(12) United States Patent
Lawit et al.

(10) Patent No.: US 11,466,288 B2
(45) Date of Patent: Oct. 11, 2022

(54) METHODS FOR REPRODUCING PLANTS ASEXUALLY AND COMPOSITIONS THEREOF

(71) Applicants: Pioneer Hi-Bred International, Inc., Johnston, IA (US); Centro de Investigacion y de Estudios Avanzados del Instituto Politecnico Nacional (Cinvestav), Col. San Pedro Zacatenco (MX)

(72) Inventors: Shai J. Lawit, Johnston, IA (US); Marc C. Albertsen, Grimes, IA (US); Tim Fox, Des Moines, IA (US); William Gordon-Kamm, Urbandale, IA (US); Michelle M. Van Allen, Urbandale, IA (US); Jean-Philippe Vielle Calzada, Guanajuato (MX); Carlos Barragan Rosillo, Guanajuato (MX); Edgar Demesa Arevalo, Guanajuato (MX); Carlos Gonzalez Chavez, Guanajuato (MX); Elvira Hernandez Lagana, Guanajuato (MX); Gloria Leon Martinez, Guanajuato (MX); Nidia Sanchez Leon, Guanajuato (MX); Daniel Rodriguez Leal, Guanajuato (MX); Isaac Rodriguez Arevalo, Guanajuato (MX); Jaime Padilla Calzada, Guanajuato (MX)

(73) Assignees: Pioneer Hi-Bred International, Inc., Johnston, IA (US); Centro de Investigacion y de Estudios Avanzados del Instituto Politecnico Nacional (Cinvestav)

( * ) Notice: Subject to any disclaimer, the term of this patent is extended or adjusted under 35 U.S.C. 154(b) by 0 days.

(21) Appl. No.: 15/512,629

(22) PCT Filed: Sep. 21, 2015

(86) PCT No.: PCT/US2015/051260
§ 371 (c)(1),
(2) Date: Mar. 20, 2017

(87) PCT Pub. No.: WO2016/048909
PCT Pub. Date: Mar. 31, 2016

(65) Prior Publication Data
US 2017/0290279 A1  Oct. 12, 2017

Related U.S. Application Data

(60) Provisional application No. 62/053,587, filed on Sep. 22, 2014.

(51) Int. Cl.
*A01H 1/08* (2006.01)
*A01H 6/20* (2018.01)
*C12N 15/82* (2006.01)
*C07K 14/415* (2006.01)

(52) U.S. Cl.
CPC .......... *C12N 15/8287* (2013.01); *A01H 1/08* (2013.01); *A01H 6/202* (2018.05); *A01H 6/203* (2018.05); *A01H 6/206* (2018.05); *C07K 14/415* (2013.01)

(58) Field of Classification Search
None
See application file for complete search history.

(56) References Cited

U.S. PATENT DOCUMENTS

| | | | |
|---|---|---|---|
| 7,029,917 B2* | 4/2006 | Fischer | C07K 14/415 435/468 |
| 7,759,546 B2* | 7/2010 | Scott | C07K 14/415 800/285 |
| 2003/0074687 A1 | 4/2003 | Scott | |
| 2003/0233687 A1 | 12/2003 | Gawthrop | |
| 2012/0291155 A1 | 11/2012 | Grimanelli et al. | |
| 2013/0180001 A1* | 7/2013 | Vielle-Calzada | C12N 15/8218 800/260 |
| 2013/0180005 A1 | 7/2013 | Cigan et al. | |
| 2016/0208282 A1 | 7/2016 | Vielle Calzada et al. | |

FOREIGN PATENT DOCUMENTS

| | | |
|---|---|---|
| CA | 2925017 A1 | 3/2015 |
| CA | 2962199 A1 | 3/2016 |
| MX | 2016003845 A | 1/2017 |
| MX | 2017003676 A | 11/2017 |
| WO | WO-2011/064668 A2 | 6/2011 |

(Continued)

OTHER PUBLICATIONS

Fujimoto et al. Genes and Genetic Systems 81: 235-242 (2006).*
Radke et al. Plant Cell Reports 11: 499-505 (1992).*
Reiser et al. Cell 83: 735-742 (1995).*
Rodrigues et al. Sexual Plant Reproduction 23: 123-133 (2010).*
Rodrigues et al. The Plant Cell 20: 2372-2386 (2008).*
Wang et al. Nature Genetics 43(10): 1035-1040 (Oct. 2011).*
Peragine et al. Genes and Development 18(19): 2368-2379 (Oct. 2004).*
Armenta-Medina, A. et al., Epigenetic Control of Cell Specification During Female Gametogenesis. Sexual Plant Reproduction. Springer. 2011; 24(2):137-47.

(Continued)

*Primary Examiner* — Stuart F Baum
(74) *Attorney, Agent, or Firm* — Ballard Spahr LLP

(57) ABSTRACT

Disclosed are methods of obtaining clonal seeds, methods of plant cloning, methods of screening for maternal plants that produce clonal seeds asexually and methods of increasing yield of clonal seeds. Also disclosed are constructs comprising a nucleic acid that may silence the activity of a RNA-dependent DNA methylation pathway gene. Further disclosed are maternal plants comprising a construct wherein the construct comprises an exogenous nucleic acid sequence, wherein the construct renders the maternal plant defective for RNA-dependent DNA methylation.

2 Claims, 26 Drawing Sheets

Specification includes a Sequence Listing.

(56) References Cited

FOREIGN PATENT DOCUMENTS

| WO | WO-2015/040493 A2 | 3/2015 |
|---|---|---|
| WO | WO-2016/048909 A1 | 3/2016 |

OTHER PUBLICATIONS

Chinnusamy, V. and Zhu, J.-K., RNA-Directed DNA Methylation and Demethylation in Plants. Sci China C Life Sci. 2009; 52(4):331-43.
Huh, J.H. et al., Endosperm Gene Imprinting and Seed Development. Curr Opin Genet Dev. 2007; 17(6):480-5.
Olmedo-Monfil, V. et al., Control of Female Gamete Formation by a Small RNA Pathway in *Arabidopsis*. Nature. 2010; 464(7288):628-32 (7 pages).
Singh, M. et al., Production of Viable Gametes without Meiosis in Maize Deficient for an Argonaute Protein. Plant Cell. 2011; 23(2):443-58.
Tas, I.C.Q. and Van Dijk, P.J., Crosses Between Sexual and Apomictic Dandelions (*Taraxacum*). I. The Inheritance of Apoximis. Heredity. 2009; 83(6):707-14.
International Search Report and Written Opinion dated Aug. 21, 2015 for Ppplication No. PCT/IB2014/002702, which was filed on Sep. 22, 2014 and published as WO 2015/040493 on Mar. 26, 2015 (Applicant—Centro de Investigación y de Estudios Avanzados del Inst Politecnico Nac (cinvestav); Inventor—Vielle Calzada et al.) (21 pages).
International Preliminary Report on Patentability dated Mar. 29, 2015 for Application No. PCT/IB2014/002702, which was filed on Sep. 22, 2014 and published as WO 2015/040493 on Mar. 26, 2015 (Inventor—Vielle Calzada et al.; Applicant—Centro de Investigación y de Estudios Avanzados del Inst Politecnico Nac (cinvestav) (13 pages).
Preliminary Amendment filed on Mar. 22, 2016 with the U.S. Patent and Trademark Office for U.S. Appl. No. 15/023,950, filed Mar. 22, 2016 and published as US 2016/0208282 on Jul. 21, 2016 (Inventor—Vielle Calzada et al.; Applicant—Centro de Investigación y de Estudios Avanzados del Inst Politecnico Nac (cinvestav) (3 pages).
Restriction Requirement dated Oct. 5, 2017 by the U.S. Patent and Trademark Office for U.S. Appl. No. 15/023,950, filed Mar. 22, 2016 and published as US 2016/0208282 on Jul. 21, 2016 (Inventor—Vielle Calzada et al.; Applicant—Centro de Investigación y de Estudios Avanzados del Inst Politecnico Nac (cinvestav) (13 pages).
Response to Restriction Requirement filed on Feb. 5, 2018 with the U.S. Patent and Trademark Office for U.S. Appl. No. 15/023,950, filed Mar. 22, 2016 and published as US 2016/0208282 on Jul. 21, 2016 (Inventor—Vielle Calzada et al.; Applicant—Centro de Investigación y de Estudios Avanzados del Inst Politecnico Nac (cinvestav) (15 pages).
International Search Report and Written Opinion dated Feb. 5, 2016 by the International Searching Authority for International Patent Application No. PCT/US2015/051260, which was filed on Sep. 21, 2015 and published as WO 2016/048909 on Mar. 31, 2016 (Inventor—Lawit et al.; Applicant—Pioneer Hi-Bred International, Inc. et al.) (19 pages).
International Preliminary Report on Patentability dated Mar. 28, 2017 by the International Searching Authority for International Patent Application No. PCT/US2015/051260, which was filed on Sep. 21, 2015 and published as WO 2016/048909 on Mar. 31, 2016 (Inventor—Lawit et al.; Applicant—Pioneer Hi-Bred International, Inc. et al.) (14 pages).
FitzGerald et al. "DNA Methylation Causes Predominant Maternal Controls of Plant Embryo Growth" Plos One, vol. 3 No. 5, e2298. (2008).
Non Final Rejection dated Apr. 26, 2018 by the USPTO for U.S. Appl. No. 15/023,950, filed Mar. 22, 2016 and published as US 2016/0208282 A1 on Jul. 21, 2016 (Inventor—Jean-Philippe Vielle Calzada,et al.) (12 pages).
Hernandez-Lagana et al. (2016) A Multigenic Network of Argonaute4 Clade Members Controls Early Megaspore Formation in *Arabidopsis*. Genetics. 204(3):1045-56 (17 pages).
Office Action dated Jan. 15, 2019 by the Mexican Patent Office for MX Application No. MX/a/2016/003845, filed on Sep. 22, 2014 and published as MX 2016003845 A on Jan. 5, 2017(Applicant—Centro de Investigacion y Estudios Avanzados del Instituto Politecnico Nacional MX/a(Cinvestav) (Original—6 pages; Translation—5 pages).
Final Rejection dated Mar. 11, 2019 to the USPTO for U.S. Appl. No. 15/023,950, filed Mar. 22, 2016 and published as US 2016/0208282 A1 on Jul. 21, 2016 (Inventor—Jean-Philippe Vielle Calzada et al.) (14 pages).
Office Action dated Mar. 21, 2019 by the Mexican Patent Office for MX Application No. MX/a/2017/003676, filed on Sep. 21, 2015 (Applicant—Pioneer Hi-Bred International, Inc.) (5 Pages).
Office Action dated Sep. 26, 2019 by the Mexican Patent Office for MX Application No. MX/a/2016/003845, filed on Sep. 22, 2014 and published as on (Applicant—Centro de Investigacion y de Estudios Avanzados del Instituto Politecnico Nacional) (Original—21 pages// Translation—29 pages).
Feng Qu et al. RDR6 Has a Broad-Spectrum but Temperature-Dependent Antiviral Defense Role in Nicotiana benthamiana, J Virol. Dec. 2005; 79(24): 15209-15217. (9 pages).
Magdy M Mahfouz, RNA-directed DNA methylation: mechanisms and functions, Plant Signal Behav Jul. 2010;5(7):806-16. doi: 10.4161/psb.5.7.11695. Epub Jul. 1, 2010. (11 pages).

* cited by examiner

| | mutant (female) X wild-type (male) | | |
|---|---|---|---|
| | ovules with MMC-like cells (%) | ovules with 2FGs (%) | triploid (2n+n) progeny (%) |
| *rdr6-15* (F2) | 33.88 | 29.6 | 16.2 (n=850) |
| *ago4-1* (F2) | 39.8 | 19.5 | 17.1 (n=620) |
| *ago9-3* (F2) | 37.16 | 14.7 | 11.3 (n=350) |

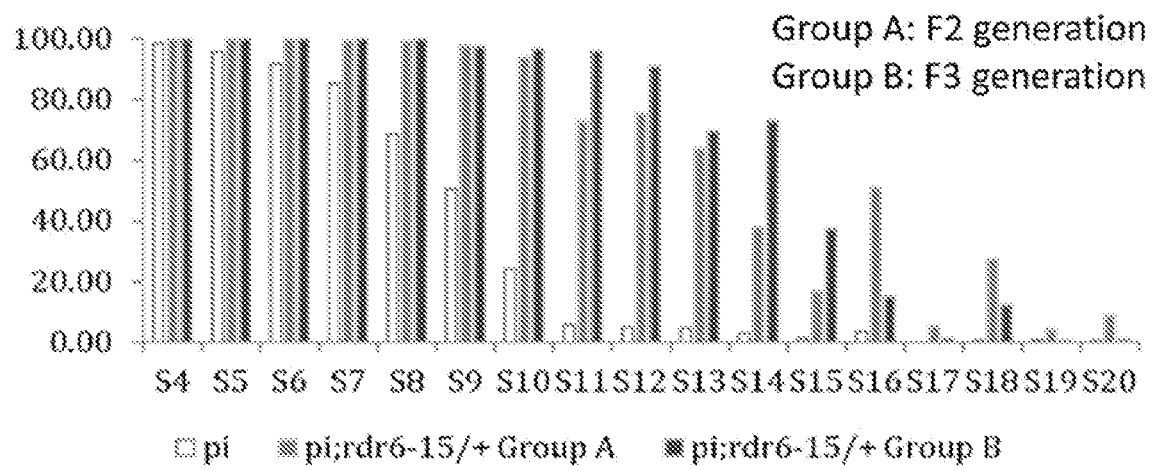
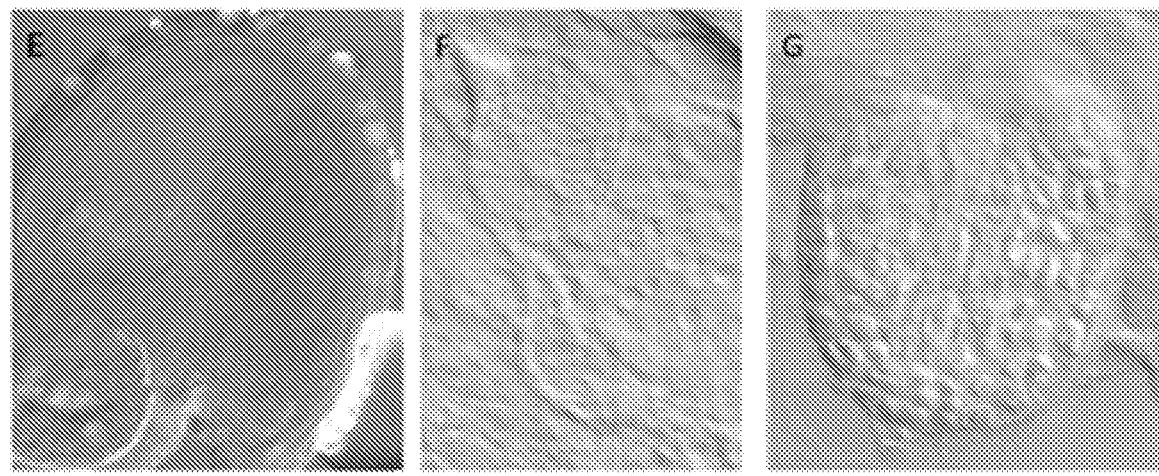
FIG. 2D, FIG. 2E, FIG. 2F and FIG. 2G

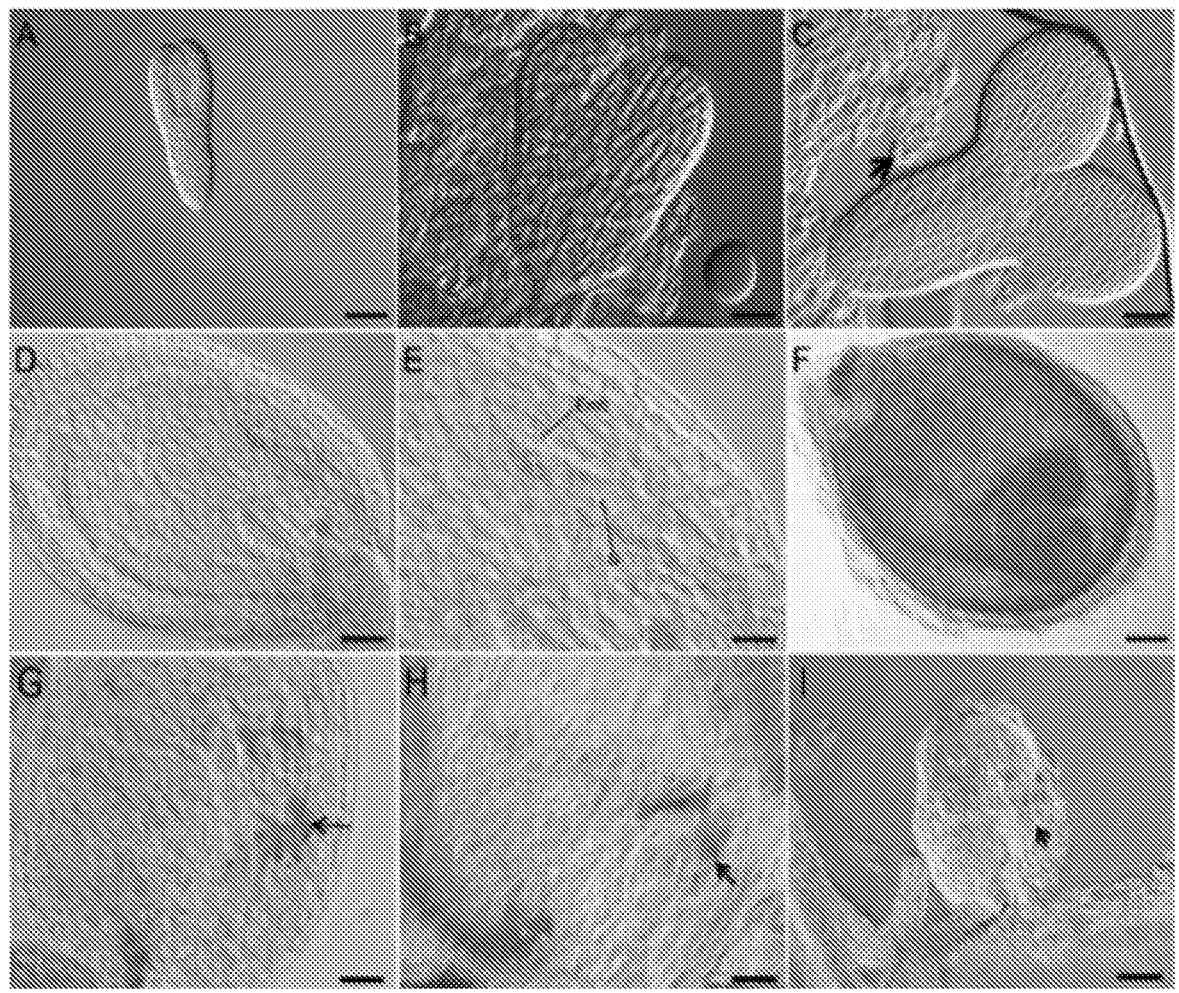
FIG. 3A, FIG. 3B, FIG. 3C, FIG. 3D, FIG. 3E, FIG. 3F, FIG. 3G, FIG. 3H, and FIG. 3I

REPLACEMENT SHEET

FIG. 4

Legend: L = *Landsberg* allele
LC = Heterozygous
C = *Columbia-0* allele

Molecular markers: A=T19D16-T7-2; B=F16J7-TR6; C=CAT3; D=NGA280; E=NPR1; F=ADH; G=CIW2; H=M421B; I=CIW3; J=ER; K=VE017; NGA168; M=G4711; N=AFC1; O=TSA1; P=CIW5; Q=JV30/31; R=CIW5; S=LD; T=NGA8; U=FCA35; V=FCA312; W=G4539; X=NGA1107; Y=CIW7; Z=MQJB; W=*Psitillata*; WW=PAT1.1; XX=PHYC.2; YY=PDC2; ZZ=EG7F2; AA=ATTED2

| Genotype[a] | Ploidy[b] | Seeds Recovered[c] |
|---|---|---|
| F2 | | |
| pi rdr6-15/+ (1) | 2n | 27 |
| pi rdr6-15/+ (2) | 2n | 68 |
| pi rdr6-15/+ (3) | 2n | 29 |
| pi rdr6-15/+ (4) | 2n | 26 |
| pi rdr6-15/+ (5) | 2n | 11 |
| | | |
| F3 | | |
| pi rdr6-15/+ (1.1) | 2n | 11 |
| pi rdr6-15/+ (1.2) | 2n | 257 |
| pi rdr6-15/+ (1.3) | 2n | 35 |
| | | |
| F2 | | |
| pi ago4-1/ago4-1 (1) | 2n | 15 |
| pi ago4-1/+ (2) | ND | 28 |
| pi ago4-1/+ (3) | ND | 44 |
| pi ago4-1/+ (4) | ND | 293 |
| pi ago4-1/ago4-1 (5) | 2n | 46 |
| | | |
| F3 | | |
| pi ago4-1/ago4-1 (3.1) | 2n | 11 |
| pi ago4-1/+ (3.2) | 2n | 10 |
| pi ago4-1/+ (3.3) | 2n | 21 |
| pi ago4-1/+ (5.1) | 2n | 28 |
| pi ago4-1/ago4-1 (5.2) | 2n | 86 |
| pi ago4-1/+ (5.3) | 2n | 125 |

| Silique | pi Turgid (%) | pi Aborted (%) | SE | pisrdr6-15/+ (F2) Turgid (%) | pisrdr6-15/+ (F2) Aborted (%) | SE | pisrdr6-15/+ (F3) Turgid (%) | pisrdr6-15/+ (F3) Aborted (%) | SE |
|---|---|---|---|---|---|---|---|---|---|
| S4 | 196 (98.49) | 3 (1.51) | 1.415 | 183 (100) | 0 (0) | 0 | 262 (100) | 0 (0) | 0 |
| S5 | 179 (95.72) | 8 (4.28) | 4.480 | 234 (100) | 0 (0) | 0 | 256 (100) | 0 (0) | 0 |
| S6 | 138 (92.01) | 12 (8) | 6.806 | 213 (100) | 0 (0) | 0 | 180 (100) | 0 (0) | 0 |
| S7 | 199 (85.41) | 34 (14.59) | 12.159 | 208 (99.52) | 1 (0.48) | 0.528 | 227 (100) | 0 (0) | 0 |
| S8 | 153 (68.61) | 70 (31.39) | 21.234 | 306 (99.35) | 2 (0.65) | 0.422 | 195 (100) | 0 (0) | 0 |
| S9 | 97 (50.52) | 95 (49.48) | 20.831 | 327 (97.9) | 7 (2.1) | 2.236 | 243 (97.59) | 6 (2.41) | 2.083 |
| S10 | 5 (24.17) | 160 (75.83) | 20.989 | 209 (94.14) | 13 (5.86) | 3.856 | 152 (96.82) | 5 (3.18) | 12.381 |
| S11 | 10 (5.59) | 169 (94.41) | 0.437 | 222 (72.79) | 83 (27.21) | 16.972 | 246 (96.09) | 10 (3.91) | 2.528 |
| S12 | 10 (4.93) | 193 (95.07) | 0.414 | 182 (75.52) | 59 (24.48) | 12.282 | 165 (91.16) | 16 (8.84) | 8.237 |
| S13 | 10 (4.74) | 201 (95.26) | 3.437 | 182 (63.86) | 103 (36.14) | 16.941 | 142 (69.61) | 62 (30.39) | 12.416 |
| S14 | 5 (2.82) | 172 (97.18) | 2.180 | 92 (37.86) | 151 (62.14) | 19.027 | 95 (73.08) | 35 (26.92) | 17.450 |
| S15 | 2 (1.25) | 158 (98.75) | 0.926 | 26 (16.67) | 130 (83.33) | 17.142 | 77 (37.33) | 129 (62.62) | 17.162 |
| S16 | 6 (3.43) | 169 (96.57) | 2.751 | 128 (51.2) | 122 (48.8) | 19.800 | 33 (15.21) | 184 (84.79) | 13.934 |
| S17 | 0 (0) | 206 (100) | 0.000 | 9 (5.45) | 156 (94.5) | 1.781 | 2 (1.17) | 169 (98.83) | 12.383 |
| S18 | 1 (0.51) | 191 (99.49) | 0.397 | 50 (27.47) | 132 (72.53) | 16.302 | 18 (12.08) | 131 (87.92) | 13.861 |
| S19 | 1 (0.62) | 161 (99.38) | 0.410 | 5 (4.1) | 117 (95.90) | 1.031 | 1 (0.5) | 200 (99.5) | 12.457 |
| S20 | 1 (0.48) | 206 (99.52) | 0.313 | 15 (8.93) | 153 (91.07) | 4.222 | 2 (0.89) | 223 (99.11) | 12.383 |

FIG. 8

| Genotype | Aborted Ovules % | Developing seeds (%) | Seeds with cotyledonary embryos (%)[a] | n |
|---|---|---|---|---|
| ago4-6 | 1976 (61.8) | 1214 (37.9) | 10 (0.3) | 3200 |
| ago9-2 | 4544 (55.1) | 3689 (44.7) | 16 (0.2) | 8249 |
| rdr6-15/+ | 4243 (73.8) | 1494 (25.48) | 12 (0.2) | 5749 |

[a] Embryos were observed under microscope and Nomarsky optics.

FIG. 9

| Mutant line Individual | Siliques | Aborted Ovules (%) | Developing seeds (%) | Seeds with cotyledonary embryos (%)[a] | n |
|---|---|---|---|---|---|
| ago9-2.1 | 14 | 225 (32.3) | 469 (67.3) | 3 (0.4)[b] | 697 |
| ago9-2.2 | 14 | 413 (61.5) | 258 (38.4) | 1 (0.1) | 672 |
| ago9-2.3 | 14 | 185 (27.7) | 482 (72.3) | 0 | 667 |
| ago9-2.4 | 13 | 139 (22.9) | 469 (77.1) | 0 | 608 |
| ago9-2.5 | 10 | 55 (12.9) | 371 (86.7) | 2 (0.5) | 428 |
| ago 9-2.6 | 15 | 243 (36.6) | 419 (63.1) | 2 (0.3) | 664 |
| ago9-2.7 | 11 | 161 (36.3) | 282 (63.5) | 1 (0.2) | 444 |
| ago9-2.8 | 12 | 104 (17.0) | 507 (82.8) | 1 (0.2) | 612 |
| Total | 103 | 1525 | 3257 | 10 | 4792 |
| Average | 12.87 | 190.62 (30.9) | 407 (68.9) | 1.25 | |

FIG. 10

| Mutant line individual | Siliques | Aborted ovules (%) | Developing seeds (%) | Seeds with cotyledonary embryos (%)[a] | n |
|---|---|---|---|---|---|
| rdr6-15.1/+ | 10 | 320 (71) | 121 (27) | 9 (2)[b] | 450 |
| rdr6-15.3/+ | 14 | 447 (63.5) | 257 (36.5) | 0 | 704 |
| rdr6-15.4/+ | 18 | 617 (65) | 330 (35) | 0 | 947 |
| rdr6-15.5/+ | 3 | 115 (100) | 0 | 0 | 115 |
| rdr6-15.6/+ | 7 | 314 (91.3) | 30 (8.7) | 0 | 344 |
| rdr6-15.7/+ | 19 | 694 (77.6) | 199 (22.2) | 2 (0.2)[b] | 895 |
| rdr6-15.8/+ | 13 | 488 (77) | 146 (23) | 0 | 634 |
| rdr6-15.9/+ | 5 | 196 (84.5) | 36 (15.5) | 0 | 232 |
| rdr6-15.10/+ | 10 | 394 (80) | 100 (20) | 0 | 494 |
| rdr6-15.11/+ | 9 | 391 (74.2) | 136 (25.8) | 0 | 527 |
| rdr6-15.12/+ | 6 | 267 (65.6) | 139 (34.2) | 1 (0.2) | 407 |

FIG. 11

| Mutant line individual | Siliques | Aborted ovules (%) | Developing seeds (%) | Seeds with cotyledonary embryos (%)[a] | n |
|---|---|---|---|---|---|
| ago4-6.1 | 4 | 86 (57.7) | 62 (41.6) | 1 (0.7) | 149 |
| ago4-6.2 | 18 | 350 (43.5) | 452 (56.2) | 2 (0.2) | 804 |
| ago4-6.3 | 10 | 284 (56.7) | 215 (42.9) | 2 (0.4) | 501 |
| ago4-6.4 | 10 | 437 (89.9) | 45 (9.3) | 4 (0.8) | 486 |
| ago4-6.5 | 12 | 399 (66.4) | 202 (33.6) | 0 | 601 |
| ago4-6.6 | 14 | 420 (63.7) | 238 (36.1) | 1 (0.2) | 659 |

| Genotype | Ploidy | Seeds recovered |
|---|---|---|
| pi rdr6-15 (F2) | 2N | 27 |
| | 2N | 68 |
| | 2N | 29 |
| | 2N | 26 |
| pi rdr6-15 (F3) | 2N | 11 |
| | 2N | 11 |
| | 2N | ND |
| | 2N | 35 |
| | 2N | 44 |
| pi ago4-1 (F2) | 2N | 28 |
| | 2N | 46 |
| | 2N | 15 |
| | 2N | ND |
| pi ago4-1 (F3) | 2N | 11 |
| | 2N | 10 |
| | 2N | 21 |
| | 2N | 28 |
| | 2N | 86 |
| | 2N | ND |
| | 2N | 11 |

*Only individuals from which seeds were recovered are shown.

A

*Turgid ovules*

B

*Aborted ovules*

C

| Genotype | Recovered seeds |
|---|---|
| ago4-6 | 19 |
| ago9-2 | 5 |
| rdr6-15/+ | 9 |
| WT Col-0 | 0 |

*Vanilin red staining is positive for the presence of proanthocyanidins.
White dashed circles.

| GEN | ID | ALLELE | Mutant stock Id | TYPE OF MUTATION | Mutation site (Apolab info) | REFERENCE | Predicted insertion site (SALK information) | Observations |
|---|---|---|---|---|---|---|---|---|
| AGO4 | AT2G27040 | ago4-6 | SALK_071772 | T-DNA insertion | Insertion within the promoter | Strickler et al. 2013. G3 | T-DNA insertion within predicted promoter before 779 nucleotides from ATG | |
| AGO4 | AT2G27040 | ago4-1 | CS6364 | EMS induced | Substitution in nt 2924 from ATG | Zilberman et al., 2003. Science | | |
| AGO6 | AT2G32940 | ago6-2 | SALK_031553 | T-DNA insertion | Insertion within exon 2 | Zheng et al. 2007. The EMBO journal | T-DNA insertion within predicted exon1 in front of nucleotide 175 from ATG | |
| AGO8 | AT5G21030 | ago8-1 | SALK_139894 | T-DNA insertion | Insertion within exon 3 | Havecker, et al. 2012. Plos One | T-DNA insertion within predicted exon2 in front of nucleotide 603 from ATG | |
| AGO9 | AT5G21150 | ago9-2 | SALK_112059 | T-DNA insertion | Insertion within intron 16 | Takeda et al. 2008. Plant and cell physiology | T-DNA insertion within predicted intron 16 in front of nucleotide 3595 from ATG | |
| AGO9 | AT5G21150 | ago9-3 | SAIL_34_G10 | T-DNA insertion | Insertion within exon 22 | Olmedo-Monfil et al. 2010. Nature | T-DNA insertion within predicted exon 22 in front of nucleotide 4609 from ATG | |
| AGO9 | AT5G21150 | ago9-4 | SAIL_260_A03 | T-DNA insertion | Insertion within exon 18 | Olmedo-Monfil et al. 2010. Nature | | |
| RDR2 | AT4G11130 | rdr2-1 | SAIL_1277H08 | T-DNA insertion | Insertion within exon 1 in front of nt 316 from the ATG | Xie et al., 2004. Plos Biology | | |
| RDR6 | AT3G49500 | rdr6-15 | SAIL_617_H07 | T-DNA insertion | Insertion within exon 1 in front of nt 312 from the ATG | Sanchez-León et al, 2013 | | |

FIG. 25

| | | | | | | | Wrong annotation in SALK stock |
|---|---|---|---|---|---|---|---|
| RDR6 | AT3G49500 | rdr6-11 | | EMS induced | Substitution in nt 993 from ATG | Peragine et al., 2004. Genes & Development. | |
| NRPD1 | AT1G63020 | nrpd1a | SALK_083051 | T-DNA insertion | Insertion within predicted exon 12 in front of nt 4372 from ATG | Herr, et al. 2005. Science | |
| NRPE1 | AT2G40030 | nrpd1b-11 | SALK_029919 | T-DNA insertion | Insertion within predicted exon 12 | Pontier et al. 2005. Genes and Development | |
| SGS3 | AT5G23570 | sgs3-11 | | EMS induced | Substitution G by A in nt 2283 from ATG (G by A), splicing site | Peragine et al., 2004. Genes & Development. | |
| DRM2 | AT5G14620 | drm2-2 | SALK_150863 | T-DNA insertion | Insertion within predicted exon 10 | Naumann et al. 2011. Genetics. | T-DNA insertion in front of nucleotide 2809 from ATG |
| MET1 | AT5G49160 | met1-7 | SALK_076522 | T-DNA insertion | Insertion within predicted exon 1 | | T-DNA insertion in front of nucleotide 1263 from ATG |
| EXS1 | AT5G07280 | exs1 | SALK_138083 | T-DNA insertion | Not Determined Yet | | T-DNA insertion within predicted promoter before 500 nucleotides from ATG |
| DCL3 | AT3G43920 | dcl3-1 | SALK_005512 | T-DNA insertion | Insertion within predicted exon 7 at nt 2 136 from ATG | Xie et al., 2004. Plos Biology | |
| CMT3 | AT1G69770 | cmt3_11t | SALK_148381 | T-DNA insertion | Not determined Yet | | T-DNA insertion in front of nucleotide 2170 from ATG |

FIG. 25 Continued

METHODS FOR REPRODUCING PLANTS ASEXUALLY AND COMPOSITIONS THEREOF

CROSS-REFERENCE TO RELATED APPLICATIONS

This Application claims the benefit of and priority under 35 U.S.C. § 371 to PCT/US2015/051260, filed Sep. 21, 2015, which claims the benefit under 35 U.S.C. § 119(e) to U.S. Provisional Application No. 62/053,587, filed on Sep. 22, 2014, which applications are incorporated herein by reference in their entireties.

REFERENCE TO SEQUENCE LISTING

The Sequence Listing submitted Mar. 20, 2017 as a text file named "37487_0002U2_Sequence Listing.txt," created on Mar. 20, 2017, and having a size of 8,101,836 bytes is hereby incorporated by reference pursuant to 37 C.F.R. § 1.52(e)(5).

BACKGROUND

The majority of cultivated plants reproduce in a sexual manner. In sexual reproduction, the fusion of male and female gametes leads to the formation of seeds that combine maternal and paternal traits.

Although sexual reproduction predominates, plant species exist that reproduce themselves asexually through seeds. This asexual reproduction, termed apomixis, is a natural cloning process by which the female reproductive organ of a plant, the ovule, is able to form the embryonic portion of seeds, without the need for a genetic contribution from male gametes. In particular, an ovule of an apomictic plant produces one or more unreduced female gametes that form without undergoing meiosis. Accordingly, each unreduced female gamete maintains the somatic genotype of the parent plant when the gamete is incorporated into a seed and ultimately develops to form a child plant that is a clone of the parent.

The induction of apomixes in cultivated plants, such as in edible cereals, constitutes one of the most attractive challenges of agricultural biotechnology. Currently, the majority of improved, commercial seeds are the result of a long hybridization process in which certain plants that present desirable traits are selected and crossed to obtain seeds for an improved hybrid. However, the agronomic value of the improved hybrid is maintained only during one cultivation cycle. The natural sexuality of the hybrid causes the next generation to lose many of the desirable characteristics of the hybrid through separation of genetic traits. As a consequence, competitive producers find themselves obliged to buy seed year after year if they want to maintain high performance.

The ability to generate apomictic plant varieties would have tremendous commercial benefits. For example, creation of improved hybrids that exhibit a high rate of apomixis can, in some cases, make it possible for farmers to recurrently sow the seed produced by the improved hybrid, thereby maintaining the agronomic value of the seed for multiple generations (and potentially indefinitely). Also, by genetically fixing the agronomic value of any sexual cultivation, the ability to induce apomixis can encourage plant breeders to develop customized plant varieties adapted to specific environmental conditions. Additionally, the induction of apomixis offers the possibility of eliminating the use of costly cultivation techniques associated with vegetative reproduction of crop plants (e.g., potato, agave, and strawberry, among others). An ability to induce apomixis also can permit the preservation of individual plants with high rates of heterozygosis, such as vegetable species that are in danger of extinction.

Thus, there is a need for a maternal plant that produces clonal seeds asexually, with each clonal seed containing an embryo that is a clone of the maternal plant, and with germination of each clonal seed forming a progeny plant that is a clone of the maternal plant.

BRIEF SUMMARY

Disclosed are methods of obtaining clonal seeds comprising a) obtaining a maternal plant, wherein the maternal plant is unable to be pollinated; and b) collecting one or more seeds produced by the maternal plant, wherein the one or more seeds comprise an embryo that is a clone of the maternal plant.

Disclosed are methods of obtaining clonal seeds comprising a) obtaining a maternal plant, wherein the maternal plant is unable to be pollinated; and b) collecting one or more seeds produced by the maternal plant, wherein the one or more seeds comprise an embryo that is a clone of the maternal plant, wherein the maternal plant is defective in at least one RNA dependent DNA methylation pathway gene. For example, the RNA dependent DNA methylation pathway gene may be any of the polynucleotides or polypeptides included in Table 1 and the sequences in the accompanying sequence listing, AGO4 (ARGONAUTE 4), AGO6 (ARGONAUTE 6), AGO8 (ARGONAUTE 8), AGO9 (ARGONAUTE 9), CMT3 (CHROMOMETHYLASE 3), DCL3 (DICER-LIKE 3), DRM2 (DOMAINS REARRANGED METHYLASE 2), EXS1 (EXTRA SPOROGENOUS CELLS1), IDN2 (INVOLVED IN DE NOVO 2), MET1 (METHYL TRANSFERASE 1), NPRD1a (NUCLEAR POLYMERASE D 1a), NRPD1b (NUCLEAR POLYMERASE D 1b), NRPD2 (NUCLEAR POLYMERASE D 2), NRPE1 (NUCLEAR RNA POLYMERASE E 1), NRPE2 (NUCLEAR RNA POLYMERASE E 2), RDR2 (RNA-DEPENDENT RNA POLYMERASE 2), RDR6 (RNA-DEPENDENT RNA POLYMERASE 6), SGS3 (SUPPRESSOR OF GENE SILENCING 3), SUVH2 (SUPPRESSOR OF VARIEGATION 3-9 HOMOLOG 2), and SUVH9 (SUPPRESSOR OF VARIEGATION 3-9 HOMOLOG 9). In some instances, the AGO4 allele may be ago4-6 or ago4-1. In some instances, the AGO6 allele may be ago6-2. In some instances, the AGO9 allele may be 9-2, 9-3 or 9-4. In some instances, the AGO8 allele may be ago 8-1. In some instances, the RDR2 allele may be rdr2-1. In some instances, the RDR6 allele may be rdr6-15 or rdr6-11. In some instances, the SGS3 allele may be sgs3-11. In some instances, the DRM2 allele may be drm2-2. In some instances, the MET1 allele may be met1-7.

Disclosed are methods of obtaining clonal seeds comprising a) obtaining a maternal plant, wherein the maternal plant is unable to be pollinated; and b) collecting one or more seeds produced by the maternal plant, wherein the one or more seeds comprise an embryo that is a clone of the maternal plant further comprising pollinating the maternal plant prior to collecting the seeds and sorting the seeds to separate clonal seeds from non-clonal seeds.

Disclosed are methods of obtaining clonal seeds comprising a) obtaining a maternal plant, wherein the maternal plant is unable to be pollinated; and b) collecting one or more seeds produced by the maternal plant, wherein the one or more seeds comprise an embryo that is a clone of the maternal plant further comprising pollinating the maternal plant prior to collecting the seeds and sorting the seeds to separate clonal seeds from non-clonal seeds, wherein sorting the seeds is based on distinguishing the size, shape, size and shape, or genetics of the embryos. The sorting may be performed manually or automatically. In some instances, automatic sorting comprises a machine comprising an optical detector. In some instances, the sorting may be done visually.

Disclosed are methods of obtaining clonal seeds comprising a) obtaining a maternal plant, wherein the maternal plant is unable to be pollinated; and b) collecting one or more seeds produced by the maternal plant, wherein the one or more seeds comprise an embryo that is a clone of the maternal plant, wherein the maternal plant is exposed to a gametocide that abolishes pollen formation. Gametocides may include at least one of maleic hydrazide (1,2-dihydropyridazine, 3-6-dione) (MH), 2,4-dichlorophenoxyacetic acid (2,4-D), a-naphthalene acetic acid (NAA), and tri-iodobenzoic acid (TIBA).

Disclosed are methods of obtaining clonal seeds comprising a) obtaining a maternal plant, wherein the maternal plant is unable to be pollinated; and b) collecting one or more seeds produced by the maternal plant, wherein the one or more seeds comprise an embryo that is a clone of the maternal plant further comprising emasculating the maternal plant before collecting the seeds.

Also disclosed are methods of screening for maternal plants that produce clonal seeds asexually comprising a) obtaining a maternal plant; b) silencing the activity of a gene of interest producing a transformed maternal plant; crossing the transformed maternal plant with a sterile male plant; and d) harvesting the seeds; wherein the presence of clonal seeds indicates the maternal plant may produce clonal seeds asexually.

Disclosed are methods of screening for maternal plants that produce clonal seeds asexually comprising a) obtaining a maternal plant; b) silencing the activity of a gene of interest producing a transformed maternal plant; crossing the transformed maternal plant with a sterile male plant; and d) harvesting the seeds; wherein the presence of clonal seeds indicates the maternal plant may produce clonal seeds asexually, wherein silencing the activity of a gene of interest comprises RNA interference.

Disclosed are methods of screening for maternal plants that produce clonal seeds asexually comprising a) obtaining a maternal plant; b) silencing the activity of a gene of interest producing a transformed maternal plant; crossing the transformed maternal plant with a sterile male plant; and d) harvesting the seeds; wherein the presence of clonal seeds indicates the maternal plant may produce clonal seeds asexually, wherein the gene of interest is a RNA dependent DNA methylation pathway gene. The gene of interest may be any of the polynucleotides included in Table 1 and sequences in the accompanying sequence listing, AGO4 (ARGONAUTE 4), AGO6 (ARGONAUTE 6), AGO8 (ARGONAUTE 8), AGO9 (ARGONAUTE 9), CMT3 (CHROMOMETHYLASE 3), DCL3 (DICER-LIKE 3), DRM2 (DOMAINS REARRANGED METHYLASE 2), EXS1 (EXTRA SPOROGENOUS CELLS1), IDN2 (INVOLVED IN DE NOVO 2), MET1 (METHYL TRANSFERASE 1), NPRD1a (NUCLEAR POLYMERASE D 1a), NPRD1b (NUCLEAR POLYMERASE D 1b), NPRD2 (NUCLEAR POLYMERASE D 2), NRPE1 (NUCLEAR RNA POLYMERASE E 1), NRPE2 (NUCLEAR RNA POLYMERASE E 2), RDR2 (RNA-DEPENDENT RNA POLYMERASE 2), RDR6 (RNA-DEPENDENT RNA POLYMERASE 6), SGS3 (SUPPRESSOR OF GENE SILENCING 3), SUVH2 (SUPPRESSOR OF VARIEGATION 3-9 HOMOLOG 2), and SUVH9 (SUPPRESSOR OF VARIEGATION 3-9 HOMOLOG 9).

Disclosed are methods of increasing the yield of clonal seeds comprising obtaining a maternal plant; pollinating the maternal plant; collecting a mixture of seeds produced by the maternal plant; and sorting the mixture to separate clonal seeds from non-clonal seeds.

Disclosed are methods of increasing the yield of clonal seeds comprising obtaining a maternal plant; pollinating the maternal plant; collecting a mixture of seeds produced by the maternal plant; and sorting the mixture to separate clonal seeds from non-clonal seeds, wherein sorting the mixture to separate clonal seeds from non-clonal seeds comprises distinguishing clonal embryos from non-clonal embryos. Distinguishing clonal embryos from non-clonal embryos may comprise determining the size, shape, size and shape, or genetics of the embryos. In some instances, the sorting may be performed manually or automatically. Automatic sorting may comprise a machine comprising an optical detector. In some instances, sorting may be done visually.

Disclosed are methods of increasing the yield of clonal seeds comprising obtaining a maternal plant; pollinating the maternal plant; collecting a mixture of seeds produced by the maternal plant; and sorting the mixture to separate clonal seeds from non-clonal seeds, wherein the maternal plant is defective in at least one RNA dependent DNA methylation pathway gene. RNA dependent DNA methylation pathway genes may be any of the polynucleotides included in Table 1 and sequences in the accompanying sequence listing, AGO4 (ARGONAUTE 4), AGO6 (ARGONAUTE 6), AGO8 (ARGONAUTE 8), AGO9 (ARGONAUTE 9), CMT3 (CHROMOMETHYLASE 3), DCL3 (DICER-LIKE 3), DRM2 (DOMAINS REARRANGED METHYLASE 2), EXS1 (EXTRA SPOROGENOUS CELLS1), IDN2 (INVOLVED IN DE NOVO 2), MET1 (METHYL TRANSFERASE 1), NPRD1a (NUCLEAR POLYMERASE D 1a), NPRD1b (NUCLEAR POLYMERASE D 1b), NPRD2 (NUCLEAR POLYMERASE D 2), NRPE1 (NUCLEAR RNA POLYMERASE E 1), NRPE2 (NUCLEAR RNA POLYMERASE E 2), RDR2 (RNA-DEPENDENT RNA POLYMERASE 2), RDR6 (RNA-DEPENDENT RNA POLYMERASE 6), SGS3 (SUPPRESSOR OF GENE SILENCING 3), SUVH2 (SUPPRESSOR OF VARIEGATION 3-9 HOMOLOG 2), and SUVH9 (SUPPRESSOR OF VARIEGATION 3-9 HOMOLOG 9).

Disclosed are maternal plants comprising a construct, wherein the construct comprises an exogenous nucleic acid sequence, wherein the construct renders the maternal plant defective for RNA-dependent DNA methylation.

Disclosed are maternal plants comprising a construct, wherein the construct comprises an exogenous nucleic acid sequence, wherein the construct renders the maternal plant defective for RNA-dependent DNA methylation, wherein the exogenous nucleic acid sequence silences activity of a RNA-dependent DNA methylation pathway gene.

Disclosed are maternal plants comprising a construct, wherein the construct comprises an exogenous nucleic acid sequence, wherein the construct renders the maternal plant defective for RNA-dependent DNA methylation, wherein the exogenous nucleic acid sequence silences activity of a RNA-dependent DNA methylation pathway gene further comprising a clonal seed.

Also disclosed are maternal plants comprising a defective RNA-dependent DNA methylation pathway gene.

Disclosed are maternal plants comprising a defective RNA-dependent DNA methylation pathway gene, wherein the RNA dependent DNA methylation pathway gene is AGO4 (ARGONAUTE 4), AGO6 (ARGONAUTE 6), AGO8 (ARGONAUTE 8), AGO9 (ARGONAUTE 9), CMT3 (CHROMOMETHYLASE 3), DCL3 (DICER-LIKE 3), DRM2 (DOMAINS REARRANGED METHYLASE 2), EXS1 (EXTRA SPOROGENOUS CELLS1), IDN2 (INVOLVED IN DE NOVO 2), MET1 (METHYL TRANSFERASE 1), NPRD1a (NUCLEAR POLYMERASE D 1a), NPRD1b (NUCLEAR POLYMERASE D 1b), NPRD2 (NUCLEAR POLYMERASE D 2), NRPE1 (NUCLEAR RNA POLYMERASE E 1), NRPE2 (NUCLEAR RNA POLYMERASE E 2), RDR2 (RNA-DEPENDENT RNA POLYMERASE 2), RDR6 (RNA-DEPENDENT RNA POLYMERASE 6), SGS3 (SUPPRESSOR OF GENE SILENCING 3), SUVH2 (SUPPRESSOR OF VARIEGATION 3-9 HOMOLOG 2), and SUVH9 (SUPPRESSOR OF VARIEGATION 3-9 HOMOLOG 9).

Additional advantages of the disclosed method and compositions will be set forth in part in the description which follows, and in part will be understood from the description, or can be learned by practice of the disclosed method and compositions. The advantages of the disclosed method and compositions will be realized and attained by means of the elements and combinations particularly pointed out in the appended claims. It is to be understood that both the foregoing general description and the following detailed description are exemplary and explanatory only and are not restrictive of the invention as claimed.

BRIEF DESCRIPTION OF THE DRAWINGS

The accompanying drawings, which are incorporated in and constitute a part of this specification, illustrate several embodiments of the disclosed method and compositions and together with the description, serve to explain the principles of the disclosed method and compositions.

FIGS. 2A-2G show seed formation in unpollinated siliques of heterozygous rdr6-15 plants. In contrast to unpollinated pistillata gynoecia (FIG. 2A), unpollinated siliques of rdr16-15/+ individuals show a large frequency of growing seeds (FIG. 2B and FIG. 2C). FIG. 2D shows frequency of turgid developing seed-like organs in unpollinated siliques of pi, F2 pi rdr6-15/+ (Group A), and F3 pi rdr6-15/+ (Group B) individuals. FIGS. 2E-2G show whole-mount cleared seeds, which contained free nuclear endosperm and normally organized embryos.

FIGS. 3A-3I show autonomous seed formation in emasculated plants of ago4-5, ago9-2 and rdr6-15 plants. FIG. 3A shows an embryo from a rdr6-15 autonomous developing seed. FIG. 3B and FIG. 3C show embryos from ago4-6 autonomous seeds; uncellularized endosperm nuclei are marked by an arrow. FIG. 3D to FIG. 3F show autonomous seeds of ago9-2 showing an early globular embryo (dashed) with embryo-proper (Emb) and suspensor (S). FIG. 3G to FIG. 3I show vanillin stain in the micropylar region of a young autonomous developing seed. A and F, scale bar=50 μm; B, E, G and H, scale bar=12.5 μm; C and D, scale bar=25 μm.

FIG. 4 shows that plants originating from mature seeds produced in the absence of pollination are genetically equivalent to their mother. Maternal individuals and their progeny were genotyped for polymorphic loci; each row represents a plant and each column is a locus.

FIG. 5 shows the quantitation of ploidy levels and seed recovery in nonpollinated pi individuals that carried mutations in rdr6 or ago4.

FIGS. 7A-7C show inflorescences for the genotype indicated in the figure (scale bar=1 mm); and FIGS. 7D-7F show siliques for the genotypes indicated in the respective left side panels (scale bar=0.5 mm).

FIG. 8 shows the frequency of turgid and aborted seeds and ovules in pi and pi rdr6-15/+F2 and F3 individuals. S4 refers to the 4th siliques top to bottom (SI being the first gynoecia within the inflorescence that completely lost its floral organs following floral senescence); S20 is the oldest unpollinated silique.

FIG. 9 provides general data of emasculated rdr6-15, ago4-6, and ago9-2 mutants.

FIG. 10 shows the individual analysis of emasculated ago9-2 plants.

FIG. 11 shows the individual analysis of emasculated rdr6-15 plants.

FIG. 12 shows the individual analysis of emasculated ago4-6 plants.

FIG. 25 provides a complete list of mutants and alleles that show ectopic gametic precursor cells reminiscent of aposporous initials (apomixis).

DETAILED DESCRIPTION

Figure 1:
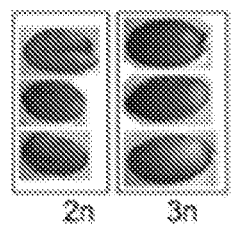
FIG. 1 shows that homozygous mutant individuals of rdr6-15, ago4-1, and ago9-3 form viable 2n gametes. Flow cytometry was used to estimate the number of triploid progeny that was recovered; triploid seeds are usually larger than diploid seeds. In all three cases, triploid progeny was recovered.

The disclosed methods and compositions can be understood more readily by reference to the following detailed description of particular embodiments and the Example included therein and to the Figures and their previous and following description.

It is to be understood that the disclosed methods and compositions are not limited to specific synthetic methods, specific analytical techniques, or to particular reagents unless otherwise specified, and, as such, can vary. It is also to be understood that the terminology used herein is for the purpose of describing particular embodiments only and is not intended to be limiting.

Disclosed are materials, compositions, and components that may be used for, may be used in conjunction with, may be used in preparation for, or are products of the disclosed method and compositions. These and other materials are disclosed herein, and it is understood that when combinations, subsets, interactions, groups, etc. of these materials are disclosed that while specific reference of each various individual and collective combinations and permutation of these compounds can not be explicitly disclosed, each is specifically contemplated and described herein. For example, if a maternal plant is disclosed and discussed and a number of modifications that may be made are discussed, each and every combination and permutation of the maternal plant and the modifications that are possible are specifically contemplated unless specifically indicated to the contrary. Thus, if a class of molecules A, B, and C are disclosed as well as a class of molecules D, E, and F and an example of a combination molecule, A-D is disclosed, then even if each is not individually recited, each is individually and collectively contemplated. Thus, is this example, each of the combinations A-E, A-F, B-D, B-E, B-F, C-D, C-E, and C-F are specifically contemplated and should be considered disclosed from disclosure of A, B, and C; D, E, and F; and the example combination A-D. Likewise, any subset or combination of these is also specifically contemplated and disclosed. Thus, for example, the sub-group of A-E, B-F, and C-E are specifically contemplated and should be considered disclosed from disclosure of A, B, and C; D, E, and F; and the example combination A-D. This concept applies to all aspects of this application including, but not limited to, steps in methods of making and using the disclosed compositions. Thus, if there are a variety of additional steps that may be performed it is understood that each of these additional steps may be performed with any specific embodiment or combination of embodiments of the disclosed methods, and that each such combination is specifically contemplated and should be considered disclosed.

A. Definitions

It must be noted that as used herein and in the appended claims, the singular forms "a", "an", and "the" include plural reference unless the context clearly dictates otherwise. Thus, for example, reference to "a polypeptide" includes a plurality of such polypeptides, reference to "the polypeptide" is a reference to one or more polypeptide and equivalents thereof known to those skilled in the art, and so forth.

Throughout the description and claims of this specification, the word "comprise" and variations of the word, such as "comprising" and "comprises," means "including but not limited to," and is not intended to exclude, for example, other additives, components, integers or steps. In particular, in methods stated as comprising one or more steps or operations it is specifically contemplated that each step comprises what is listed (unless that step includes a limiting term such as "consisting of"), meaning that each step is not intended to exclude, for example, other additives, components, integers or steps that are not listed in the step.

The word "autonomous" as used herein means in the absence of fertilization or by the process of pseudogamy. Accordingly, the terms "autonomous endosperm development" and "autonomous embryogenesis" or similar term, shall be taken to mean endosperm development and embryogenesis respectively, in the absence of fertilization or by the process of pseudogamy.

Similarly, the term "autonomous seed development" shall be taken to refer to the development of seed independent of fertilization or by the process of pseudogamy, wherein said seed comprise one or more organs of a seed, including any one or more of female gametophyte, endosperm, embryo and a seed coat, irrespective of whether or not said seed structure is fertile or infertile. Accordingly, autonomous seed development clearly includes the process of "apomixis" wherein viable seed are produced either in the absence of fertilisation or by the process of pseudogamy. Where the production of fertile seed is required, it is essential that autonomous seed development leads to the formation of at least an endosperm and an embryo, notwithstanding that the endosperm can subsequently degenerate. In certain commercial applications involving the production of soft-seeded or parthenocarpic fruit varieties, autonomous endosperm formation can comprise the formation of non-viable seed wherein the embryo crushes down, leaving only soft seed comprising an endosperm. Alternatively, the endosperm can commence development autonomously and later degenerate, leaving seedless fruit.

TABLE 1

| SEQ ID # | IDENTITY | PN/PP (polynucleotide/ polypeptide) | Genus species |
|---|---|---|---|
| 1 | AGO4 AT2G27040.1-CDS | PN | *Arabidopsis thaliana* |
| 2 | AGO4 AT2G27040.2-CDS | PN | *Arabidopsis thaliana* |

TABLE 1-continued

| SEQ ID # | IDENTITY | PN/PP (polynucleotide/ polypeptide) | Genus species |
|---|---|---|---|
| 3 | SUVH2H9AT2G33290.1-CDS | PN | *Arabidopsis thaliana* |
| 4 | SUVH2H9AT4G13 460.1-CDS | PN | *Arabidopsis thaliana* |
| 5 | RDR6 AT3G49500.1-CDS | PN | *Arabidopsis thaliana* |
| 6 | RDR2 AT4G11130.1-CDS | PN | *Arabidopsis thaliana* |
| 7 | NRPD2 AT3G23780.1-CDS | PN | *Arabidopsis thaliana* |
| 8 | NRPD2 AT3G23780.2-CDS | PN | *Arabidopsis thaliana* |
| 9 | NRPD2 AT3G18090.1-CDS | PN | *Arabidopsis thaliana* |
| 10 | NRPD1 a AT 1G63020.1-CDS | PN | *Arabidopsis thaliana* |
| 11 | NRPD1a AT1G63020.2-CDS | PN | *Arabidopsis thaliana* |
| 12 | NRPD1b AT2G40030.1-CDS | PN | *Arabidopsis thaliana* |
| 13 | MET1 AT5G49160.1-CDS | PN | *Arabidopsis thaliana* |
| 14 | IDN2 At3g48670.1-CDS | PN | *Arabidopsis thaliana* |
| 15 | IDN2 AT2G16490.1-CDS | PN | *Arabidopsis thaliana* |
| 16 | IDN2 AT4G01180.1-CDS | PN | *Arabidopsis thaliana* |
| 17 | IDN2 AT1G13790.1-CDS | PN | *Arabidopsis thaliana* |
| 18 | IDN2 AT3G48670.2-CDS | PN | *Arabidopsis thaliana* |
| 19 | IDN2 AT3G12550.1-CDS | PN | *Arabidopsis thaliana* |
| 20 | IDN2 AT3G12550.2-CDS | PN | *Arabidopsis thaliana* |
| 21 | IDN2 AT5G59390.1-CDS | PN | *Arabidopsis thaliana* |
| 22 | DRM2 AT5G14620.1-CDS | PN | *Arabidopsis thaliana* |
| 23 | DCL3 AT3G43920.2-CDS | PN | *Arabidopsis thaliana* |
| 24 | DCL3 AT3G43920.3-CDS | PN | *Arabidopsis thaliana* |
| 25 | DCL3 AT3G43920.1-CDS | PN | *Arabidopsis thaliana* |
| 26 | CMT3 AT1G69770.1-CDS | PN | *Arabidopsis thaliana* |
| 27 | AGO6-8-9 AT5G21150.1-CDS | PN | *Arabidopsis thaliana* |
| 28 | AGO6-8-9 AT2G32940.1-CDS | PN | *Arabidopsis thaliana* |
| 29 | AGO6-8-9 AT5G21030.1-CDS | PN | *Arabidopsis thaliana* |
| 30 | AGO5 AT2G27880.1-CDS | PN | *Arabidopsis thaliana* |
| 31 | DCL4 AT5G20320.1 CDS-CDS | PN | *Arabidopsis thaliana* |
| 32 | DCL4 AT5G20320.2|AT5G20320-CDS | PN | *Arabidopsis thaliana* |
| 33 | RDR1 AT1G14790.1 CDS-CDS | PN | *Arabidopsis thaliana* |
| 34 | AGO4 AT2G27040.1-Promoter_Genomic | PN | *Arabidopsis thaliana* |
| 35 | AGO4 AT2G27040.2-Promoter_Genomic | PN | *Arabidopsis thaliana* |
| 36 | AGO6-8-9 AT5G21150.1-Promoter_Genomic | PN | *Arabidopsis thaliana* |
| 37 | AGO6-8-9 AT2G32940.1-Promoter_Genomic | PN | *Arabidopsis thaliana* |
| 38 | AGO6-8-9 AT5G21030.1-Promoter_Genomic | PN | *Arabidopsis thaliana* |
| 39 | CMT3 AT1G69770.1-Promoter_Genomic | PN | *Arabidopsis thaliana* |
| 40 | DCL3 AT3G43920.2-Promoter_Genomic | PN | *Arabidopsis thaliana* |

TABLE 1-continued

| SEQ ID # | IDENTITY | PN/PP (polynucleotide/ polypeptide) | Genus species |
|---|---|---|---|
| 41 | DCL3 AT3G43920.3-Promoter_Genomic | PN | Arabidopsis thaliana |
| 42 | DCL3 AT3G43920.1-Promoter_Genomic | PN | Arabidopsis thaliana |
| 43 | DRM2 AT5G14620.1-Promoter_Genomic | PN | Arabidopsis thaliana |
| 44 | IDN2 AT3G48670.1-Promoter_Genomic | PN | Arabidopsis thaliana |
| 45 | IDN2 AT2G16490.1-Promoter_Genomic | PN | Arabidopsis thaliana |
| 46 | IDN2 AT4G01180.1-Promoter_Genomic | PN | Arabidopsis thaliana |
| 47 | IDN2 AT1G13790.1-Promoter_Genomic | PN | Arabidopsis thaliana |
| 48 | IDN2 AT3G48670.2-Promoter_Genomic | PN | Arabidopsis thaliana |
| 49 | IDN2 AT3G12550.1-Promoter_Genomic | PN | Arabidopsis thaliana |
| 50 | IDN2 AT3G12550.2-Promoter_Genomic | PN | Arabidopsis thaliana |
| 51 | IDN2 AT5G59390.1-Promoter_Genomic | PN | Arabidopsis thaliana |
| 52 | MET1 AT5G49160.1-Promoter_Genomic | PN | Arabidopsis thaliana |
| 53 | NRPD1a AT1G63020.1-Promoter_Genomic | PN | Arabidopsis thaliana |
| 54 | NRPD1a AT1G63020.2-Promoter_Genomic | PN | Arabidopsis thaliana |
| 55 | NRPD1b AT2G40030.1-Promoter_Genomic | PN | Arabidopsis thaliana |
| 56 | NRPD2 AT3G23780.1-Promoter_Genomic | PN | Arabidopsis thaliana |
| 57 | NRPD2 AT3G23780.2-Promoter_Genomic | PN | Arabidopsis thaliana |
| 58 | NRPD2 AT3G18090.1-Promoter_Genomic | PN | Arabidopsis thaliana |
| 59 | RDR6 AT3G49500.1-Promoter_Genomic | PN | Arabidopsis thaliana |
| 60 | SUVH2_H9 AT4G13460.1-Promoter_Genomic | PN | Arabidopsis thaliana |
| 61 | SUVH2_H9 AT4G13460.2-Promoter_Genomic | PN | Arabidopsis thaliana |
| 62 | AGO5 AT2G27880.1-Promoter_Genomic | PN | Arabidopsis thaliana |
| 63 | RDR1 AT1G14790-Promoter_Genomic | PN | Arabidopsis thaliana |
| 64 | DCL4 AT5G20320.2-Promoter_Genomic | PN | Arabidopsis thaliana |
| 65 | AGO4 AT2G27040.1-amino acid | PP | Arabidopsis thaliana |
| 66 | AGO4 AT2G27040.2-amino acid | PP | Arabidopsis thaliana |
| 67 | AGO689 AT5G21150.1-amino acid | PP | Arabidopsis thaliana |
| 68 | AGO689 AT2G32940.1-amino acid | PP | Arabidopsis thaliana |
| 69 | AGO689 AT5G21030.1-amino acid | PP | Arabidopsis thaliana |
| 70 | CMT3 AT1G69770.1-amino acid | PP | Arabidopsis thaliana |
| 71 | DCL3 AT3G43920.2-amino acid | PP | Arabidopsis thaliana |
| 72 | DCL3 AT3G43920.3-amino acid | PP | Arabidopsis thaliana |
| 73 | DCL3 AT3G43920.1-amino acid | PP | Arabidopsis thaliana |
| 74 | DRM2 AT5G14620.1-amino acid | PP | Arabidopsis thaliana |
| 75 | IDN2 AT3G48670.1-amino acid | PP | Arabidopsis thaliana |
| 76 | IDN2 AT2G16490.1-amino acid | PP | Arabidopsis thaliana |
| 77 | IDN2 AT4G01180.1-amino acid | PP | Arabidopsis thaliana |
| 78 | IDN2 AT1G13790.1-amino acid | PP | Arabidopsis thaliana |

TABLE 1-continued

| SEQ ID # | IDENTITY | PN/PP (polynucleotide/ polypeptide) | Genus species |
|---|---|---|---|
| 79 | IDN2 AT3G48670.2-amino acid | PP | *Arabidopsis thaliana* |
| 80 | IDN2 AT3G12550.1-amino acid | PP | *Arabidopsis thaliana* |
| 81 | IDN2 AT3G12550.2-amino acid | PP | *Arabidopsis thaliana* |
| 82 | IDN2 AT5G59390.1-amino acid | PP | *Arabidopsis thaliana* |
| 83 | MET1 AT5G49160.1-amino acid | PP | *Arabidopsis thaliana* |
| 84 | NRPD1a AT1G63020.1-amino acid | PP | *Arabidopsis thaliana* |
| 85 | NRPD1a AT1G63020.2-amino acid | PP | *Arabidopsis thaliana* |
| 86 | NRPD1b AT2G40030.1-amino acid | PP | *Arabidopsis thaliana* |
| 87 | NRPD2 AT3G23780.1-amino acid | PP | *Arabidopsis thaliana* |
| 88 | NRPD2 AT3G23780.2-amino acid | PP | *Arabidopsis thaliana* |
| 89 | NRPD2 AT3G18090.1-amino acid | PP | *Arabidopsis thaliana* |
| 90 | RDR2 AT4G11130.1-amino acid | PP | *Arabidopsis thaliana* |
| 91 | RDR6 AT3G49500.1-amino acid | PP | *Arabidopsis thaliana* |
| 92 | SGS3 AT5G23570.1-amino acid | PP | *Arabidopsis thaliana* |
| 93 | SUVH2H9 AT2G33290.1-amino acid | PP | *Arabidopsis thaliana* |
| 94 | SUVH2H9 AT4G13460.1-amino acid | PP | *Arabidopsis thaliana* |
| 95 | SUVH2H9 AT4G13460.2-amino acid | PP | *Arabidopsis thaliana* |
| 96 | RDR1 AT1G14790.1-amino acid | PP | *Arabidopsis thaliana* |
| 97 | DCL4 AT5G20320.1-amino acid | PP | *Arabidopsis thaliana* |
| 98 | DCL4 AT5G20320.2-amino acid | PP | *Arabidopsis thaliana* |
| 99 | AGO5 AT2G27880.1-amino acid | PP | *Arabidopsis thaliana* |
| 100 | AGO4 Glyma14g04510.1-CDS | PN | *Glycine max* |
| 101 | AGO4 Glyma02g44260.1-CDS | PN | *Glycine max* |
| 102 | AGO4 Glyma20g12070.3-CDS | PN | *Glycine max* |
| 103 | AGO4 Glyma20g12070.2-CDS | PN | *Glycine max* |
| 104 | SUVH2H9 Glyma20g00810.2-CDS | PN | *Glycine max* |
| 105 | SUVH2H9 Glyma07g19420.1-CDS | PN | *Glycine max* |
| 106 | SUVH2H9 Glyma16g18500.2-CDS | PN | *Glycine max* |
| 107 | SGS3 Glyma06g16960.2-CDS | PN | *Glycine max* |
| 108 | SGS3 Glyma06g16960.3-CDS | PN | *Glycine max* |
| 109 | SGS3 Glyma04g38100.2-CDS | PN | *Glycine max* |
| 110 | SGS3 Glyma04g38100.3-CDS | PN | *Glycine max* |
| 111 | SGS3 Glyma08g19690.2-CDS | PN | *Glycine max* |
| 112 | SGS3 Glyma08g19690.3-CDS | PN | *Glycine max* |
| 113 | SGS3 Glyma08g19690.4-CDS | PN | *Glycine max* |
| 114 | SGS3 Glyma08g19690.5-CDS | PN | *Glycine max* |
| 115 | SGS3 Glyma05g33260.1-CDS | PN | *Glycine max* |
| 116 | SGS3 Glyma15g05380.2-CDS | PN | *Glycine max* |
| 117 | RDR6 Glyma06g07251.1-CDS | PN | *Glycine max* |
| 118 | RDR6 Glyma06g07251.2-CDS | PN | *Glycine max* |
| 119 | RDR6 Glyma04g07151.1-CDS | PN | *Glycine max* |
| 120 | RDR6 Glyma04g07151.2-CDS | PN | *Glycine max* |
| 121 | RDR2 Glyma17g09920.1-CDS | PN | *Glycine max* |
| 122 | RDR2 Glyma05g02000.1-CDS | PN | *Glycine max* |
| 123 | RDR2 Glyma05g02000.2-CDS | PN | *Glycine max* |
| 124 | NRPD2 Glyma06g06480.1-CDS | PN | *Glycine max* |
| 125 | NRPD2 Glyma04g06440.2-CDS | PN | *Glycine max* |
| 126 | NRPD1a Glyma11g02921.1-CDS | PN | *Glycine max* |
| 127 | NRPD1a Glyma11g02921.2_CDS | PN | *Glycine max* |
| 128 | NRPD1a Glyma01g42480.1-CDS | PN | *Glycine max* |
| 129 | NRPD1a Glyma01g42480.2-CDS | PN | *Glycine max* |
| 130 | NRPD1b Glyma13g26691.1-CDS | PN | *Glycine max* |
| 131 | NRPD1b Glyma13g26691.2-CDS | PN | *Glycine max* |
| 132 | NRPD1b Glyma15g37710.1-CDS | PN | *Glycine max* |
| 133 | NRPD1b Glyma15g37710.2-CDS | PN | *Glycine max* |

TABLE 1-continued

| SEQ ID # | IDENTITY | PN/PP (polynucleotide/polypeptide) | Genus species |
|---|---|---|---|
| 134 | NRPD1b Glyma15g37710.3-CDS | PN | *Glycine max* |
| 135 | NRPD1b Glyma15g37710.4-CDS | PN | *Glycine max* |
| 136 | NRPD1b Glyma15g37710.5-CDS | PN | *Glycine max* |
| 137 | NRPD1b Glyma15g37710.6-CDS | PN | *Glycine max* |
| 138 | MET1 Glyma06g18790.1-CDS | PN | *Glycine max* |
| 139 | MET1 Glyma04g36150.1-CDS | PN | *Glycine max* |
| 140 | IDN2 Glyma13g41150.1-CDS | PN | *Glycine max* |
| 141 | IDN2 Glyma15g04250.1-CDS | PN | *Glycine max* |
| 142 | DRM2 Glyma02g04060.2-CDS | PN | *Glycine max* |
| 143 | DRM2 Glyma02g04060.3-CDS | PN | *Glycine max* |
| 144 | DRM2 Glyma05g08740.3-CDS | PN | *Glycine max* |
| 145 | DRM2 Glyma05g08740.4-CDS | PN | *Glycine max* |
| 146 | DRM2 Glyma19g00250.2-CDS | PN | *Glycine max* |
| 147 | DCL3 Glyma06g06061.1-CDS | PN | *Glycine max* |
| 148 | DCL3 Glyma04g06060.2-CDS | PN | *Glycine max* |
| 149 | CMT3 Glyma11g08861.1-CDS | PN | *Glycine max* |
| 150 | CMT3 Glyma01g36500.1-CDS | PN | *Glycine max* |
| 151 | CMT3 Glyma01g01120.2-CDS | PN | *Glycine max* |
| 152 | AGO6-8-9 Glyma06g47230.1-CDS | PN | *Glycine max* |
| 153 | AGO6-8-9 Glyma06g47230.2-CDS | PN | *Glycine max* |
| 154 | AGO6-8-9 Glyma06g47230.3-CDS | PN | *Glycine max* |
| 155 | AGO6-8-9 Glyma13g26240.2-CDS | PN | *Glycine max* |
| 156 | AGO6-8-9 Glyma13g26240.3-CDS | PN | *Glycine max* |
| 157 | AGO6-8-9 Glyma13g26240.4-CDS | PN | *Glycine max* |
| 158 | AGO6-8-9 Glyma13g26240.5-CDS | PN | *Glycine max* |
| 159 | AGO5 Glyma12g08860.1-CDS | PN | *Glycine max* |
| 160 | AGO5 Glyma11g19650.2-CDS | PN | *Glycine max* |
| 161 | DCL4 Glyma17g11235.1-CDS | PN | *Glycine max* |
| 162 | DCL4 Glyma13g22450.2-CDS | PN | *Glycine max* |
| 163 | DCL4 Glyma13g22450.3-CDS | PN | *Glycine max* |
| 164 | DCL4 Glyma13g22450.4-CDS | PN | *Glycine max* |
| 165 | DCL4 Glyma13g22450.5-CDS | PN | *Glycine max* |
| 166 | RDR1 Glyma02g09470.2-CDS | PN | *Glycine max* |
| 167 | RDR1 Glyma02g09470.3-CDS | PN | *Glycine max* |
| 168 | RDR1 Glyma02g09470.4-CDS | PN | *Glycine max* |
| 169 | AGO4 Glyma14g04510.1-Promoter_Genomic | PN | *Glycine max* |
| 170 | AGO4 Glyma02g44260.1-Promoter_Genomic | PN | *Glycine max* |
| 171 | AGO4 Glyma20g12070.3-Promoter_Genomic | PN | *Glycine max* |
| 172 | AGO4 Glyma20g12070.2-Promoter_Genomic | PN | *Glycine max* |
| 173 | AGO6-8-9 Glyma06g47230.1-Promoter_Genomic | PN | *Glycine max* |
| 174 | AGO6-8-9 Glyma06g47230.2-Promoter_Genomic | PN | *Glycine max* |
| 175 | AGO6-8-9 Glyma06g47230.3-Promoter_Genomic | PN | *Glycine max* |
| 176 | AGO6-8-9 Glyma13g26240.2-Promoter_Genomic | PN | *Glycine max* |
| 177 | AGO6-8-9 Glyma13g26240.3-Promoter_Genomic | PN | *Glycine max* |
| 178 | AGO6-8-9 Glyma13g26240.4-Promoter_Genomic | PN | *Glycine max* |
| 179 | AGO6-8-9 Glyma13g26240.5-Promoter_Genomic | PN | *Glycine max* |
| 180 | CMT3 Glyma11g08861.1-Promoter_Genomic | PN | *Glycine max* |
| 181 | CMT3 Glyma01g36500.1-Promoter_Genomic | PN | *Glycine max* |
| 182 | CMT3 Glyma01g01120.2-Promoter_Genomic | PN | *Glycine max* |
| 183 | DCL3 Glyma06g06061.1-Promoter_Genomic | PN | *Glycine max* |
| 184 | DCL3 Glyma04g06060.2-Promoter_Genomic | PN | *Glycine max* |
| 185 | DRM2 Glyma02g04060.2-Promoter_Genomic | PN | *Glycine max* |
| 186 | DRM2 Glyma02g04060.3-Promoter_Genomic | PN | *Glycine max* |
| 187 | DRM2 Glyma05g08740.3-Promoter_Genomic | PN | *Glycine max* |
| 188 | DRM2 Glyma05g08740.4-Promoter_Genomic | PN | *Glycine max* |

TABLE 1-continued

| SEQ ID # | IDENTITY | PN/PP (polynucleotide/ polypeptide) | Genus species |
|---|---|---|---|
| 189 | DRM2 Glyma19g00250.2-Promoter_Genomic | PN | *Glycine max* |
| 190 | IDN2 Glyma13g41150.1-Promoter_Genomic | PN | *Glycine max* |
| 191 | IDN2 Glyma15g04250.1-Promoter_Genomic | PN | *Glycine max* |
| 192 | MET1 Glyma06g18790.1-Promoter_Genomic | PN | *Glycine max* |
| 193 | MET1 Glyma04g36150.1-Promoter_Genomic | PN | *Glycine max* |
| 194 | NRPD1a Glyma11g02921.1-Promoter_Genomic | PN | *Glycine max* |
| 195 | NRPD1a Glyma11g02921.2-Promoter_Genomic | PN | *Glycine max* |
| 196 | NRPD1a Glyma01g42480.1-Promoter_Genomic | PN | *Glycine max* |
| 197 | NRPD1a Glyma01g42480.2-Promoter_Genomic | PN | *Glycine max* |
| 198 | NRPD1b Glyma13g26691.2-Promoter_Genomic | PN | *Glycine max* |
| 199 | NRPD2 Glyma06g06480.1-Promoter_Genomic | PN | *Glycine max* |
| 200 | NRPD2 Glyma04g06440.2-Promoter_Genomic | PN | *Glycine max* |
| 201 | RDR2 Glyma17g09920.1-Promoter_Genomic | PN | *Glycine max* |
| 202 | RDR2 Glyma05g02000.1-Promoter_Genomic | PN | *Glycine max* |
| 203 | RDR2 Glyma05g02000.2-Promoter_Genomic | PN | *Glycine max* |
| 204 | RDR6 Glyma06g07251.1-Promoter_Genomic | PN | *Glycine max* |
| 205 | RDR6 Glyma06g07251.2-Promoter_Genomic | PN | *Glycine max* |
| 206 | RDR6 Glyma04g07151.1-Promoter_Genomic | PN | *Glycine max* |
| 207 | RDR6 Glyma04g07151.2-Promoter_Genomic | PN | *Glycine max* |
| 208 | SGS3 Glyma06g16960.2-Promoter_Genomic | PN | *Glycine max* |
| 209 | SGS3 Glyma06g16960.3-Promoter_Genomic | PN | *Glycine max* |
| 210 | SGS3 Glyma04g38100.2-Promoter_Genomic | PN | *Glycine max* |
| 211 | SGS3 Glyma04g38100.3-Promoter_Genomic | PN | *Glycine max* |
| 212 | SGS3 Glyma08g19690.2-Promoter_Genomic | PN | *Glycine max* |
| 213 | SGS3 Glyma08g19690.3-Promoter_Genomic | PN | *Glycine max* |
| 214 | SGS3 Glyma08g19690.4-Promoter_Genomic | PN | *Glycine max* |
| 215 | SGS3 Glyma08g19690.5-Promoter_Genomic | PN | *Glycine max* |
| 216 | SGS3 Glyma05g33260.1-Promoter_Genomic | PN | *Glycine max* |
| 217 | SGS3 Glyma15g05380.1-Promoter_Genomic | PN | *Glycine max* |
| 218 | SUVH2_H9 Glyma20g00810.2-Promoter_Genomic | PN | *Glycine max* |
| 219 | SUVH2_H9 Glyma07g19420.1-Promoter_Genomic | PN | *Glycine max* |
| 220 | SUVH2_H9 Glyma16g18500.2-Promoter_Genomic | PN | *Glycine max* |
| 221 | AGO5 Glyma12g08860.1-Promoter_Genomic | PN | *Glycine max* |
| 222 | AGO5 Glyma11g19650.2-Promoter_Genomic | PN | *Glycine max* |
| 223 | RDR1 Glyma02g09470.2-Promoter_Genomic | PN | *Glycine max* |
| 224 | RDR1 Glyma02g09470.3-Promoter_Genomic | PN | *Glycine max* |
| 225 | RDR1 Glyma02g09470.4-Promoter_Genomic | PN | *Glycine max* |
| 226 | DCL4 Glyma17g11235.1-Promoter_Genomic | PN | *Glycine max* |
| 227 | DCL4 Glyma13g22450.2-Promoter_Genomic | PN | *Glycine max* |
| 228 | DCL4 Glyma13g22450.3-Promoter_Genomic | PN | *Glycine max* |
| 229 | DCL4 Glyma13g22450.4-Promoter_Genomic | PN | *Glycine max* |
| 230 | DCL4 Glyma13g22450.5-Promoter_Genomic | PN | *Glycine max* |
| 231 | AGO4 Glyma14g04510.1-amino acid | PP | *Glycine max* |
| 232 | AGO4 Glyma02g44260.1-amino acid | PP | *Glycine max* |
| 233 | AGO4 Glyma20g12070.3-amino acid | PP | *Glycine max* |
| 234 | AGO4 Glyma20g12070.2-amino acid | PP | *Glycine max* |

TABLE 1-continued

| SEQ ID # | IDENTITY | PN/PP (polynucleotide/polypeptide) | Genus species |
|---|---|---|---|
| 235 | AGO689 Glyma06g47230.1-amino acid | PP | Glycine max |
| 236 | AGO689 Glyma06g47230.2-amino acid | PP | Glycine max |
| 237 | AGO689 Glyma06g47230.3-amino acid | PP | Glycine max |
| 238 | AGO689 Glyma13g26240.2-amino acid | PP | Glycine max |
| 239 | AGO689 Glyma13g26240.3-amino acid | PP | Glycine max |
| 240 | AGO689 Glyma13g26240.4-amino acid | PP | Glycine max |
| 241 | AGO689 Glyma13g26240.5-amino acid | PP | Glycine max |
| 242 | CMT3 Glyma11g08861.1-amino acid | PP | Glycine max |
| 243 | CMT3 Glyma01g36500.1-amino acid | PP | Glycine max |
| 244 | CMT3 Glyma01g01120.2-amino acid | PP | Glycine max |
| 245 | DCL3 Glyma06g06061.1-amino acid | PP | Glycine max |
| 246 | DCL3 Glyma04g06060.2-amino acid | PP | Glycine max |
| 247 | DRM2 Glyma02g04060.2-amino acid | PP | Glycine max |
| 248 | DRM2 Glyma02g04060.3-amino acid | PP | Glycine max |
| 249 | DRM2 Glyma05g08740.3-amino acid | PP | Glycine max |
| 250 | DRM2 Glyma05g08740.4-amino acid | PP | Glycine max |
| 251 | DRM2 Glyma19g00250.2-amino acid | PP | Glycine max |
| 252 | IDN2 Glyma13g41150.1-amino acid | PP | Glycine max |
| 253 | IDN2 Glyma15g04250.1-amino acid | PP | Glycine max |
| 254 | MET1 Glyma06g18790.1-amino acid | PP | Glycine max |
| 255 | MET1 Glyma04g36150.1-amino acid | PP | Glycine max |
| 256 | NRPD1a Glyma11g02921.1-amino acid | PP | Glycine max |
| 257 | NRPD1a Glyma11g02921.2-amino acid | PP | Glycine max |
| 258 | NRPD1a Glyma01g42480.1-amino acid | PP | Glycine max |
| 259 | NRPD1a Glyma01g42480.2-amino acid | PP | Glycine max |
| 260 | NRPD1b Glyma13g26691.1-amino acid | PP | Glycine max |
| 261 | NRPD1b Glyma13g26691.2-amino acid | PP | Glycine max |
| 262 | NRPD1b Glyma15g37710.1-amino acid | PP | Glycine max |
| 263 | NRPD1b Glyma15g37710.2-amino acid | PP | Glycine max |
| 264 | NRPD1b Glyma15g37710.3-amino acid | PP | Glycine max |
| 265 | NRPD1b Glyma15g37710.4-amino acid | PP | Glycine max |
| 266 | NRPD1b Glyma15g37710.5-amino acid | PP | Glycine max |
| 267 | NRPD1b Glyma15g37710.6-amino acid | PP | Glycine max |
| 268 | NRPD2 Glyma06g06480.1-amino acid | PP | Glycine max |
| 269 | NRPD2 Glyma04g06440.2-amino acid | PP | Glycine max |
| 270 | RDR2 Glyma17g09920.1-amino acid | PP | Glycine max |
| 271 | RDR2 Glyma05g02000.1-amino acid | PP | Glycine max |
| 272 | RDR2 Glyma05g02000.2-amino acid | PP | Glycine max |
| 273 | RDR6 Glyma06g07251.1-amino acid | PP | Glycine max |
| 274 | RDR6 Glyma06g07251.2-amino acid | PP | Glycine max |
| 275 | RDR6 Glyma04g07151.1-amino acid | PP | Glycine max |
| 276 | RDR6 Glyma04g07151.2-amino acid | PP | Glycine max |
| 277 | SGS3 Glyma06g16960.2-amino acid | PP | Glycine max |
| 278 | SGS3 Glyma06g16960.3-amino acid | PP | Glycine max |
| 279 | SGS3 Glyma04g38100.2-amino acid | PP | Glycine max |
| 280 | SGS3 Glyma04g38100.3-amino acid | PP | Glycine max |
| 281 | SGS3 Glyma08g19690.2-amino acid | PP | Glycine max |
| 282 | SGS3 Glyma08g19690.3-amino acid | PP | Glycine max |
| 283 | SGS3 Glyma08g19690.4-amino acid | PP | Glycine max |
| 284 | SGS3 Glyma08g19690.5-amino acid | PP | Glycine max |
| 285 | SGS3 Glyma05g33260.1-amino acid | PP | Glycine max |
| 286 | SGS3 Glyma15g05380.2-amino acid | PP | Glycine max |
| 287 | SUVH2H9 Glyma20g00810.2-amino acid | PP | Glycine max |
| 288 | SUVH2H9 Glyma07g19420.1-amino acid | PP | Glycine max |
| 289 | SUVH2H9 Glyma16g18500.2-amino acid | PP | Glycine max |
| 290 | RDR1 Glyma02g09470.2-amino acid | PP | Glycine max |
| 291 | RDR1 Glyma02g09470.3-amino acid | PP | Glycine max |
| 292 | RDR1 Glyma02g09470.4-amino acid | PP | Glycine max |
| 293 | DCL4 Glyma17g11235.1-amino acid | PP | Glycine max |
| 294 | DCL4 Glyma13g22450.2-amino acid | PP | Glycine max |
| 295 | DCL4 Glyma13g22450.3-amino acid | PP | Glycine max |
| 296 | DCL4 Glyma13g22450.4-amino acid | PP | Glycine max |
| 297 | DCL4 Glyma13g22450.5-amino acid | PP | Glycine max |
| 298 | AGO5 Glyma12g08860.1-amino acid | PP | Glycine max |
| 299 | AGO5 Glyma11g19650.2-amino acid | PP | Glycine max |
| 300 | AGO4 Bra034318-CDS | PN | Brassica rapa |
| 301 | SUVH2H9 Bra005511-CDS | PN | Brassica rapa |
| 302 | SUVH2H9 Bra007048-CDS | PN | Brassica rapa |
| 303 | SUVH2H9 Bra021840-CDS | PN | Brassica rapa |
| 304 | SGS3 Bra009695-CDS | PN | Brassica rapa |
| 305 | RDR6 Bra029957-CDS | PN | Brassica rapa |
| 306 | RDR2 Bra035249-CDS | PN | Brassica rapa |
| 307 | NRPD2 Bra022279-CDS | PN | Brassica rapa |
| 308 | NRPD1a Bra041010-CDS | PN | Brassica rapa |
| 309 | NRPD1a Bra027611-CDS | PN | Brassica rapa |
| 310 | NRPD1b Bra000162-CDS | PN | Brassica rapa |

TABLE 1-continued

| SEQ ID # | IDENTITY | PN/PP (polynucleotide/polypeptide) | Genus species |
|---|---|---|---|
| 311 | MET1 Bra010026-CDS | PN | *Brassica rapa* |
| 312 | MET1 Bra039939-CDS | PN | *Brassica rapa* |
| 313 | MET1 Bra030191-CDS | PN | *Brassica rapa* |
| 314 | IDN2 Bra034752-CDS | PN | *Brassica rapa* |
| 315 | IDN2 Bra002570-CDS | PN | *Brassica rapa* |
| 316 | IDN2 Bra019557-CDS | PN | *Brassica rapa* |
| 317 | IDN2 Bra018043-CDS | PN | *Brassica rapa* |
| 318 | IDN2 Bra026932-CDS | PN | *Brassica rapa* |
| 319 | DRM2 Bra023480-CDS | PN | *Brassica rapa* |
| 320 | DRM2 Bra023479-CDS | PN | *Brassica rapa* |
| 321 | DRM2 Bra008749-CDS | PN | *Brassica rapa* |
| 322 | DCL3 Bra019456-CDS | PN | *Brassica rapa* |
| 323 | CMT3 Bra024340-CDS | PN | *Brassica rapa* |
| 324 | AGO6-8-9 Bra020152-CDS | PN | *Brassica rapa* |
| 325 | AGO6-8-9 Bra002360-CDS | PN | *Brassica rapa* |
| 326 | AGO6-8-9 Bra002349-CDS | PN | *Brassica rapa* |
| 327 | AGO6-8-9 Bra002361-CDS | PN | *Brassica rapa* |
| 328 | AGO6-8-9 Bra022918-CDS | PN | *Brassica rapa* |
| 329 | AGO6-8-9 Bra005981-CDS | PN | *Brassica rapa* |
| 330 | AGO5 Bra011993-CDS | PN | *Brassica rapa* |
| 331 | DCL4 Bra002293-CDS | PN | *Brassica rapa* |
| 332 | RDR1 Bra026187-CDS | PN | *Brassica rapa* |
| 333 | AGO4 Bra034318-Promoter_Genomic | PN | *Brassica rapa* |
| 334 | AGO6-8-9 Bra020152-Promoter_Genomic | PN | *Brassica rapa* |
| 335 | AGO6-8-9 Bra002360-Promoter_Genomic | PN | *Brassica rapa* |
| 336 | AGO6-8-9 Bra002349-Promoter_Genomic | PN | *Brassica rapa* |
| 337 | AGO6-8-9 Bra002361-Promoter_Genomic | PN | *Brassica rapa* |
| 338 | AGO6-8-9 Bra022918-Promoter_Genomic | PN | *Brassica rapa* |
| 339 | AGO6-8-9 Bra005981-Promoter_Genomic | PN | *Brassica rapa* |
| 340 | CMT3 Bra024340-Promoter_Genomic | PN | *Brassica rapa* |
| 341 | DCL3 Bra019456-Promoter_Genomic | PN | *Brassica rapa* |
| 342 | DRM2 Bra023480-Promoter_Genomic | PN | *Brassica rapa* |
| 343 | DRM2 Bra023479-Promoter_Genomic | PN | *Brassica rapa* |
| 344 | DRM2 Bra008749-Promoter_Genomic | PN | *Brassica rapa* |
| 345 | IDN2 Bra034752-Promoter_Genomic | PN | *Brassica rapa* |
| 346 | IDN2 Bra002570-Promoter_Genomic | PN | *Brassica rapa* |
| 347 | IDN2 Bra019557-Promoter_Genomic | PN | *Brassica rapa* |
| 348 | IDN2 Bra018043-Promoter_Genomic | PN | *Brassica rapa* |
| 349 | IDN2 Bra026932-Promoter_Genomic | PN | *Brassica rapa* |
| 350 | MET1 Bra010026-Promoter_Genomic | PN | *Brassica rapa* |
| 351 | MET1 Bra039939-Promoter_Genomic | PN | *Brassica rapa* |
| 352 | MET1 Bra030191-Promoter_Genomic | PN | *Brassica rapa* |
| 353 | NRPD1a Bra041010-Promoter_Genomic | PN | *Brassica rapa* |
| 354 | NRPD1a Bra027611-Promoter_Genomic | PN | *Brassica rapa* |
| 355 | NRPD1b Bra000162-Promoter_Genomic | PN | *Brassica rapa* |
| 356 | NRPD2 Bra022279-Promoter_Genomic | PN | *Brassica rapa* |
| 357 | RDR2 Bra035249-Promoter_Genomic | PN | *Brassica rapa* |
| 358 | RDR6 Bra029957-Promoter_Genomic | PN | *Brassica rapa* |
| 359 | SGS3 Bra009695-Promoter_Genomic | PN | *Brassica rapa* |
| 360 | SUVH2_H9 Bra005511-Promoter_Genomic | PN | *Brassica rapa* |
| 361 | SUVH2_H9 Bra007048-Promoter_Genomic | PN | *Brassica rapa* |
| 362 | SUVH2_H9 Bra021840-Promoter_Genomic | PN | *Brassica rapa* |
| 363 | AGO5 Bra011993-Promoter_Genomic | PN | *Brassica rapa* |
| 364 | RDR1 Bra026187-Promoter_Genomic | PN | *Brassica rapa* |
| 365 | DCL4 Bra002293-Promoter_Genomic | PN | *Brassica rapa* |
| 366 | AGO4 Bra034318-amino acid | PP | *Brassica rapa* |
| 367 | AGO689 Bra020152-amino acid | PP | *Brassica rapa* |
| 368 | AGO689 Bra002360-amino acid | PP | *Brassica rapa* |
| 369 | AGO689 Bra002349-amino acid | PP | *Brassica rapa* |
| 370 | AGO689 Bra002361-amino acid | PP | *Brassica rapa* |
| 371 | AGO689 Bra022918-amino acid | PP | *Brassica rapa* |
| 372 | AGO689 Bra005981-amino acid | PP | *Brassica rapa* |
| 373 | CMT3 Bra024340-amino acid | PP | *Brassica rapa* |
| 374 | DCL3 Bra019456-amino acid | PP | *Brassica rapa* |
| 375 | DRM2 Bra023480-amino acid | PP | *Brassica rapa* |
| 376 | DRM2 Bra023479-amino acid | PP | *Brassica rapa* |
| 377 | DRM2 Bra008749-amino acid | PP | *Brassica rapa* |
| 378 | IDN2 Bra034752-amino acid | PP | *Brassica rapa* |
| 379 | IDN2 Bra002570-amino acid | PP | *Brassica rapa* |
| 380 | IDN2 Bra019557-amino acid | PP | *Brassica rapa* |
| 381 | IDN2 Bra018043-amino acid | PP | *Brassica rapa* |
| 382 | IDN2 Bra026932-amino acid | PP | *Brassica rapa* |
| 383 | MET1 Bra010026-amino acid | PP | *Brassica rapa* |
| 384 | MET1 Bra039939-amino acid | PP | *Brassica rapa* |
| 385 | MET1 Bra030191-amino acid | PP | *Brassica rapa* |
| 386 | NRPD1a Bra041010-amino acid | PP | *Brassica rapa* |

TABLE 1-continued

| SEQ ID # | IDENTITY | PN/PP (polynucleotide/ polypeptide) | Genus species |
|---|---|---|---|
| 387 | NRPD1a Bra027611-amino acid | PP | Brassica rapa |
| 388 | NRPD1b Bra000162-amino acid | PP | Brassica rapa |
| 389 | NRPD2 Bra022279-amino acid | PP | Brassica rapa |
| 390 | RDR2 Bra035249-amino acid | PP | Brassica rapa |
| 391 | RDR6 Bra029957-amino acid | PP | Brassica rapa |
| 392 | SGS3 Bra009695-amino acid | PP | Brassica rapa |
| 393 | SUVH2H9 Bra005511-amino acid | PP | Brassica rapa |
| 394 | SUVH2H9 Bra007048-amino acid | PP | Brassica rapa |
| 395 | SUVH2H9 Bra021840-amino acid | PP | Brassica rapa |
| 396 | RDR1 Bra026187-amino acid | PP | Brassica rapa |
| 397 | DCL4 Bra002293-amino acid | PP | Brassica rapa |
| 398 | AGO5 Bra011993-amino acid | PP | Brassica rapa |
| 399 | AGO4 Gorai.009G105600.2-CDS | PN | Gossypium raimondii |
| 400 | AGO4 Gorai.009G105600.1-CDS | PN | Gossypium raimondii |
| 401 | AGO4 Gorai.009G105600.7-CDS | PN | Gossypium raimondii |
| 402 | AGO4 Gorai.009G105600.3-CDS | PN | Gossypium raimondii |
| 403 | AGO4 Gorai.009G105600.4-CDS | PN | Gossypium raimondii |
| 404 | AGO4 Gorai.009G105600.5-CDS | PN | Gossypium raimondii |
| 405 | AGO4 Gorai.009G105600.6-CDS | PN | Gossypium raimondii |
| 406 | AGO4 Gorai.004G228100.1-CDS | PN | Gossypium raimondii |
| 407 | SUVH2H9 Gorai.006G254500.1-CDS | PN | Gossypium raimondii |
| 408 | SGS3 Gorai.009G148800.1-CDS | PN | Gossypium raimondii |
| 409 | SGS3 Gorai.009G009900.1-CDS | PN | Gossypium raimondii |
| 410 | SGS3 Gorai.009G009900.2-CDS | PN | Gossypium raimondii |
| 411 | SGS3 Gorai.009G009900.3-CDS | PN | Gossypium raimondii |
| 412 | SGS3 Gorai.002G209000.1-CDS | PN | Gossypium raimondii |
| 413 | SGS3 Gorai.002G209000.2-CDS | PN | Gossypium raimondii |
| 414 | SGS3 Gorai.005G260400.2-CDS | PN | Gossypium raimondii |
| 415 | SGS3 Gorai.005G260400.1-CDS | PN | Gossypium raimondii |
| 416 | SGS3 Gorai.011G121000.1-CDS | PN | Gossypium raimondii |
| 417 | SGS3 Gorai.011G121100.4-CDS | PN | Gossypium raimondii |
| 418 | SGS3 Gorai.011G121100.1-CDS | PN | Gossypium raimondii |
| 419 | SGS3 Gorai.011G121100.3-CDS | PN | Gossypium raimondii |
| 420 | SGS3 Gorai.011G121100.2-CDS | PN | Gossypium raimondii |
| 421 | SGS3 Gorai.011G121100.5-CDS | PN | Gossypium raimondii |
| 422 | RDR6 Gorai.009G057700.1-CDS | PN | Gossypium raimondii |
| 423 | RDR2 Gorai.008G296900-CDS | PN | Gossypium raimondii |
| 424 | NRPD2 Gorai.001G037900.1-CDS | PN | Gossypium raimondii |
| 425 | NRPD2 Gorai.001G037900.2-CDS | PN | Gossypium raimondii |
| 426 | NRPD1a Gorai.004G207300.1-CDS | PN | Gossypium raimondii |
| 427 | NRPD1a Gorai.004G207300.2-CDS | PN | Gossypium raimondii |
| 428 | NRPD1a Gorai.004G207300.3-CDS | PN | Gossypium raimondii |
| 429 | NRPD1a Gorai.007G022200.1-CDS | PN | Gossypium raimondii |
| 430 | NRPD1b Gorai.010G216600.1-CDS | PN | Gossypium raimondii |

TABLE 1-continued

| SEQ ID # | IDENTITY | PN/PP (polynucleotide/ polypeptide) | Genus species |
|---|---|---|---|
| 431 | NRPD1b Gorai.010G216600.3-CDS | PN | *Gossypium raimondii* |
| 432 | NRPD1b Gorai.010G216600.2-CDS | PN | *Gossypium raimondii* |
| 433 | NRPD1b Gorai.010G216600.4-CDS | PN | *Gossypium raimondii* |
| 434 | MET1 Gorai.004G180200.1-CDS | PN | *Gossypium raimondii* |
| 435 | MET1 Gorai.012G048000.1-CDS | PN | *Gossypium raimondii* |
| 436 | MET1 Gorai.012G048000.2-CDS | PN | *Gossypium raimondii* |
| 437 | MET1 Gorai.012G048000.3-CDS | PN | *Gossypium raimondii* |
| 438 | MET1 Gorai.012G048000.4-CDS | PN | *Gossypium raimondii* |
| 439 | IDN2 Gorai.013G263400.1-CDS | PN | *Gossypium raimondii* |
| 440 | IDN2 Gorai.013G263400.5-CDS | PN | *Gossypium raimondii* |
| 441 | DRM2 Gorai.012G062900.2-CDS | PN | *Gossypium raimondii* |
| 442 | DRM2 Gorai.012G062900.3-CDS | PN | *Gossypium raimondii* |
| 443 | DRM2 Gorai.012G062900.4-CDS | PN | *Gossypium raimondii* |
| 444 | DRM2 Gorai.006G031000.1-CDS | PN | *Gossypium raimondii* |
| 445 | DRM2 Gorai.006G031000.2-CDS | PN | *Gossypium raimondii* |
| 446 | DCL3 Gorai.010G093100.2-CDS | PN | *Gossypium raimondii* |
| 447 | DCL3 Gorai.010G093100.3-CDS | PN | *Gossypium raimondii* |
| 448 | DCL3 Gorai.010G093100.4-CDS | PN | *Gossypium raimondii* |
| 449 | DCL3 Gorai.013G221400.1-CDS | PN | *Gossypium raimondii* |
| 450 | CMT3 Gorai.001G052000.1-CDS | PN | *Gossypium raimondii* |
| 451 | AGO6-8-9 Gorai.009G105600.2-CDS | PN | *Gossypium raimondii* |
| 452 | AGO6-8-9 Gorai.009G105600.1-CDS | PN | *Gossypium raimondii* |
| 453 | AGO6-8-9 Gorai.009G105600.7-CDS | PN | *Gossypium raimondii* |
| 454 | AGO6-8-9 Gorai.004G228100.1-CDS | PN | *Gossypium raimondii* |
| 455 | AGO6-8-9 Gorai.001G195700.1-CDS | PN | *Gossypium raimondii* |
| 456 | AGO6-8-9 Gorai.001G195700.3-CDS | PN | *Gossypium raimondii* |
| 457 | AGO6-8-9 Gorai.001G195700.2-CDS | PN | *Gossypium raimondii* |
| 458 | AGO5 Gorai.006G103000.1-CDS | PN | *Gossypium raimondii* |
| 459 | AGO5 Gorai.006G103000.12-CDS | PN | *Gossypium raimondii* |
| 460 | AGO5 Gorai.006G103000.13-CDS | PN | *Gossypium raimondii* |
| 461 | AGO5 Gorai.006G103000.14-CDS | PN | *Gossypium raimondii* |
| 462 | AGO5 Gorai.006G103000.2-CDS | PN | *Gossypium raimondii* |
| 463 | AGO5 Gorai.006G103000.3-CDS | PN | *Gossypium raimondii* |
| 464 | AGO5 Gorai.006G103000.4-CDS | PN | *Gossypium raimondii* |
| 465 | AGO5 Gorai.006G103000.5-CDS | PN | *Gossypium raimondii* |
| 466 | AGO5 Gorai.006G103000.6-CDS | PN | *Gossypium raimondii* |
| 467 | AGO5 Gorai.006G103000.15-CDS | PN | *Gossypium raimondii* |
| 468 | DCL4 Gorai.009G053300.1-CDS | PN | *Gossypium raimondii* |

TABLE 1-continued

| SEQ ID # | IDENTITY | PN/PP (polynucleotide/ polypeptide) | Genus species |
|---|---|---|---|
| 469 | DCL4 Gorai.009G053300.3-CDS | PN | *Gossypium raimondii* |
| 470 | DCL4 Gorai.009G053300.2-CDS | PN | *Gossypium raimondii* |
| 471 | RDR1 Gorai.009G352500.1-CDS | PN | *Gossypium raimondii* |
| 472 | RDR1 Gorai.013G029000.1-CDS | PN | *Gossypium raimondii* |
| 473 | RDR1 Gorai.002G196400.1-CDS | PN | *Gossypium raimondii* |
| 474 | AGO4 Gorai.009G105600.2-Promoter_Genomic | PN | *Gossypium raimondii* |
| 475 | AGO4 Gorai.009G105600.1-Promoter_Genomic | PN | *Gossypium raimondii* |
| 476 | AGO4 Gorai.009G105600.7-Promoter_Genomic | PN | *Gossypium raimondii* |
| 477 | AGO4 Gorai.004G228100.1-Promoter_Genomic | PN | *Gossypium raimondii* |
| 478 | AGO6-8-9 Gorai.009G105600.2-Promoter_Genomic | PN | *Gossypium raimondii* |
| 479 | AGO6-8-9 Gorai.009G105600.1-Promoter_Genomic | PN | *Gossypium raimondii* |
| 480 | AGO6-8-9 Gorai.009G105600.7-Promoter_Genomic | PN | *Gossypium raimondii* |
| 481 | AGO6-8-9 Gorai.004G228100.1-Promoter_Genomic | PN | *Gossypium raimondii* |
| 482 | AGO6-8-9 Gorai001G195700.1-Promoter_Genomic | PN | *Gossypium raimondii* |
| 483 | AGO6-8-9 Gorai.001G195700.3-Promoter_Genomic | PN | *Gossypium raimondii* |
| 484 | AGO6-8-9 Goria.001G195700.2-Promoter_Genomic | PN | *Gossypium raimondii* |
| 485 | CMT3 Gorai.001G052000.1-Promoter_Genomic | PN | *Gossypium raimondii* |
| 486 | DCL3 Gorai.010G093100.2-Promoter_Genomic | PN | *Gossypium raimondii* |
| 487 | DCL3 Gorai.010G093100.3-Promoter_Genomic | PN | *Gossypium raimondii* |
| 488 | DCL3 Gorai.010G093100.4-Promoter_Genomic | PN | *Gossypium raimondii* |
| 489 | DCL3 Gorai.013G221400.1-Promoter_Genomic | PN | *Gossypium raimondii* |
| 490 | DRM2 Gorai.012G062900.1-Promoter_Genomic | PN | *Gossypium raimondii* |
| 491 | DRM2 Gorai.012G062900.2-Promoter_Genomic | PN | *Gossypium raimondii* |
| 492 | DRM2 Gorai.012G062900.3-Promoter_Genomic | PN | *Gossypium raimondii* |
| 493 | DRM2 Gorai.006G031000.1-Promoter_Genomic | PN | *Gossypium raimondii* |
| 494 | DRM2 Gorai.006G031000.2-Promoter_Genomic | PN | *Gossypium raimondii* |
| 495 | IDN2 Gorai.013G263400.1-Promoter_Genomic | PN | *Gossypium raimondii* |
| 496 | IDN2 Gorai.013G263400.5-Promoter_Genomic | PN | *Gossypium raimondii* |
| 497 | MET1 Gorai.004G180200.1-Promoter_Genomic | PN | *Gossypium raimondii* |
| 498 | MET1 Gorai.012G048000.1-Promoter_Genomic | PN | *Gossypium raimondii* |
| 499 | MET1 Gorai.012G048000.2-Promoter_Genomic | PN | *Gossypium raimondii* |
| 500 | MET1 Gorai.012G048000.3-Promoter_Genomic | PN | *Gossypium raimondii* |
| 501 | MET1 Gorai.012G048000.4-Promoter_Genomic | PN | *Gossypium raimondii* |
| 502 | NRPD1a Gorai.004G207300.1-Promoter_Genomic | PN | *Gossypium raimondii* |
| 503 | NRPD1a Gorai.004G207300.2-Promoter_Genomic | PN | *Gossypium raimondii* |
| 504 | NRPD1a Gorai.004G207300.3-Promoter_Genomic | PN | *Gossypium raimondii* |
| 505 | NRPD1a Gorai.007G022200.1-Promoter_Genomic | PN | *Gossypium raimondii* |
| 506 | NRPD1b Gorai.010G216600.1-Promoter_Genomic | PN | *Gossypium raimondii* |

TABLE 1-continued

| SEQ ID # | IDENTITY | PN/PP (polynucleotide/ polypeptide) | Genus species |
|---|---|---|---|
| 507 | NRPD2 Gorai.001G037900.1-Promoter_Genomic | PN | Gossypium raimondii |
| 508 | NRPD2 Gorai.001G037900.2-Promoter_Genomic | PN | Gossypium raimondii |
| 509 | RDR2 Gorai.008G296900.1-Promoter_Genomic | PN | Gossypium raimondii |
| 510 | RDR6 Gorai.009G057700.1-Promoter_Genomic | PN | Gossypium raimondii |
| 511 | SGS3 Gorai.009G148800.1-Promoter_Genomic | PN | Gossypium raimondii |
| 512 | SGS3 Gorai.009G009900.1-Promoter_Genomic | PN | Gossypium raimondii |
| 513 | SGS3 Gorai.009G009900.2-Promoter_Genomic | PN | Gossypium raimondii |
| 514 | SGS3 Gorai.009G009900.3-Promoter_Genomic | PN | Gossypium raimondii |
| 515 | SGS3 Gorai.002G209000.1-Promoter_Genomic | PN | Gossypium raimondii |
| 516 | SGS3 Gorai.002G209000.2-Promoter_Genomic | PN | Gossypium raimondii |
| 517 | SGS3 Gorai.005G260400.2-Promoter_Genomic | PN | Gossypium raimondii |
| 518 | SGS3 Gorai.005G260400.1-Promoter_Genomic | PN | Gossypium raimondii |
| 519 | SGS3 Gorai.011G121000.1-Promoter_Genomic | PN | Gossypium raimondii |
| 520 | SGS3 Gorai.011G121100.4-Promoter_Genomic | PN | Gossypium raimondii |
| 521 | SGS3 Gorai.011G121100.1-Promoter_Genomic | PN | Gossypium raimondii |
| 522 | SGS3 Gorai.011G121100.3-Promoter_Genomic | PN | Gossypium raimondii |
| 523 | SGS3 Gorai.011G121100.2-Promoter_Genomic | PN | Gossypium raimondii |
| 524 | SGS3 Gorai.011G121100.5-Promoter_Genomic | PN | Gossypium raimondii |
| 525 | SUVH2_H9 Gorai.006G254500.1-Promoter_Genomic | PN | Gossypium raimondii |
| 526 | AGO5 Gorai.006G103000.1-Promoter_Genomic | PN | Gossypium raimondii |
| 527 | AGO5 Gorai.006G103000.12-Promoter_Genomic | PN | Gossypium raimondii |
| 528 | AGO5 Gorai.006G103000.13-Promoter_Genomic | PN | Gossypium raimondii |
| 529 | AGO5 Gorai.006G103000.14-Promoter_Genomic | PN | Gossypium raimondii |
| 530 | AGO5 Gorai.006G103000.2-Promoter_Genomic | PN | Gossypium raimondii |
| 531 | AGO5 Gorai.006G103000.3-Promoter_Genomic | PN | Gossypium raimondii |
| 532 | AGO5 Gorai.006G103000.4-Promoter_Genomic | PN | Gossypium raimondii |
| 533 | AGO5 Gorai.006G103000.5-Promoter_Genomic | PN | Gossypium raimondii |
| 534 | AGO5 Gorai.006G103000.6-Promoter_Genomic | PN | Gossypium raimondii |
| 535 | AGO5 Gorai.006G103000.15-Promoter_Genomic | PN | Gossypium raimondii |
| 536 | RDR1 Gorai.009G352500.1-Promoter_Genomic | PN | Gossypium raimondii |
| 537 | RDR1 Gorai.013G029000.1-Promoter_Genomic | PN | Gossypium raimondii |
| 538 | RDR1 Gorai.002G196400.1-Promoter_Genomic | PN | Gossypium raimondii |
| 539 | DCL4 Gorai.009G053300.1-Promoter_Genomic | PN | Gossypium raimondii |
| 540 | DCL4 Gorai.009G053300.3-Promoter_Genomic | PN | Gossypium raimondii |
| 541 | DCL4 Gorai.009G053300.2-Promoter_Genomic | PN | Gossypium raimondii |
| 542 | AGO4 Gorai.009G105600.2-amino acid | PP | Gossypium raimondii |
| 543 | AGO4 Gorai.009G105600.1-amino acid | PP | Gossypium raimondii |
| 544 | AGO4 Gorai.009G105600.7-amino acid | PP | Gossypium raimondii |

TABLE 1-continued

| SEQ ID # | IDENTITY | PN/PP (polynucleotide/ polypeptide) | Genus species |
|---|---|---|---|
| 545 | AGO4 Gorai.009G105600.3-amino acid | PP | *Gossypium raimondii* |
| 546 | AGO4 Gorai.009G105600.4-amino acid | PP | *Gossypium raimondii* |
| 547 | AGO4 Gorai.009G105600.5-amino acid | PP | *Gossypium raimondii* |
| 548 | AGO4 Gorai.009G105600.6-amino acid | PP | *Gossypium raimondii* |
| 549 | AGO4 Gorai.004G228100.1-amino acid | PP | *Gossypium raimondii* |
| 550 | AGO689 Gorai.009G105600.2-amino acid | PP | *Gossypium raimondii* |
| 551 | AGO689 Gorai.009G105600.1-amino acid | PP | *Gossypium raimondii* |
| 552 | AGO689 Gorai.009G105600.7-amino acid | PP | *Gossypium raimondii* |
| 553 | AGO689 Gorai.004G228100.1-amino acid | PP | *Gossypium raimondii* |
| 554 | AGO689 Gorai.001G195700.1-amino acid | PP | *Gossypium raimondii* |
| 555 | AGO689 Gorai.001G195700.3-amino acid | PP | *Gossypium raimondii* |
| 556 | AGO689 Gorai.001G195700.2-amino acid | PP | *Gossypium raimondii* |
| 557 | CMT3 Gorai.001G052000.1-amino acid | PP | *Gossypium raimondii* |
| 558 | DCL3 Gorai.010G093100.2-amino acid | PP | *Gossypium raimondii* |
| 559 | DCL3 Gorai.010G093100.3-amino acid | PP | *Gossypium raimondii* |
| 560 | DCL3 Gorai.010G093100.4-amino acid | PP | *Gossypium raimondii* |
| 561 | DCL3 Gorai.013G221400.1-amino acid | PP | *Gossypium raimondii* |
| 562 | DRM2 Gorai.012G062900.1-amino acid | PP | *Gossypium raimondii* |
| 563 | DRM2 Gorai.012G062900.2-amino acid | PP | *Gossypium raimondii* |
| 564 | DRM2 Gorai.012G062900.3-amino acid | PP | *Gossypium raimondii* |
| 565 | DRM2 Gorai.006G031000.1-amino acid | PP | *Gossypium raimondii* |
| 566 | DRM2 Gorai.006G031000.2-amino acid | PP | *Gossypium raimondii* |
| 567 | IDN2 Gorai.013G263400.1-amino acid | PP | *Gossypium raimondii* |
| 568 | MET1 Gorai.004G180200.1-amino acid | PP | *Gossypium raimondii* |
| 569 | MET1 Gorai.012G048000.1-amino acid | PP | *Gossypium raimondii* |
| 570 | MET1 Gorai.012G048000.2-amino acid | PP | *Gossypium raimondii* |
| 571 | MET1 Gorai.012G048000.3-amino acid | PP | *Gossypium raimondii* |
| 572 | MET1 Gorai.012G048000.4-amino acid | PP | *Gossypium raimondii* |
| 573 | NRPD1a Gorai.004G207300.1-amino acid | PP | *Gossypium raimondii* |
| 574 | NRPD1a Gorai.004G207300.2-amino acid | PP | *Gossypium raimondii* |
| 575 | NRPD1a Gorai.004G207300.3-amino acid | PP | *Gossypium raimondii* |
| 576 | NRPD1a Gorai.007G022200.1-amino acid | PP | *Gossypium raimondii* |
| 577 | NRPD1b Gorai.010G216600.1-amino acid | PP | *Gossypium raimondii* |
| 578 | NRPD1b Gorai.010G216600.3-amino acid | PP | *Gossypium raimondii* |
| 579 | NRPD1b Gorai.010G216600.2-amino acid | PP | *Gossypium raimondii* |
| 580 | NRPD1b Gorai.010G216600.4-amino acid | PP | *Gossypium raimondii* |
| 581 | NRPD2 Gorai.001G037900.1-amino acid | PP | *Gossypium raimondii* |
| 582 | NRPD2 Gorai.001G037900.2-amino acid | PP | *Gossypium raimondii* |

TABLE 1-continued

| SEQ ID # | IDENTITY | PN/PP (polynucleotide/ polypeptide) | Genus species |
|---|---|---|---|
| 583 | RDR2 Gorai.008G296900.1-amino acid | PP | *Gossypium raimondii* |
| 584 | RDR6 Gorai.009G057700.1-amino acid | PP | *Gossypium raimondii* |
| 585 | SGS3 Gorai.009G148800.1-amino acid | PP | *Gossypium raimondii* |
| 586 | SGS3 Gorai.009G009900.1-amino acid | PP | *Gossypium raimondii* |
| 587 | SGS3 Gorai.009G009900.2-amino acid | PP | *Gossypium raimondii* |
| 588 | SGS3 Gorai.009G009900.3-amino acid | PP | *Gossypium raimondii* |
| 589 | SGS3 Gorai.002G209000.1-amino acid | PP | *Gossypium raimondii* |
| 590 | SGS3 Gorai.002G209000.2-amino acid | PP | *Gossypium raimondii* |
| 591 | SGS3 Gorai.005G260400.2-amino acid | PP | *Gossypium raimondii* |
| 592 | SGS3 Gorai.005G260400.1-amino acid | PP | *Gossypium raimondii* |
| 593 | SGS3 Gorai.011G121000.1-amino acid | PP | *Gossypium raimondii* |
| 594 | SGS3 Gorai.011G121100.4-amino acid | PP | *Gossypium raimondii* |
| 595 | SGS3 Gorai.011G121100.1-amino acid | PP | *Gossypium raimondii* |
| 596 | SGS3 Gorai.011G121100.3-amino acid | PP | *Gossypium raimondii* |
| 597 | SGS3 Gorai.011G121100.2-amino acid | PP | *Gossypium raimondii* |
| 598 | SGS3 Gorai.011G121100.5-amino acid | PP | *Gossypium raimondii* |
| 599 | SUVH2H9 Gorai.006G254500.1-amino acid | PP | *Gossypium raimondii* |
| 600 | RDR1 Gorai.009G352500.1-amino acid | PP | *Gossypium raimondii* |
| 601 | RDR1 Gorai.013G029000.1-amino acid | PP | *Gossypium raimondii* |
| 602 | RDR1 Gorai.002G196400.1-amino acid | PP | *Gossypium raimondii* |
| 603 | DCL4 Gorai.009G053300.1-amino acid | PP | *Gossypium raimondii* |
| 604 | DCL4 Gorai.009G053300.3-amino acid | PP | *Gossypium raimondii* |
| 605 | DCL4 Gorai.009G053300.2-amino acid | PP | *Gossypium raimondii* |
| 606 | AGO5 Gorai.006G103000.1-amino acid | PP | *Gossypium raimondii* |
| 607 | AGO5 Gorai.006G103000.12-amino acid | PP | *Gossypium raimondii* |
| 608 | AGO5 Gorai.006G103000.13-amino acid | PP | *Gossypium raimondii* |
| 609 | AGO5 Gorai.006G103000.14-amino acid | PP | *Gossypium raimondii* |
| 610 | AGO5 Gorai.006G103000.2-amino acid | PP | *Gossypium raimondii* |
| 611 | AGO5 Gorai.006G103000.3-amino acid | PP | *Gossypium raimondii* |
| 612 | AGO5 Gorai.006G103000.4-amino acid | PP | *Gossypium raimondii* |
| 613 | AGO5 Gorai.006G103000.5-amino acid | PP | *Gossypium raimondii* |
| 614 | AGO5 Gorai.006G103000.6-amino acid | PP | *Gossypium raimondii* |
| 615 | AGO5 Gorai.006G103000.15-amino acid | PP | *Gossypium raimondii* |
| 616 | AGO4 GRMZM2G141818_T03-CDS | PN | *Zea mays* |
| 617 | AGO4 GRMZM2G141818_T02-CDS | PN | *Zea mays* |
| 618 | AGO4 GRMZM2G141818_T01-CDS | PN | *Zea mays* |
| 619 | AGO4 GRMZM2G089743_T01-CDS | PN | *Zea mays* |
| 620 | AGO4 GRMZM2G089743_T02-CDS | PN | *Zea mays* |
| 621 | AGO4 GRMZM2G589579_T01-CDS | PN | *Zea mays* |
| 622 | SUVH2H9 GRMZM2G034288_T01-CDS | PN | *Zea mays* |
| 623 | SUVH2H9 GRMZM2G025924_T01-CDS | PN | *Zea mays* |
| 624 | SGS3 GRMZM2G020187_T01-CDS | PN | *Zea mays* |
| 625 | RDR6 GRMZM2G145201_T01-CDS | PN | *Zea mays* |

TABLE 1-continued

| SEQ ID # | IDENTITY | PN/PP (polynucleotide/ polypeptide) | Genus species |
|---|---|---|---|
| 626 | RDR6 GRMZM2G357825_T01-CDS | PN | Zea mays |
| 627 | RDR6 GRMZM2G347931_T01-CDS | PN | Zea mays |
| 628 | RDR2 GRMZM2G042443_T01-CDS | PN | Zea mays |
| 629 | NRPD2 GRMZM2G054225_T01-CDS | PN | Zea mays |
| 630 | NRPD2 GRMZM2G054225_T02-CDS | PN | Zea mays |
| 631 | NRPD2 GRMZM2G133512_T01-CDS | PN | Zea mays |
| 632 | NRPD2 GRMZM2G427031_T04-CDS | PN | Zea mays |
| 633 | NRPD1a GRMZM2G080176_T01-CDS | PN | Zea mays |
| 634 | NRPD1a GRMZM2G007681_T01-CDS | PN | Zea mays |
| 635 | NRPD1a GRMZM2G007681_T02-CDS | PN | Zea mays |
| 636 | NRPD1b GRMZM2G470305_T01-CDS | PN | Zea mays |
| 637 | NRPD1b GRMZM2G153797_T01-CDS | PN | Zea mays |
| 638 | NRPD1b GRMZM2G044306_T01-CDS | PN | Zea mays |
| 639 | MET1 GRMZM2G333916_T01-CDS | PN | Zea mays |
| 640 | MET1 GRMZM2G333916_T02-CDS | PN | Zea mays |
| 641 | MET1 GRMZM2G334041_T01-CDS | PN | Zea mays |
| 642 | MET1 GRMZM2G334041_T02-CDS | PN | Zea mays |
| 643 | IDN2 GRMZM2G100898_T01-CDS | PN | Zea mays |
| 644 | IDN2 GRMZM2G025059_T01-CDS | PN | Zea mays |
| 645 | DRM2 GRMZM2G137366_T01-CDS | PN | Zea mays |
| 646 | DCL3 GRMZM5G814985_T01-CDS | PN | Zea mays |
| 647 | DCL3 GRMZM2G413853_T01-CDS | PN | Zea mays |
| 648 | DCL3 GRMZM2G413853_T02-CDS | PN | Zea mays |
| 649 | DCL3 GRMZM2G413853_T03-CDS | PN | Zea mays |
| 650 | CMT3 GRMZM2G005310_T02-CDS | PN | Zea mays |
| 651 | AGO6-8-9 GRMZM2G141818_T01-CDS | PN | Zea mays |
| 652 | AGO6-8-9 GRMZM2G089743_T01-CDS | PN | Zea mays |
| 653 | AGO6-8-9 GRMZM2G089743_T02-CDS | PN | Zea mays |
| 654 | AGO6-8-9 GRMZM2G432075_T01-CDS | PN | Zea mays |
| 655 | AGO5 GRMZM2G079080_T02-CDS | PN | Zea mays |
| 656 | AGO5 AC189879.3_FGT003-CDS | PN | Zea mays |
| 657 | AGO5 GRMZM2G059033_T01-CDS | PN | Zea mays |
| 658 | AGO5 GRMZM2G123063_T01-CDS | PN | Zea mays |
| 659 | DCL4 GRMZM2G040762_T01-CDS | PN | Zea mays |
| 660 | DCL4 GRMZM2G024466-CDS | PN | Zea mays |
| 661 | RDR1 GRMZM2G481730_T01-CDS | PN | Zea mays |
| 662 | AGO4 GRMZM2G141818_T03-Promoter_Genomic | PN | Zea mays |
| 663 | AGO4 GRMZM2G141818_T02-Promoter_Genomic | PN | Zea mays |
| 664 | AGO4 GRMZM2G141818_T01-Promoter_Genomic | PN | Zea mays |
| 665 | AGO4 GRMZM2G089743_T01-Promoter_Genomic | PN | Zea mays |
| 666 | AGO4 GRMZM2G089743_T02-Promoter_Genomic | PN | Zea mays |
| 667 | AGO4 GRMZM2G589579_T01-Promoter_Genomic | PN | Zea mays |
| 668 | AGO6-8-9 GRMZM2G141818_T01-Promoter_Genomic | PN | Zea mays |
| 669 | AGO6-8-9 GRMZM2G089743_T01-Promoter_Genomic | PN | Zea mays |
| 670 | AGO6-8-9 GRMZM2G089743_T02-Promoter_Genomic | PN | Zea mays |
| 671 | AGO6-8-9 GRMZM2G432075_T01-Promoter_Genomic | PN | Zea mays |
| 672 | CMT3 GRMZM2G005310_T02-Promoter_Genomic | PN | Zea mays |
| 673 | CMT3 GRMZM2G005310_T01-Promoter_Genomic | PN | Zea mays |
| 674 | CMT3 GRMZM2G025592_T01-Promoter_Genomic | PN | Zea mays |
| 675 | DCL3 GRMZM5G814985_T01-Promoter_Genomic | PN | Zea mays |
| 676 | DCL3 GRMZM2G413853_T01-Promoter_Genomic | PN | Zea mays |
| 677 | DCL3 GRMZM2G413853_T02-Promoter_Genomic | PN | Zea mays |
| 678 | DCL3 GRMZM2G413853_T03-Promoter_Genomic | PN | Zea mays |
| 679 | DRM2 GRMZM2G137366_T01-Promoter_Genomic | PN | Zea mays |
| 680 | IDN2 GRMZM2G100898_T01-Promoter_Genomic | PN | Zea mays |
| 681 | IDN2 GRMZM2G025059_T01-Promoter_Genomic | PN | Zea mays |

TABLE 1-continued

| SEQ ID # | IDENTITY | PN/PP (polynucleotide/ polypeptide) | Genus species |
|---|---|---|---|
| 682 | MET1 GRMZM2G333916_T01-Promoter_Genomic | PN | Zea mays |
| 683 | MET1 GRMZM2G333916_T02-Promoter_Genomic | PN | Zea mays |
| 684 | MET1 GRMZM2G334041_T01-Promoter_Genomic | PN | Zea mays |
| 685 | MET1 GRMZM2G334041_T02-Promoter_Genomic | PN | Zea mays |
| 686 | NRPD1a GRMZM2G080176_T01-Promoter_Genomic | PN | Zea mays |
| 687 | NRPD1a GRMZM2G007681_T01-Promoter_Genomic | PN | Zea mays |
| 688 | NRPD1b GRMZM2G470305_T01-Promoter_Genomic | PN | Zea mays |
| 689 | NRPD1b GRMZM2G153797_T01-Promoter_Genomic | PN | Zea mays |
| 690 | NRPD1b GRMZM2G044306_T01-Promoter_Genomic | PN | Zea mays |
| 691 | NRPD2 GRMZM2G054225_T01-Promoter_Genomic | PN | Zea mays |
| 692 | NRPD2 GRMZM2G054225_T02-Promoter_Genomic | PN | Zea mays |
| 693 | NRPD2 GRMZM2G133512_T01-Promoter_Genomic | PN | Zea mays |
| 694 | NRPD2 GRMZM2G427031_T04-Promoter_Genomic | PN | Zea mays |
| 695 | RDR2 GRMZM2G042443_T01-Promoter_Genomic | PN | Zea mays |
| 696 | RDR6 GRMZM2G145201_T01-Promoter_Genomic | PN | Zea mays |
| 697 | RDR6 GRMZM2G357825_T01-Promoter_Genomic | PN | Zea mays |
| 698 | RDR6 GRMZM2G347931_T01-Promoter_Genomic | PN | Zea mays |
| 699 | SGS3 GRMZM2G020187_T01-Promoter_Genomic | PN | Zea mays |
| 700 | SUVH2_H9 GRMZM2G034288_T01-Promoter_Genomic | PN | Zea mays |
| 701 | SUVH2_H9 GRMZM2G025924_T01-Promoter_Genomic | PN | Zea mays |
| 702 | AGO5 GRMZM2G079080_T02-Promoter_Genomic | PN | Zea mays |
| 703 | AGO5 AC189879.3_FGT003-Promoter_Genomic | PN | Zea mays |
| 704 | AGO5 GRMZM2G059033_T01-Promoter_Genomic | PN | Zea mays |
| 705 | AGO5 GRMZM2G123063_T01-Promoter_Genomic | PN | Zea mays |
| 706 | RDR1 GRMZM2G481730_T01-Promoter_Genomic | PN | Zea mays |
| 707 | DCL4 GRMZM2G040762_T01-Promoter_Genomic | PN | Zea mays |
| 708 | DCL4 GRMZM2G024466_T01-Promoter_Genomic | PN | Zea mays |
| 709 | AGO4 GRMZM2G141818_T03-amino acid | PP | Zea mays |
| 710 | AGO4 GRMZM2G141818_T02-amino acid | PP | Zea mays |
| 711 | AGO4 GRMZM2G141818_T01-amino acid | PP | Zea mays |
| 712 | AGO4 GRMZM2G089743_T01-amino acid | PP | Zea mays |
| 713 | AGO4 GRMZM2G089743_T02-amino acid | PP | Zea mays |
| 714 | AGO4 GRMZM2G589579_T01-amino acid | PP | Zea mays |
| 715 | AGO689 GRMZM2G141818_T01-amino acid | PP | Zea mays |
| 716 | AGO689 GRMZM2G089743_T01-amino acid | PP | Zea mays |
| 717 | AGO689 GRMZM2G089743_T02-amino acid | PP | Zea mays |
| 718 | AGO689 GRMZM2G432075_T01-amino acid | PP | Zea mays |
| 719 | CMT3 GRMZM2G005310_T02-amino acid | PP | Zea mays |
| 720 | CMT3 GRMZM2G005310_T01-amino acid | PP | Zea mays |
| 721 | CMT3 GRMZM2G025592_T01-amino acid | PP | Zea mays |
| 722 | DCL3 GRMZM5G814985_T01-amino acid | PP | Zea mays |
| 723 | DCL3 GRMZM2G413853_T01-amino acid | PP | Zea mays |
| 724 | DCL3 GRMZM2G413853_T02-amino acid | PP | Zea mays |
| 725 | DCL3 GRMZM2G413853_T03-amino acid | PP | Zea mays |
| 726 | DRM2 GRMZM2G137366_T01-amino acid | PP | Zea mays |

TABLE 1-continued

| SEQ ID # | IDENTITY | PN/PP (polynucleotide/ polypeptide) | Genus species |
|---|---|---|---|
| 727 | IDN2 GRMZM2G100898__T01-amino acid | PP | Zea mays |
| 728 | IDN2 GRMZM2G025059__T01-amino acid | PP | Zea mays |
| 729 | MET1 GRMZM2G333916__T01-amino acid | PP | Zea mays |
| 730 | MET1 GRMZM2G333916__T02-amino acid | PP | Zea mays |
| 731 | MET1 GRMZM2G334041__T01-amino acid | PP | Zea mays |
| 732 | MET1 GRMZM2G334041__T02-amino acid | PP | Zea mays |
| 733 | NRPD1a GRMZM2G080176__T01-amino acid | PP | Zea mays |
| 734 | NRPD1a GRMZM2G007681__T01-amino acid | PP | Zea mays |
| 735 | NRPD1a GRMZM2G007681__T02-amino acid | PP | Zea mays |
| 736 | NRPD1b GRMZM2G470305__T01-amino acid | PP | Zea mays |
| 737 | NRPD1b GRMZM2G153797__T01-amino acid | PP | Zea mays |
| 738 | NRPD1b GRMZM2G044306__T01-amino acid | PP | Zea mays |
| 739 | NRPD2 GRMZM2G054225__T01-amino acid | PP | Zea mays |
| 740 | NRPD2 GRMZM2G054225__T02-amino acid | PP | Zea mays |
| 741 | NRPD2 GRMZM2G133512__T01-amino acid | PP | Zea mays |
| 742 | NRPD2 GRMZM2G427031__T04-amino acid | PP | Zea mays |
| 743 | RDR2 GRMZM2G042443__T01-amino acid | PP | Zea mays |
| 744 | RDR6 GRMZM2G145201__T01-amino acid | PP | Zea mays |
| 745 | RDR6 GRMZM2G357825__T01-amino acid | PP | Zea mays |
| 746 | RDR6 GRMZM2G347931__T01-amino acid | PP | Zea mays |
| 747 | SGS3 GRMZM2G020187__T01-amino acid | PP | Zea mays |
| 748 | SUVH2H9 GRMZM2G034288__T01-amino acid | PP | Zea mays |
| 749 | SUVH2H9 GRMZM2G025924__T01-amino acid | PP | Zea mays |
| 750 | RDR1 GRMZM2G481730__T01-amino acid | PP | Zea mays |
| 751 | DCL4 GRMZM2G040762__T01-amino acid | PP | Zea mays |
| 752 | DCL4 GRMZM2G024466__T01-amino acid | PP | Zea mays |
| 753 | AGO5 GRMZM2G079080__T02-amino acid | PP | Zea mays |
| 754 | AGO5 AC189879.3__FGT003-amino acid | PP | Zea mays |
| 755 | AGO5 GRMZM2G059033__T01-amino acid | PP | Zea mays |
| 756 | AGO5 GRMZM2G123063__T01-amino acid | PP | Zea mays |
| 757 | AGO4 Sb03g011020.1-CDS | PN | Sorghum bicolor |
| 758 | AGO4 Sb03g011020.2-CDS | PN | Sorghum bicolor |
| 759 | AGO4 Sb09g030910.1-CDS | PN | Sorghum bicolor |
| 760 | SUVH2H9 Sb07g023560.1-CDS | PN | Sorghum bicolor |
| 761 | SGS3 Sb08g006200.1-CDS | PN | Sorghum bicolor |
| 762 | SGS3 Sb08g006220.1-CDS | PN | Sorghum bicolor |
| 763 | RDR6 Sb03g022880.1-CDS | PN | Sorghum bicolor |
| 764 | RDR6 Sb07g006150.1-CDS | PN | Sorghum bicolor |
| 765 | RDR6 Sb10g025950.1-CDS | PN | Sorghum bicolor |
| 766 | RDR6 Sb10g025970.1-CDS | PN | Sorghum bicolor |
| 767 | RDR2 Sb06g019330.1-CDS | PN | Sorghum bicolor |
| 768 | NRPD2 Sb01g042100.1-CDS | PN | Sorghum bicolor |
| 769 | NRPD2 Sb06g030300.1-CDS | PN | Sorghum bicolor |
| 770 | NRPD2 Sb07g004600.1-CDS | PN | Sorghum bicolor |
| 771 | NRPD1a Sb06g025933.1-CDS | PN | Sorghum bicolor |
| 772 | NRPD1b Sb04g003760.1-CDS | PN | Sorghum bicolor |
| 773 | MET1 Sb01g005082.1-CDS | PN | Sorghum bicolor |
| 774 | MET1 Sb02g004680.1-CDS | PN | Sorghum bicolor |
| 775 | IDN2 Sb03g006150.1-CDS | PN | Sorghum bicolor |

TABLE 1-continued

| SEQ ID # | IDENTITY | PN/PP (polynucleotide/ polypeptide) | Genus species |
|---|---|---|---|
| 776 | DRM2 Sb01g043010.1-CDS | PN | Sorghum bicolor |
| 777 | DRM2 Sb01g049860-CDS | PN | Sorghum bicolor |
| 778 | DRM2 Sb03g010500.1-CDS | PN | Sorghum bicolor |
| 779 | DCL3 Sb01g018890.1-CDS | PN | Sorghum bicolor |
| 780 | DCL3 Sb03g043355.1-CDS | PN | Sorghum bicolor |
| 781 | CMT3 Sb06g028430.1-CDS | PN | Sorghum bicolor |
| 782 | AGO6-8-9 Sb03g010990.1-CDS | PN | Sorghum bicolor |
| 783 | AGO6-8-9 Sb08g009100.1-CDS | PN | Sorghum bicolor |
| 784 | AGO5 Sb01g004920.1-CDS | PN | Sorghum bicolor |
| 785 | AGO5 Sb02g005150.1-CDS | PN | Sorghum bicolor |
| 786 | AGO5 Sb10g023230.1-CDS | PN | Sorghum bicolor |
| 787 | DCL4 Sb01g015670.1\|Sb01g015670-CDS | PN | Sorghum bicolor |
| 788 | DCL4 Sb06g022180.1\|Sb06g022180-CDS | PN | Sorghum bicolor |
| 789 | AGO4 Sb03g011020.1-Promoter_Genomic | PN | Sorghum bicolor |
| 790 | AGO4 Sb03g011020.2-Promoter_Genomic | PN | Sorghum bicolor |
| 791 | AGO4 Sb09g030910.1-Promoter_Genomic | PN | Sorghum bicolor |
| 792 | AGO6-8-9 Sb03g010990.1-Promoter_Genomic | PN | Sorghum bicolor |
| 793 | AGO6-8-9 Sb08g009100.1-Promoter_Genomic | PN | Sorghum bicolor |
| 794 | CMT3 Sb06g028430.1-Promoter_Genomic | PN | Sorghum bicolor |
| 795 | DCL3 Sb01g018890.1-Promoter_Genomic | PN | Sorghum bicolor |
| 796 | DCL3 Sb03g043355.1-Promoter_Genomic | PN | Sorghum bicolor |
| 797 | DRM2 Sb01g043010.1-Promoter_Genomic | PN | Sorghum bicolor |
| 798 | DRM2 Sb01g049860.1-Promoter_Genomic | PN | Sorghum bicolor |
| 799 | DRM2 Sb03g010500.1-Promoter_Genomic | PN | Sorghum bicolor |
| 800 | IDN2 Sb03g006150.1-Promoter_Genomic | PN | Sorghum bicolor |
| 801 | MET1 Sb01g005082.1-Promoter_Genomic | PN | Sorghum bicolor |
| 802 | MET1 Sb02g004680.1-Promoter_Genomic | PN | Sorghum bicolor |
| 803 | NRPD1a Sb06g025933.1-Promoter_Genomic | PN | Sorghum bicolor |
| 804 | NRPD1b Sb04g003760.1-Promoter_Genomic | PN | Sorghum bicolor |
| 805 | NRPD2 Sb01g042100.1-Promoter_Genomic | PN | Sorghum bicolor |
| 806 | NRPD2 Sb06g030300.1-Promoter_Genomic | PN | Sorghum bicolor |
| 807 | NRPD2 Sb07g004600.1-Promoter_Genomic | PN | Sorghum bicolor |
| 808 | RDR2 Sb06g019330.1-Promoter_Genomic | PN | Sorghum bicolor |
| 809 | RDR6 Sb03g022880\|Sb03g022880.1-Promoter_Genomic | PN | Sorghum bicolor |
| 810 | RDR6 Sb07g006150.1-Promoter_Genomic | PN | Sorghum bicolor |
| 811 | RDR6 Sb10g025950.1-Promoter_Genomic | PN | Sorghum bicolor |
| 812 | RDR6 Sb10g025970.1-Promoter_Genomic | PN | Sorghum bicolor |
| 813 | SGS3 Sb08g006200.1-Promoter_Genomic | PN | Sorghum bicolor |

TABLE 1-continued

| SEQ ID # | IDENTITY | PN/PP (polynucleotide/ polypeptide) | Genus species |
|---|---|---|---|
| 814 | SGS3 Sb08g006220.1-Promoter_Genomic | PN | *Sorghum bicolor* |
| 815 | SUVH2_H9 Sb07g023560.1-Promoter_Genomic | PN | *Sorghum bicolor* |
| 816 | AGO5 Sb01g004920.1-Promoter_Genomic | PN | *Sorghum bicolor* |
| 817 | AGO5 Sb02g005150.1-Promoter_Genomic | PN | *Sorghum bicolor* |
| 818 | AGO5 Sb10g023230.1-Promoter_Genomic | PN | *Sorghum bicolor* |
| 819 | DCL4 Sb01g015670.1-Promoter_Genomic | PN | *Sorghum bicolor* |
| 820 | DCL4 Sb06g022180.1-Promoter_Genomic | PN | *Sorghum bicolor* |
| 821 | AGO4 Sb03g011020.1-amino acid | PP | *Sorghum bicolor* |
| 822 | AGO4 Sb03g011020.2-amino acid | PP | *Sorghum bicolor* |
| 823 | AGO4 Sb09g030910.1-amino acid | PP | *Sorghum bicolor* |
| 824 | AGO689 Sb03g010990.1-amino acid | PP | *Sorghum bicolor* |
| 825 | AGO689 Sb08g009100.1-amino acid | PP | *Sorghum bicolor* |
| 826 | CMT3 Sb06g028430.1-amino acid | PP | *Sorghum bicolor* |
| 827 | DCL3 Sb01g018890.1-amino acid | PP | *Sorghum bicolor* |
| 828 | DCL3 Sb03g043355.1-amino acid | PP | *Sorghum bicolor* |
| 829 | DRM2 Sb01g043010.1-amino acid | PP | *Sorghum bicolor* |
| 830 | DRM2 Sb01g049860.1-amino acid | PP | *Sorghum bicolor* |
| 831 | DRM2 Sb03g010500.1-amino acid | PP | *Sorghum bicolor* |
| 832 | IDN2 Sb03g006150.1-amino acid | PP | *Sorghum bicolor* |
| 833 | MET1 Sb01g005084.1-amino acid | PP | *Sorghum bicolor* |
| 834 | MET1 Sb02g004680.1-amino acid | PP | *Sorghum bicolor* |
| 835 | NRPD1a Sb06g025933.1-amino acid | PP | *Sorghum bicolor* |
| 836 | NRPD1b Sb04g003760.1-amino acid | PP | *Sorghum bicolor* |
| 837 | NRPD2 Sb01g042100.1-amino acid | PP | *Sorghum bicolor* |
| 838 | NRPD2 Sb06g030300.1-amino acid | PP | *Sorghum bicolor* |
| 839 | NRPD2 Sb07g004600.1-amino acid | PP | *Sorghum bicolor* |
| 840 | RDR2 Sb06g019330.1-amino acid | PP | *Sorghum bicolor* |
| 841 | RDR6 Sb03g022880.1-amino acid | PP | *Sorghum bicolor* |
| 842 | RDR6 Sb07g006150.1-amino acid | PP | *Sorghum bicolor* |
| 843 | RDR6 Sb10g025950.1-amino acid | PP | *Sorghum bicolor* |
| 844 | RDR6 Sb10g025970.1-amino acid | PP | *Sorghum bicolor* |
| 845 | SGS3 Sb08g006200.1-amino acid | PP | *Sorghum bicolor* |
| 846 | SGS3 Sb08g006220.1-amino acid | PP | *Sorghum bicolor* |
| 847 | SUVH2H9 Sb07g023560.1-amino acid | PP | *Sorghum bicolor* |
| 848 | DCL4 Sb01g015670.1-amino acid | PP | *Sorghum bicolor* |
| 849 | DCL4 Sb06g022180.1-amino acid | PP | *Sorghum bicolor* |
| 850 | AGO5 Sb01g004920.1-amino acid | PP | *Sorghum bicolor* |
| 851 | AGO5 Sb02g005150.1-amino acid | PP | *Sorghum bicolor* |

TABLE 1-continued

| SEQ ID # | IDENTITY | PN/PP (polynucleotide/ polypeptide) | Genus species |
|---|---|---|---|
| 852 | AGO5 Sb10g023230.1-amino acid | PP | Sorghum bicolor |
| 853 | AGO4 LOC_Os04g06770.1-CDS | PN | Oryza sativa |
| 854 | AGO4 LOC_Os04g06770.2-CDS | PN | Oryza sativa |
| 855 | AGO4 LOC_Os01g16870.1-CDS | PN | Oryza sativa |
| 856 | AGO4 LOC_Os01g16870.2-CDS | PN | Oryza sativa |
| 857 | AGO4 LOC_Os01g16870.3-CDS | PN | Oryza sativa |
| 858 | AGO4 LOC_Os01g16870.4-CDS | PN | Oryza sativa |
| 859 | SUVH2H9 Os07g25450.1-CDS | PN | Oryza sativa |
| 860 | SGS3 LOC_Os12g09580.1-CDS | PN | Oryza sativa |
| 861 | SGS3 LOC_Os12g09590.1-CDS | PN | Oryza sativa |
| 862 | RDR6 Os01g34350.1-CDS | PN | Oryza sativa |
| 863 | RDR2 LOC_Os04g39160.1-CDS | PN | Oryza sativa |
| 864 | NRPD2 LOC_Os08g07480.1-CDS | PN | Oryza sativa |
| 865 | NRPD2 LOC_Os04g54840.1-CDS | PN | Oryza sativa |
| 866 | NRPD1a Os06g40950.1-CDS | PN | Oryza sativa |
| 867 | NRPD1a Os04g48370.1-CDS | PN | Oryza sativa |
| 868 | NRPD1a Os04g41490.1-CDS | PN | Oryza sativa |
| 869 | NRPD1b LOC_Os01g73430.1-CDS | PN | Oryza sativa |
| 870 | NRPD1b LOC_Os02g05880.1-CDS | PN | Oryza sativa |
| 871 | MET1 LOC_Os03g58400.1-CDS | PN | Oryza sativa |
| 872 | IDN2 LOC_Os01g05470.1-CDS | PN | Oryza sativa |
| 873 | DRM2 LOC_Os03g02010.4-CDS | PN | Oryza sativa |
| 874 | DRM2 LOC_Os12g01800.1-CDS | PN | Oryza sativa |
| 875 | DRM2 LOC_Os11g01810.1-CDS | PN | Oryza sativa |
| 876 | DCL3 gi297610683O-CDS | PN | Oryza sativa |
| 877 | CMT3 LOC_Os03g12570.1-CDS | PN | Oryza sativa |
| 878 | AG06-8-9 LOC_Os07g16224.1-CDS | PN | Oryza sativa |
| 879 | AGO5 LOC_Os07g09020.1-CDS | PN | Oryza sativa |
| 880 | AGO5 LOC_Os03g58600.1-CDS | PN | Oryza sativa |
| 881 | AGO5 LOC_Os06g39640.1-CDS | PN | Oryza sativa |
| 882 | RDR1 LOC_Os02g50330.1-CDS | PN | Oryza sativa |
| 883 | AGO4 LOC_Os04g06770.1-Promoter_Genomic | PN | Oryza sativa |
| 884 | AGO4 LOC_Os04g06770.2-Promoter_Genomic | PN | Oryza sativa |
| 885 | AGO4 LOC_Os01g16870.1-Promoter_Genomic | PN | Oryza sativa |
| 886 | AGO4 LOC_Os01g16870.2-Promoter_Genomic | PN | Oryza sativa |
| 887 | AGO4 LOC_Os01g16870.3-Promoter_Genomic | PN | Oryza sativa |
| 888 | AGO4 LOC_Os01g16870.4-Promoter_Genomic | PN | Oryza sativa |
| 889 | AGO6-8-9 LOC_Os07g16224.1-Promoter_Genomic | PN | Oryza sativa |
| 890 | CMT3 LOC_Os03g12570.1-Promoter_Genomic | PN | Oryza sativa |
| 891 | DRM2 LOC_Os03g02010.4-Promoter_Genomic | PN | Oryza sativa |
| 892 | DRM2 LOC_Os12g01800.1-Promoter_Genomic | PN | Oryza sativa |
| 893 | DRM2 LOC_Os11g01810.1-Promoter_Genomic | PN | Oryza sativa |
| 894 | IDN2 LOC_Os01g05470.1-Promoter_Genomic | PN | Oryza sativa |
| 895 | MET1 LOC_Os03g58400.1-Promoter_Genomic | PN | Oryza sativa |
| 896 | NRPD1a LOC_Os06g40950.1-Promoter_Genomic | PN | Oryza sativa |
| 897 | NRPD1a LOC_Os04g48370.1-Promoter_Genomic | PN | Oryza sativa |
| 898 | NRPD1a LOC_Os04g41490.1-Promoter_Genomic | PN | Oryza sativa |
| 899 | NRPD1b LOC_Os01g73430.1-Promoter_Genomic | PN | Oryza sativa |
| 900 | NRPD1b LOC_Os02g05880.1-Promoter_Genomic | PN | Oryza sativa |
| 901 | NRPD2 LOC_Os08g07480.1-Promoter_Genomic | PN | Oryza sativa |
| 902 | NRPD2 LOC_Os04g54840.1-Promoter_Genomic | PN | Oryza sativa |
| 903 | RDR2 LOC_Os04g39160.1-Promoter_Genomic | PN | Oryza sativa |
| 904 | RDR6 LOC_Os01g34350.1-Promoter_Genomic | PN | Oryza sativa |

TABLE 1-continued

| SEQ ID # | IDENTITY | PN/PP (polynucleotide/ polypeptide) | Genus species |
|---|---|---|---|
| 905 | SGS3 LOC__Os12g09580.1-Promoter_Genomic | PN | Oryza sativa |
| 906 | SGS3 LOC__Os12g09590.1-Promoter_Genomic | PN | Oryza sativa |
| 907 | SUVH2_H9 LOC__Os07g25450.1-Promoter_Genomic | PN | Oryza sativa |
| 908 | AGO5 LOC__Os07g09020.1-Promoter_Genomic | PN | Oryza sativa |
| 909 | AGO5 LOC__Os03g58600.1-Promoter_Genomic | PN | Oryza sativa |
| 910 | AGO5 LOC__Os06g39640.1-Promoter_Genomic | PN | Oryza sativa |
| 911 | RDR1 LOC__Os02g50330.1-Promoter_Genomic | PN | Oryza sativa |
| 912 | AGO4 LOC__Os04g06770.1-amino acid | PP | Oryza sativa |
| 913 | AGO4 LOC__Os04g06770.2-amino acid | PP | Oryza sativa |
| 914 | AGO4 LOC__Os01g16870.1-amino acid | PP | Oryza sativa |
| 915 | AGO4 LOC__Os01g16870.2-amino acid | PP | Oryza sativa |
| 916 | AGO4 LOC__Os01g16870.3-amino acid | PP | Oryza sativa |
| 917 | AGO4 LOC__Os01g16870.4-amino acid | PP | Oryza sativa |
| 918 | AGO689 LOC__Os07g16224.1-amino acid | PP | Oryza sativa |
| 919 | CMT3 LOC__Os03g12570.1-amino acid | PP | Oryza sativa |
| 920 | DCL3 Os10g0485600-amino acid | PP | Oryza sativa |
| 921 | DRM2 LOC__Os03g02010.4-amino acid | PP | Oryza sativa |
| 922 | DRM2 LOC__Os12g01800.1-amino acid | PP | Oryza sativa |
| 923 | DRM2 LOC__Os11g01810.1-amino acid | PP | Oryza sativa |
| 924 | IDN2 LOC__Os01g05470.1-amino acid | PP | Oryza sativa |
| 925 | MET1 LOC__Os03g58400.1-amino acid | PP | Oryza sativa |
| 926 | NRPD1a LOC__Os06g40950.1-amino acid | PP | Oryza sativa |
| 927 | NRPD1a LOC__Os04g48370.1-amino acid | PP | Oryza sativa |
| 928 | NRPD1a LOC__Os04g41490.1-amino acid | PP | Oryza sativa |
| 929 | NRPD1b LOC__Os01g73430.1-amino acid | PP | Oryza sativa |
| 930 | NRPD1b LOC__Os02g05880.1-amino acid | PP | Oryza sativa |
| 931 | NRPD2 LOC__Os08g07480.1-amino acid | PP | Oryza sativa |
| 932 | NRPD2 LOC__Os04g54840.1-amino acid | PP | Oryza sativa |
| 933 | RDR2 LOC__Os04g39160.1-amino acid | PP | Oryza sativa |
| 934 | RDR6 LOC__Os01g34350.1-amino acid | PP | Oryza sativa |
| 935 | SGS3 LOC__Os12g09580.1-amino acid | PP | Oryza sativa |
| 936 | SGS3 LOC__Os12g09590.1-amino acid | PP | Oryza sativa |
| 937 | SUVH2H9 LOC__Os07g25450.1-amino acid | PP | Oryza sativa |
| 938 | RDR1 LOC__Os02g50330.1-amino acid | PP | Oryza sativa |
| 939 | AGO5 LOC__Os07g09020.1-amino acid | PP | Oryza sativa |
| 940 | AGO5 LOC__Os03g58600.1-amino acid | PP | Oryza sativa |
| 941 | AGO5 LOC__Os06g39640.1-amino acid | PP | Oryza sativa |
| 942 | SUVH2H9 gi474402932-CDS | PN | Triticum urartu |
| 943 | SUVH2H9 gi48927668accAY634575.1-CDS | PN | Triticum aestivum |
| 944 | SGS3 GPAAP80862.1-CDS | PN | Triticum aestivum |
| 945 | RDR2 gi474049152__3-CDS | PN | Triticum urartu |
| 946 | RDR2 gi73486682__3-CDS | PN | Triticum aestivum |
| 947 | RDR2 gi4138609AJ011978.1-CDS | PN | Triticum aestivum |
| 948 | NRPD2 gi14017551-CDS | PN | Triticum aestivum |
| 949 | NRPD2 gi474308450-CDS | PN | Triticum urartu |
| 950 | NRPD1a gi14017551__23184-25235-CDS | PN | Triticum aestivum |
| 951 | NRPD1a G1812gi474413220-CDS | PN | Triticum urartu |
| 952 | NRPD1b gi474413146_G1812-CDS | PN | Triticum urartu |
| 953 | MET1 gi474175088-CDS | PN | Triticum urartu |
| 954 | MET1 gi47834699-CDS | PN | Triticum aestivum |
| 955 | CMT3 gi16755863-CDS | PN | Triticum aestivum |
| 956 | CMT3 gi473982126-CDS | PN | Triticum urartu |
| 957 | AGO6-8-9 gbJQ805149.1__GI433351406-CDS | PN | Triticum aestivum |

TABLE 1-continued

| SEQ ID # | IDENTITY | PN/PP (polynucleotide/ polypeptide) | Genus species |
|---|---|---|---|
| 958 | AGO6-8-9 gi474363461-CDS | PN | Triticum urartu |
| 959 | AGO6-8-9 gi474054172-CDS | PN | Triticum urartu |
| 960 | AGO5 gi: 433351409-CDS | PN | Triticum aestivum |
| 961 | AGO5 gi: 474077143-CDS | PN | Triticum urartu |
| 962 | DCL4 gi: 478246245-CDS | PN | Triticum aestivum |
| 963 | DCL4 gi: 473971146-CDS | PN | Triticum urartu |
| 964 | RDR1 gi: 474216269-CDS | PN | Triticum urartu |
| 965 | RDR1 gi: 33342177-CDS | PN | Triticum aestivum |
| 966 | AGO6-8-9 gi474363462-Promoter_Genomic | PN | Triticum urartu |
| 967 | AGO6-8-9 gi474054173-Promoter_Genomic | PN | Triticum urartu |
| 968 | MET1 gi474175088-Promoter_Genomic | PN | Triticum urartu |
| 969 | NRPD1a gi14017551Promoter_Genomic | PN | Triticum aestivum |
| 970 | NRPD1a gi474413220-Promoter_Genomic | PN | Triticum urartu |
| 971 | NRPD1b gi474413146-Promoter_Genomic | PN | Triticum urartu |
| 972 | NRPD2 gi474308450-Promoter_Genomic | PN | Triticum urartu |
| 973 | RDR2 gi474049152-Promoter_Genomic | PN | Triticum urartu |
| 974 | SGS3 GPAAP80862.1-Promoter_Genomic | PN | Triticum aestivum |
| 975 | AGO5 gi: 474077143-Promoter_Genomic | PN | Triticum urartu |
| 976 | AGO5 gi: 433351409-Promoter_Genomic | PN | Triticum aestivum |
| 977 | RDR1 gi: 33342177-Promoter_Genomic | PN | Triticum aestivum |
| 978 | RDR1 gi: 474216269-Promoter_Genomic | PN | Triticum urartu |
| 979 | DCL4 gi: 473971146-Promoter_Genomic | PN | Triticum urartu |
| 980 | DCL4 gi: 478246245-Promoter_Genomic | PN | Triticum aestivum |
| 981 | AGO4gi519669068-amino acid | PP | Triticum aestivum |
| 982 | AGO689gi474054173-amino acid | PP | Triticum urartu |
| 983 | AGO689gi474363462-amino acid | PP | Triticum urartu |
| 984 | AGO689gi433351406-amino acid | PP | Triticum aestivum |
| 985 | CMT3gi16755863-amino acid | PP | Triticum aestivum |
| 986 | CMT3gi473982127-amino acid | PP | Triticum aestivum |
| 987 | MET1 gi: 47834699-amino acid | PP | Triticum aestivum |
| 988 | MET1 gi: 474175089-amino acid | PP | Triticum urartu |
| 989 | NRPD1a gi14017563-amino acid | PP | Triticum aestivum |
| 990 | NRPD1a gi474413220-amino acid | PP | Triticum urartu |
| 991 | NRPD1b gi474413220-amino acid | PP | Triticum urartu |
| 992 | NRPD2 gi14017562-amino acid | PP | Triticum aestivum |
| 993 | NRPD2 gi474308451-amino acid | PP | Triticum urartu |
| 994 | RDR2 gi474049153-amino acid | PP | Triticum urartu |
| 995 | RDR2 gi4138610-amino acid | PP | Triticum aestivum |

TABLE 1-continued

| SEQ ID # | IDENTITY | PN/PP (polynucleotide/ polypeptide) | Genus species |
|---|---|---|---|
| 996 | RDR2 gi73486683-amino acid | PP | Triticum aestivum |
| 997 | SGS3 gi32401386-amino acid | PP | Triticum aestivum |
| 998 | SUVH2H9 gi48927668-amino acid | PP | Triticum aestivum |
| 999 | SUVH2H9 gi474402933-amino acid | PP | Triticum urartu |
| 1000 | RDR1 gi33342178(partial) | PP | Triticum aestivum |
| 1001 | RDR1 gi474216270-amino acid | PP | Triticum urartu |
| 1002 | DCL4 gi: 473971148-amino acid | PP | Triticum urartu |
| 1003 | DCL4 gi: 478246246-amino acid | PP | Triticum aestivum |
| 1004 | AGO5 gi: 474077144-amino acid | PP | Triticum urartu |
| 1005 | AGO5 gi: 433351409-amino acid | PP | Triticum aestivum |
| 1006 | pFGC5941 GenBank: AY310901.1 | PN | Artificial sequence - vector |
| 1007 | pRS300 Addgene plasmid 22846 Article: Highly specific gene silencing by artificial microRNAs in *Arabidopsis*. Schwab et al (Plant Cell. 2006 May. 18(5): 1121-33. PubMed) | PN | Artificial sequence - vector |
| 1008 | pHELLSGATE GenBank: AJ311874.1 | PN | Artificial sequence - vector |
| 1009 | pMDC32 GenBank: FJ172534.1 | PN | Artificial sequence - vector |

The term "exogenous" means, introduced from or produced outside the organism or system, for example, a promoter sequence that is sourced from an organism that is of different genetic origin than the organism it is introduced into is an exogenous sequence.

As used herein, "polynucleotide" includes reference to a deoxyribopolynucleotide, ribopolynucleotide or analogs thereof that have the essential nature of a natural ribonucleotide in that they hybridize, under stringent hybridization conditions, to substantially the same nucleotide sequence as naturally occurring nucleotides and/or allow translation into the same amino acid(s) as the naturally occurring nucleotide(s). A polynucleotide may be full-length or a subsequence of a native or heterologous structural or regulatory gene. Unless otherwise indicated, the term includes reference to the specified sequence as well as the complementary sequence thereof.

The terms "polypeptide," "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The term "polypeptide" refers to one or more amino acid sequences. The term is also inclusive of fragments, variants, homologs, alleles or precursors (e.g., pre-proproteins or proproteins) thereof.

As used herein "promoter" includes reference to a region of DNA upstream from the start of transcription and involved in recognition and binding of RNA polymerase and other proteins to initiate transcription. A "plant promoter" is a promoter capable of initiating transcription in plant cells.

Exemplary plant promoters include, but are not limited to, those that are obtained from plants, plant viruses and bacteria which comprise genes expressed in plant cells such *Agrobacterium* or *Rhizobium*. Examples are promoters that preferentially initiate transcription in certain tissues, such as leaves, roots, seeds, fibres, xylem vessels, tracheids or sclerenchyma. Such promoters are referred to as "tissue preferred." A "cell type" specific promoter primarily drives expression in certain cell types in one or more organs, for example, vascular cells in roots or leaves. An "inducible" or "regulatable" promoter is a promoter, which is under environmental control. Examples of environmental conditions that may affect transcription by inducible promoters include anaerobic conditions or the presence of light. Another type of promoter is a developmentally regulated promoter, for example, a promoter that drives expression during pollen development. Tissue preferred, cell type specific, developmentally regulated and inducible promoters constitute the class of "non-constitutive" promoters. A "constitutive" promoter is a promoter which is active in essentially all tissues of a plant, under most environmental conditions and states of development or cell differentiation.

"Parthenogenically-derived embryo" refers to an embryo developed without fusion of the male (sperm cell) and female gametes (egg cell) taking place and is also referred to a parthenogenically-derived clonal embryo.

As used herein "recombinant" includes reference to a cell or vector, that has been modified by the introduction of a heterologous nucleic acid or that the cell is derived from a cell so modified. Thus, for example, recombinant cells express genes that are not found in identical form within the native (non-recombinant) form of the cell or express native genes that are otherwise abnormally expressed, under expressed or not expressed at all as a result of deliberate human intervention or may have reduced or eliminated expression of a native gene. The term "recombinant" as used herein does not encompass the alteration of the cell or vector by naturally occurring events (e.g., spontaneous mutation, natural transformation/transduction/transposition) such as those occurring without deliberate human intervention.

As used herein, a "recombinant expression cassette" is a nucleic acid construct, generated recombinantly or synthetically, with a series of specified nucleic acid elements, which permit transcription of a particular nucleic acid in a target cell. The recombinant expression cassette may be incorporated into a plasmid, chromosome, mitochondrial DNA, plastid DNA, virus or nucleic acid fragment. Typically, the recombinant expression cassette portion of an expression vector includes, among other sequences, a nucleic acid to be transcribed and a heterologous promoter.

"Sexually-generated embryos" refer to embryos that contain both male and female DNA. Sexually-generated embryos are also referred to as non-clonal embryos.

The phrase "unreduced gamete" refers to a reproductive cell formed by a plant, having the same ("unreduced") ploidy and/or genotype as somatic (sporophyte) cells of the plant, and capable of contributing genetic material for embryo formation. The gamete may be formed by and/or present in an ovule of the plant and may be described as a female gamete, whether or not the gamete is capable of uniting with a male gamete. A diploid plant produces unreduced gametes that are diploid, a triploid plant produces unreduced gametes that are triploid, as so on. An unreduced female gamete may unite with a male gamete to form a zygote that develops into an embryo, or, in some cases, may develop into an embryo without uniting with a male gamete. An unreduced female gamete may be described as having the same genotype as somatic cells of the plant, which means that at least substantially every allele of a somatic cell is also present in the gamete. In some examples, the chromosomal constitution of the gamete (or of a progeny plant or next generation) may be described as a somatic chromosomal constitution, which means that a copy of each and every somatic chromosome of the parent plant is present in the gamete (or child plant or next generation), with the linkage of alleles on each individual chromosome preserved when comparing somatic cells of the parent plant to the gamete (or child plant or next generation). A somatic chromosomal constitution may be generated in a gamete when no segregation or recombination occurs between homologous chromosomes during gamete formation.

As used herein, "transgenic plant" includes reference to a plant, which comprises within its genome a heterologous polynucleotide. Generally, the heterologous polynucleotide is stably integrated within the genome such that the polynucleotide is passed on to successive generations. The heterologous polynucleotide may be integrated into the genome alone or as part of a recombinant expression cassette. "Transgenic" is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition or spontaneous mutation. A "heterologous nucleotide sequence" is a sequence that is not naturally occurring with the promoter sequence of the disclosure. While this nucleotide sequence is heterologous to the promoter sequence, it may be homologous (native) or heterologous (foreign) to the plant host.

As used herein, "vector" includes reference to a nucleic acid used in transfection of a host cell and into which may be inserted a polynucleotide. Vectors are often replicons. Expression vectors permit transcription of a nucleic acid inserted therein.

The following terms are used to describe the sequence relationships between two or more nucleic acids or polynucleotides or polypeptides: (a) "reference sequence," (b) "comparison window," (c) "sequence identity," (d) "percentage of sequence identity" and (e) "substantial identity."

As used herein, "reference sequence" is a defined sequence used as a basis for sequence comparison. A reference sequence may be a subset or the entirety of a specified sequence; for example, as a segment of a full-length cDNA or gene sequence or the complete cDNA or gene sequence.

As used herein, "comparison window" means includes reference to a contiguous and specified segment of a polynucleotide sequence, wherein the polynucleotide sequence may be compared to a reference sequence and wherein the portion of the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally may be 30, 40, 50, 100 or longer. Those of skill in the art understand that to avoid a high similarity to a reference sequence due to inclusion of gaps in the polynucleotide sequence a gap penalty is typically introduced and is subtracted from the number of matches.

Methods of alignment of nucleotide and amino acid sequences for comparison are well known in the art. The local homology algorithm (BESTFIT) of Smith and Waterman, (1981) *Adv. Appl. Math* 2:482, may conduct optimal alignment of sequences for comparison; by the homology alignment algorithm (GAP) of Needleman and Wunsch, (1970) *J. Mol. Biol.* 48:443-53; by the search for similarity method (Tfasta and Fasta) of Pearson and Lipman, (1988) *Proc. Natl. Acad. Sci. USA* 85:2444; by computerized implementations of these algorithms, including, but not limited to: CLUSTAL in the PC/Gene program by Intelligenetics, Mountain View, Calif., GAP, BESTFIT, BLAST, FASTA and TFASTA in the Wisconsin Genetics Software Package, Version 8 (available from Genetics Computer Group (GCG® programs (Accelrys, Inc., San Diego, Calif.).). The CLUSTAL program is well described by Higgins and Sharp, (1988) *Gene* 73:237-44; Higgins and Sharp, (1989) *CABIOS* 5:151-3; Corpet, et al., (1988) *Nucleic Acids Res.* 16:10881-90; Huang, et al., (1992) *Computer Applications in the Biosciences* 8:155-65 and Pearson, et al., (1994) *Meth. Mol. Biol.* 24:307-31. The preferred program to use for optimal global alignment of multiple sequences is PileUp (Feng and Doolittle, (1987) *J. Mol. Evol.*, 25:351-60 which is similar to the method described by Higgins and Sharp, (1989) *CABIOS* 5:151-53 and hereby incorporated by reference). The BLAST family of programs which may be used for database similarity searches includes: BLASTN for nucleotide query sequences against nucleotide database sequences; BLASTX for nucleotide query sequences against protein database sequences; BLASTP for protein query sequences against protein database sequences; TBLASTN for protein query sequences against nucleotide database sequences and TBLASTX for nucleotide query sequences against nucleotide database sequences. See, *Current Protocols in Molecular Biology*, Chapter 19, Ausubel et al., eds., Greene Publishing and Wiley-Interscience, New York (1995).

GAP uses the algorithm of Needleman and Wunsch, supra, to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the Wisconsin Genetics Software Package are 8 and 2, respectively. The gap creation and gap extension penalties may be expressed as an integer selected from the group of integers consisting of from 0 to 100. Thus, for example, the gap creation and gap extension penalties may be 0, 1, 2, 3, 4, 5, 6, 7, 8, 9, 10, 15, 20, 30, 40, 50 or greater.

GAP presents one member of the family of best alignments. There may be many members of this family, but no other member has a better quality. GAP displays four figures of merit for alignments: Quality, Ratio, Identity and Similarity. The Quality is the metric maximized in order to align the sequences. Ratio is the quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold. The scoring matrix used in Version 10 of the Wisconsin Genetics Software Package is BLOSUM62 (see, Henikoff and Henikoff, (1989) *Proc. Natl. Acad. Sci. USA* 89:10915).

Unless otherwise stated, sequence identity/similarity values provided herein refer to the value obtained using the BLAST 2.0 suite of programs using default parameters (Altschul, et al., (1997) *Nucleic Acids Res.* 25:33 89-402).

As those of ordinary skill in the art will understand, BLAST searches assume that proteins may be modeled as random sequences. However, many real proteins comprise regions of nonrandom sequences, which may be homopolymeric tracts, short-period repeats, or regions enriched in one or more amino acids. Such low-complexity regions may be aligned between unrelated proteins even though other regions of the protein are entirely dissimilar. A number of low-complexity filter programs may be employed to reduce such low-complexity alignments. For example, the SEG (Wooten and Federhen, (1993) *Comput. Chem.* 17:149-63) and XNU (Claverie and States, (1993) *Comput. Chem.* 17:191-201) low-complexity filters may be employed alone or in combination.

As used herein, "sequence identity" or "identity" in the context of two nucleic acid or polypeptide sequences includes reference to the residues in the two sequences, which are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. Where sequences differ in conservative substitutions, the percent sequence identity may be adjusted upwards to correct for the conservative nature of the substitution. Sequences, which differ by such conservative substitutions, are said to have "sequence similarity" or "similarity." Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, (1988) *Computer Applic. Biol. Sci.* 4:11-17, e.g., as implemented in the program PC/GENE (Intelligenetics, Mountain View, Calif., USA).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

The term "substantial identity" of polynucleotide sequences means that a polynucleotide comprises a sequence that has between 50-100% sequence identity, preferably at least 50% sequence identity, preferably at least 60% sequence identity, preferably at least 70%, more preferably at least 80%, more preferably at least 90% and most preferably at least 95%, compared to a reference sequence using one of the alignment programs described using standard parameters. One of skill will recognize that these values may be appropriately adjusted to determine corresponding identity of proteins encoded by two nucleotide sequences by taking into account codon degeneracy, amino acid similarity, reading frame positioning and the like. Substantial identity of amino acid sequences for these purposes normally means sequence identity of between 55-100%, preferably at least 55%, preferably at least 60%, more preferably at least 70%, 80%, 90% and most preferably at least 95%.

The terms "substantial identity" in the context of a peptide indicates that a peptide comprises a sequence with between 55-100% sequence identity to a reference sequence preferably at least 55% sequence identity, preferably 60% preferably 70%, more preferably 80%, most preferably at least 90% or 95% sequence identity to the reference sequence over a specified comparison window. Preferably, optimal alignment is conducted using the homology alignment algorithm of Needleman and Wunsch, supra. An indication that two peptide sequences are substantially identical is that one peptide is immunologically reactive with antibodies raised against the second peptide. Thus, a peptide is substantially identical to a second peptide, for example, where the two peptides differ only by a conservative substitution. In addition, a peptide may be substantially identical to a second peptide when they differ by a non-conservative change if the epitope that the antibody recognizes is substantially identical. Peptides, which are "substantially similar" share sequences as, noted above except that residue positions, which are not identical, may differ by conservative amino acid changes.

Unreduced female gametes may be formed by diplospory or apospory, among others. The process of diplospory generates an unreduced gamete from a typical gamete precursor, a megaspore mother cell (MMC), which fails to undergo meiosis. The process of apospory generates an unreduced gamete by direct differentiation of a somatic cell into a gamete precursor, an MMC-like cell. The MMC-like cell generally is formed in a distinct site from the MMC (if present). Apospory may occur via a supernumerary gamete precursor while the usual gamete precursor undergoes meiosis (or apomeiosis).

Unreduced female gametes may be generated at any suitable frequency relative to total female gametes (unreduced and meiotically reduced). For example, the frequency of unreduced female gametes generated by an individual plant may be at least about 1%, 5%, 10%, or 25%, among others.

The term "apomixis" (plural apomixes) refers to clonal reproduction through seeds. Apomixis is the process by which a maternal plant produces one or more clonal seeds each containing an embryo that is a clone of the maternal plant. In other words, the embryo is genetically identical to the maternal plant and contains no genetic material from a paternal plant (e.g., a diploid maternal plant produces a diploid embryo clone). The embryo clone contains the unreduced genome (the somatic genome) of the maternal plant. Each of the clonal seeds interchangeably may be termed an asexual seed or an apomictic seed. The clonal seed may contain endosperm that is produced without plant pollination (i.e., the endosperm contains only the maternal genome and no paternal genes/genome). Alternatively, if the maternal plant has been pollinated, the endosperm of the clonal seed may result from fertilization and may have a maternal contribution and a paternal contribution (from pollen). Each clonal seed, if viable, may germinate to produce a progeny plant that is a clone of the maternal plant. A maternal plant that reproduces by apomixis forms viable clonal seeds at a detectable frequency, with any suitable percentage of its seeds being clonal, such as at least about 0.1%, 0.2%, 0.3%, 0.4%, 0.5%, 0.6%, 0.7%, 0.8%, 0.9%, 1%, 5%, 10%, 20%, 50%, or 100%, among others. The number and frequency of clonal seeds and non-clonal seeds may be influenced by the genotype of the maternal plant and its environment (i.e., whether or not the maternal plant is pollinated).

Apomixis may occur in a maternal plant when an RNA-dependent DNA methylation (RdDM) pathway is defective. Accordingly, apomixis may be induced by rendering the pathway defective. The pathway may be involved in silencing repetitive sequences by methylation of the sequences. RdDM may be required to prevent apomixis. The structure, expression, and/or activity of at least one member of the RdDM pathway may be altered to render RdDM defective and promote apomixis. The member(s) may be one or more of AGO4, AGO6, AGO9, CMT3, DCL3, DRM2, IDS2, MET1, NPRD1a, NPRD1b, NRPE1, NRPE2, RDR2, RDR6, SGS3, SUVH2, and SUVH9, among others, or a functional/structural homolog of any of the members from a different species. The homolog may exhibit homology through identity or similarity at the gene, RNA, and/or polypeptide level.

An amount of identity or similarity between two polypeptides may be determined by the blastp algorithm (e.g., program BLASTP 2.2.18+), as described in the following two references, which are incorporated herein by reference: Stephen F. Altschul, et al. (1997), "Gapped BLAST and PSI-BLAST: a new generation of protein database search programs," Constructs Res. 25:3389-3402; and Stephen F. Altschul et al. (2005) "Protein database searches using compositionally adjusted substitution matrices," FEBS J. 272:5101-5109. Examples of substantial similarity or identity include at least about 40%, 50%, 60%, 70%, or 80% sequence similarity or identity, a similarity score of at least about 200 or 250, and/or an E-Value of less than about 1e-40, 1e-60, or 1e-80, among others, using the blastp algorithm, with optimal alignment and, if needed, introduction of gaps.

A DNA sequence is "operatively linked" to an expression control sequence when the expression control sequence controls and regulates the transcription and translation of that DNA sequence. For example, the DNA sequence may be a targeting region and the expression control sequence may be a promoter. The term "operatively linked" includes having an appropriate start signal (e.g., ATG) in front of the DNA sequence to be expressed and maintaining the correct reading frame to permit expression of the DNA sequence under the control of the expression control sequence and production of the desired product encoded by the DNA sequence.

The phrase "RNA interference" refers to a process of inhibiting gene expression in a targeted fashion using RNA mediators, which may be termed interfering RNAs. Interfering RNAs may include double-stranded RNAs, short interfering RNAs, micro RNAs, and/or the like. In some embodiments, the interfering RNA, as expressed or introduced, may be a double-stranded RNA, such as an RNA with a hairpin structure, which may be processed in the cell to form a small RNA (e.g., a short interfering RNA or a micro RNA). Small RNAs generally include RNAs of less than about 30 nucleotides, such as RNAs of 20, 21, 22, 23, 24, or 25 nucleotides, among others. RNA interference may inhibit gene expression before, during, and/or after transcription of a gene (i.e., by a transcriptional and/or a post-transcriptional mechanism), such as by gene modification (e.g., DNA/histone methylation), mRNA degradation, and/or inhibition of mRNA translation, among others.

The phrase "defective for RNA-dependent DNA methylation (RdDM) activity" refers to a plant defective for RNA-dependent DNA methylation such that RNA-dependent DNA methylation activity is modulated, for example, decreased, inhibited or silenced. Being defective for RdDM activity means that at least one gene in the RNA-dependent DNA methylation pathway has been altered to the extent that the altered gene or protein results in defective RNA-dependent DNA methylation. In some instances, more than one gene or protein in the RNA-dependent DNA methylation pathway may be altered, wherein the combination of the more than one altered genes or protein results in defective RNA-dependent DNA methylation. The gene or protein in the RdDM pathway may be altered in level of expression or RNA-dependent DNA methylation (RdDM) activity so that RNA-dependent DNA methylation activity is decreased or inhibited or silenced. An altered gene that results in defective RNA-dependent DNA methylation may include an alteration (substitution or deletion), insertion or modification to any gene that encodes a product involved in and/or required for RNA-dependent DNA methylation, wherein the alteration or modification result in defective RNA-dependent DNA methylation. Defects in RdDM activity may include global or specific up- or down-regulation of small RNA molecules affecting target genes. Likewise, defects in RdDM activity may include global or specific up- or down-regulation of DNA methylation affecting target genes or chromosomal regions.

The term "plant" refers to a member of the Plantae kingdom of eukaryotic organisms, which may be described as a tree, bush, grass, shrub, herb, vine, moss, fern, algae, or a combination thereof, among others. A plant may (or may not) lack the capability for locomotive movement and generally possesses cell walls formed of cellulose. A plant may be capable of carrying out photosynthesis and may (or may not) be a vascular plant. In some embodiments, the plant may be an annual or a perennial. The plant may be a flowering plant (an angiosperm), such as a monocotyledon or a dicotyledon. In some embodiments, the plant may produce a grain, tuber, fruit, vegetable, nut, seed, fiber, oil, or a combination thereof, among others. Furthermore, the plant may be a crop plant. Exemplary crop plants that may be suitable for generation of transgenic plants according to the present disclosure include tobacco, potato, corn (maize), tomato, rice, wheat, alfalfa, soybean, and the like.

The phrase "transformed plant" refers to a plant comprising a nucleic acid construct, interchangeably termed a transgenic plant. The construct may be integrated into the plant's genome (i.e., nuclear or plastid genome), in some or at least substantially all of the cells of the plant. For example, the construct may be present in the plant's germline. Accordingly, the construct may be heritable, that is, inherited by at least one or more members, or at least substantially all members, of a succeeding generation of the plant.

The term "nucleic acid" refers to a compound comprising a chain of nucleotides. A nucleic acid may be single-stranded or double stranded. A nucleic acid may have a natural or artificial (i.e., engineered) structure, or a combination thereof. A nucleic acid may refer to ribonucleic acids, deoxyribonucleic acids, or a hybrid.

The term "gene" refers to a nucleic acid or segment thereof that provides an expressible unit for expression of a polypeptide and/or a functional RNA (e.g., an interfering RNA). A gene thus may include a targeting region (also termed a targeting sequence) to define the sequence of the interfering RNA that is expressed and at least one transcriptional promoter (also termed a promoter sequence) operatively linked to the targeting region, to control (i.e., promote, drive, and/or regulate) transcription of the targeting region. A gene optionally may include one or more other control regions and/or untranslated regions, such as at least one 5' leader sequence, intron, transcriptional terminator (also termed a terminator sequence), or any combination thereof, among others.

The term "genetics" may refer to a subset or portion of the genome of a subject, which may be one or two nucleotides, a SNP, or a defined sequence, and determining the genetics of a subject may comprise, but is not limited to, identifying, locating, sequencing, probing, hybridizing to, quantifying or labeling one or more nucleic acid bases of the genome of the subject, which for example a subject may be a plant, seed or embryo or parts thereof.

The term "construct" refers to a nucleic acid created, at least in part, outside of plants using techniques of genetic engineering. A gene included in a construct may be termed a transgene.

The term "expression" refers to a process by which a product, namely, an RNA and/or polypeptide, is synthesized based on information encoded in a nucleic acid and/or gene, generally in the form of DNA (or RNA). Accordingly, the nucleic acid/gene may be expressed to form an RNA and/or polypeptide, which means that the RNA and/or polypeptide is expressed from the nucleic acid/gene.

Ranges may be expressed herein as from "about" one particular value, and/or to "about" another particular value. When such a range is expressed, also specifically contemplated and considered disclosed is the range—from the one particular value and/or to the other particular value unless the context specifically indicates otherwise. Similarly, when values are expressed as approximations, by use of the antecedent "about," it will be understood that the particular value forms another, specifically contemplated embodiment that should be considered disclosed unless the context specifically indicates otherwise. It will be further understood that the endpoints of each of the ranges are significant both in relation to the other endpoint, and independently of the other endpoint unless the context specifically indicates otherwise. Finally, it should be understood that all of the individual values and sub-ranges of values contained within an explicitly disclosed range are also specifically contemplated and should be considered disclosed unless the context specifically indicates otherwise. The foregoing applies regardless of whether in particular cases some or all of these embodiments are explicitly disclosed.

Unless defined otherwise, all technical and scientific terms used herein have the same meanings as commonly understood by one of skill in the art to which the disclosed method and compositions belong. Although any methods and materials similar or equivalent to those described herein may be used in the practice or testing of the present method and compositions, the particularly useful methods, devices, and materials are as described. Publications cited herein and the material for which they are cited are hereby specifically incorporated by reference. Nothing herein is to be construed as an admission that the present invention is not entitled to antedate such disclosure by virtue of prior invention. No admission is made that any reference constitutes prior art. The discussion of references states what their authors assert, and applicants reserve the right to challenge the accuracy and pertinency of the cited documents. It will be clearly understood that, although a number of publications are referred to herein, such reference does not constitute an admission that any of these documents forms part of the common general knowledge in the art.

Those skilled in the art will recognize, or be able to ascertain using no more than routine experimentation, many equivalents to the specific embodiments of the method and compositions described herein. Such equivalents are intended to be encompassed by the following claims.

B. Methods

Methods of Obtaining Seeds Comprising Clonal Embryos

Disclosed are methods of obtaining seeds comprising clonal embryos comprising collecting one or more seeds produced by a maternal plant, wherein the maternal plant is unable to be pollinated, wherein the one or more seeds comprise a parthenogenically-derived embryo that is a clone of the maternal plant.

Disclosed are methods of obtaining seeds comprising clonal embryos comprising collecting one or more seeds produced by a maternal plant, wherein the maternal plant is unable to be pollinated, wherein the one or more seeds comprise a parthenogenically-derived embryo that is a clone of the maternal plant, wherein the maternal plant is defective in at least one RNA dependent DNA methylation pathway gene. For example, the RNA dependent DNA methylation pathway gene may be, but is not limited to, any of the polynucleotides included in Table 1 and sequences in the accompanying sequence listing, AGO4 (ARGONAUTE 4), AGO6 (ARGONAUTE 6), AGO8 (ARGONAUTE 8), AGO9 (ARGONAUTE 9), CMT3 (CHROMOMETHYLASE 3), DCL3 (DICER-LIKE 3), DRM2 (DOMAINS REARRANGED METHYLASE 2), EXS1 (EXTRA SPOROGENOUS CELLS1), IDN2 (INVOLVED IN DE NOVO 2), MET1 (METHYL TRANSFERASE 1), NPRD1a (NUCLEAR POLYMERASE D 1a), NRPD1b (NUCLEAR POLYMERASE D 1b), NRPD2 (NUCLEAR POLYMERASE D 2), NRPE1 (NUCLEAR RNA POLYMERASE E 1), NRPE2 (NUCLEAR RNA POLYMERASE E 2), RDR2 (RNA-DEPENDENT RNA POLYMERASE 2), RDR6 (RNA-DEPENDENT RNA POLYMERASE 6), SGS3 (SUPPRESSOR OF GENE SILENCING 3), SUVH2 (SUPPRESSOR OF VARIEGATION 3-9 HOMOLOG 2), and SUVH9 (SUPPRESSOR OF VARIEGATION 3-9 HOMOLOG 9). Defective RNA-dependent DNA methylation may result in plants that are unable to form viable pollen.

In some instances, the AGO4 allele may be ago4-6 or ago4-1; the AGO6 allele may be ago6-2; the AGO9 allele may be 9-2, 9-3 or 9-4; the AGO8 allele may be ago 8-1; the RDR2 allele may be rdr2-1; the RDR6 allele may be rdr6-15 or rdr6-11; the SGS3 allele may be sgs3-11; the DRM2 allele may be drm2-2; and the MET1 allele may be met1-7.

Also disclosed are methods of obtaining seeds comprising clonal embryos comprising a) collecting one or more seeds produced by a maternal plant, wherein the maternal plant is defective in at least one RNA dependent DNA methylation pathway gene; and b) sorting the seeds to separate the seeds comprising clonal embryos from the seeds comprising non-clonal embryos; wherein the maternal plant is pollinated prior to collecting the seeds, and wherein the one or more seeds produced by the maternal plant comprise an embryo that is a clone of the maternal plant.

Sorting seeds may be based on phenotype or genotype. Sorting by phenotype may comprise sorting the seeds based on size, shape, color, or a combination thereof. Sorting may be performed manually or automatically. Automatic sorting may comprise a machine comprising an optical detector. In some instances, the sorting may be done visually.

The disclosed methods of obtaining seeds comprising clonal embryos may comprise a maternal plant that is unable to self-pollinate. A maternal plant's ability to self-pollinate may be disrupted physically, chemically, or genetically. Examples of chemical disruption comprise exposure to a gametocide that abolishes pollen formation. Gametocides may include, but are not limited to, at least one of maleic hydrazide (1,2-dihydropyridazine, 3-6-dione) (MH), 2,4-dichlorophenoxyacetic acid (2,4-D), a-naphthalene acetic acid (NAA), and tri-iodobenzoic acid (TIBA). Examples of physical disruption comprise emasculating the maternal plant. Emasculating occurs prior to collecting one or more seeds.

Also disclosed are methods of obtaining clonal seeds, the method comprising: (A) obtaining one or more maternal plants, each optionally being defective for RNA-dependent DNA methylation; (B) allowing pollination of the maternal plants; (C) collecting a mixture of seeds produced by the maternal plants and including seeds comprising non-clonal embryos that were sexually-generated and seeds comprising clonal embryos that are each a clone of a maternal plant; and (D) sorting the mixture to separate seeds comprising clonal embryos from seeds comprising non-clonal embryos by distinguishing clonal embryos from sexually-generated embryos.

Disclosed are methods of obtaining clonal seeds, the method comprising: (A) obtaining one or more maternal plants, each optionally being defective for RNA-dependent DNA methylation; (B) allowing pollination of the maternal plants; (C) collecting a mixture of seeds produced by the maternal plants and including seeds comprising non-clonal embryos that were sexually-generated and seeds comprising clonal embryos that are each a clone of a maternal plant; and (D) sorting the mixture to separate seeds comprising clonal embryos from seeds comprising non-clonal embryos by distinguishing clonal embryos from sexually-generated embryos, wherein the step of sorting includes a step of optically distinguishing clonal embryos from sexually-generated embryos.

Clonal embryos may be distinguished from sexually-generated embryos at least in part by color. In some instances, clonal embryos may be distinguished from sexually-generated embryos at least in part by size, shape, size and shape, or genetic testing.

Disclosed are methods of obtaining clonal seeds, the method comprising: (A) obtaining one or more maternal plants, each optionally being defective for RNA-dependent DNA methylation; (B) allowing pollination of the maternal plants; (C) collecting a mixture of seeds produced by the maternal plants and including non-clonal seeds containing sexually-generated embryos and clonal seeds containing clonal embryos that are each a clone of a maternal plant; and (D) sorting the mixture to separate clonal seeds from non-clonal seeds by distinguishing clonal embryos from sexually-generated embryos, wherein the step of sorting includes a step of optically distinguishing clonal embryos from sexually-generated embryos, wherein the step of sorting may be performed manually. In some instances, the step of sorting may be performed automatically. In some instances, the step of sorting may be performed with a machine including an optical detector.

Disclosed are methods of obtaining clonal seeds, the method comprising: (A) obtaining one or more maternal plants, each optionally being defective for RNA-dependent DNA methylation; (B) allowing pollination of the maternal plants; (C) collecting a mixture of seeds produced by the maternal plants and including non-clonal seeds containing sexually-generated embryos and clonal seeds containing clonal embryos that are each a clone of a maternal plant; and (D) sorting the mixture to separate clonal seeds from non-clonal seeds by distinguishing clonal embryos from sexually-generated embryos, wherein each maternal plant has at least one mutation that renders the maternal plant defective for RNA-dependent DNA methylation. A mutation that renders the maternal plant defective for RNA-dependent DNA methylation may modify at least one endogenous gene that encodes a product involved in and/or required for RNA-dependent DNA methylation. The mutation may include a mutation that occurred spontaneously or that was produced with a nonspecific chemical mutagen, a transposable element, or a targeting construct (e.g., CRE/LOX).

In any of the disclosed methods, each maternal plant may include at least one construct that renders the maternal plant defective for RNA-dependent DNA methylation. The construct may be any of the constructs disclosed herein. For example, the construct may comprise a siRNA that silences expression of a gene in the RNA-dependent DNA methylation pathway. In some instances, the at least one construct expresses at least one RNA that renders the maternal plant defective for RNA-dependent DNA methylation. RNA may include an RNA having a pair of regions configured to base-pair intramolecularly.

The step of obtaining one or more maternal plants may include a step of transforming an ancestor of the one or more maternal plants with at least one construct including an embryo marker and/or configured to affect a characteristic of an embryo marker provided by each maternal plant. A further step of transforming an ancestor of the one or more maternal plants with at least one construct to render RNA-dependent DNA methylation defective may be employed. A same ancestor of the one or more maternal plants may be transformed to introduce the embryo marker and render RNA-dependent DNA methylation defective. For example, the ancestor is transformed with a single construct including the embryo marker and configured to affect RNA-dependent DNA methylation.

Each maternal plant may include an embryo marker introduced by breeding in the disclosed methods of obtaining clonal seeds. The embryo marker may be an allelic variant, such as a mutant, of an endogenous gene.

Disclosed are methods of obtaining clonal seeds, wherein an embryo marker may be provided by pollen.

Disclosed are methods of obtaining clonal seeds, wherein none of the maternal plants contributes pollen for the step of allowing pollination.

Disclosed are methods of obtaining clonal seeds, wherein each of the maternal plants may be male sterile.

In some instances, each of the maternal plants may be exposed to a gametocide that abolishes pollen formation before the step of allowing pollination, and wherein the gametocide includes at least one of maleic hydrazide (1,2-dihydropyridazine, 3-6-dione) (MH), 2,4-dichlorophenoxy-acetic acid (2,4-D), a-naphthalene acetic acid (NAA), and tri-iodobenzoic acid (TIBA).

In some instances the methods of obtaining clonal seeds further comprises a step of emasculating each of the maternal plants before the step of allowing pollination.

Disclosed are methods of obtaining clonal seeds, wherein each maternal plant has an abnormal level, activity, and/or structure of at least one of the following genes/gene products: any of the polynucleotides or polypeptides included in Table 1 and the sequences in the accompanying sequence listing, AGO4 (ARGONAUTE 4), AGO6 (ARGONAUTE 6), AGO9 (ARGONAUTE 9), CMT3 (CHROMOMETHYLASE 3), DCL3 (DICER-LIKE 3), DRM2 (DOMAINS REARRANGED METHYLASE 2), IDN2 (INVOLVED IN DE NOVO 2), MET1 (METHYL TRANSFERASE 1), NPRD1a (NUCLEAR POLYMERASE D 1a), NPRD1b (NUCLEAR POLYMERASE D 1b), NPRD2 (NUCLEAR POLYMERASE D 2), NRPE1 (NUCLEAR RNA POLYMERASE E 1), NRPE2 (NUCLEAR RNA POLYMERASE E 2), RDR2 (RNA-DEPENDENT RNA POLYMERASE 2), RDR6 (RNA-DEPENDENT RNA POLYMERASE 6), SGS3 (SUPPRESSOR OF GENE SILENCING 3), SUVH2 (SUPPRESSOR OF VARIEGATION 3-9 HOMOLOG 2), and SUVH9 (SUPPRESSOR OF VARIEGATION 3-9 HOMOLOG 9).

Also disclosed are methods of obtaining clonal seeds, the method comprising: (A) obtaining one or more maternal plants each defective for RNA-dependent DNA methylation and each unable to form, or prevented from forming, viable pollen; and (B) collecting seeds produced by the one or more maternal plants, each seed containing an embryo that is a clone of the maternal plant. In some instances, each maternal plant is unable to form viable pollen.

Disclosed are methods of obtaining clonal seeds, the method comprising: (A) obtaining one or more maternal plants each defective for RNA-dependent DNA methylation and each unable to form, or prevented from forming, viable pollen; and (B) collecting seeds produced by the one or more maternal plants, each seed containing an embryo that is a clone of the maternal plant, wherein each maternal plant is unable to form viable pollen, wherein each maternal plant contains at least one construct that renders the maternal plant unable to form viable pollen.

Disclosed are methods of obtaining clonal seeds, the method comprising: (A) obtaining one or more maternal plants each defective for RNA-dependent DNA methylation and each unable to form, or prevented from forming, viable pollen; and (B) collecting seeds produced by the one or more maternal plants, each seed containing an embryo that is a clone of the maternal plant, wherein each maternal plant is unable to form viable pollen, wherein each maternal plant has one or more mutations that render the maternal plant unable to form viable pollen.

Disclosed are methods of obtaining clonal seeds, the method comprising: (A) obtaining one or more maternal plants each defective for RNA-dependent DNA methylation and each unable to form, or prevented from forming, viable pollen; and (B) collecting seeds produced by the one or more maternal plants, each seed containing an embryo that is a clone of the maternal plant, wherein the step of obtaining includes a step of emasculating each maternal plant by removing one or more male reproductive organs, namely, stamens, from the maternal plant.

Disclosed are methods of obtaining clonal seeds, the method comprising: (A) obtaining one or more maternal plants each defective for RNA-dependent DNA methylation and each unable to form, or prevented from forming, viable pollen; and (B) collecting seeds produced by the one or more maternal plants, each seed containing an embryo that is a clone of the maternal plant, wherein the step of obtaining includes a step of exposing each maternal plant to a substance (a gametocide) that abolishes formation of viable pollen.

Methods of Plant Cloning

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants.

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, wherein each maternal plant includes at least one construct that renders the maternal plant defective for RNA-dependent DNA methylation.

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, wherein each maternal plant includes at least one construct that renders the maternal plant defective for RNA-dependent DNA methylation, wherein the at least one construct expresses at least one RNA that renders the maternal plant defective for RNA-dependent DNA methylation. For example, the at least one RNA may include an RNA having a pair of regions configured to base-pair intramolecularly.

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, wherein the step of obtaining one or more maternal plants includes a step of transforming an ancestor of the one or more maternal plants with at least one construct including an embryo marker and/or configured to affect a characteristic of an embryo marker provided by each maternal plant.

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, wherein the step of obtaining one or more maternal plants includes a step of transforming an ancestor of the one or more maternal plants with at least one construct including an embryo marker and/or configured to affect a characteristic of an embryo marker provided by each maternal plant, further comprising a step of transforming an ancestor of the one or more maternal plants with at least one construct to render RNA-dependent DNA methylation defective. In some instances, a same ancestor of the one or more maternal plants may be transformed to introduce the embryo marker and render RNA-dependent DNA methylation defective. In some instances, the ancestor may be transformed with a single construct including the embryo marker and configured to affect RNA-dependent DNA methylation.

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, wherein each maternal plant includes an embryo marker introduced by breeding. The embryo marker may be an allelic variant, such as a mutant, of an endogenous gene. An embryo marker may be provided by pollen.

Disclosed are methods of plant cloning, wherein none of the maternal plants contributes pollen for the step of allowing pollination.

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, wherein each of the maternal plants is male sterile.

In some instances, each of the maternal plants may be exposed to a gametocide that abolishes pollen formation before the step of allowing pollination, and wherein the gametocide includes at least one of maleic hydrazide (1,2-dihydropyridazine, 3-6-dione) (MH), 2,4-dichlorophenoxyacetic acid (2,4-D), a-naphthalene acetic acid (NAA), and tri-iodobenzoic acid (TIBA).

The disclosed methods of plant cloning may further comprise a step of emasculating each of the maternal plants before the step of allowing pollination.

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, wherein each maternal plant has an abnormal level, activity, and/or structure of at least one of the following genes/gene products: any of the polynucleotides or polypeptides included in Table 1 and the sequences in the accompanying sequence listing, AGO4 (ARGONAUTE 4), AGO6 (ARGONAUTE 6), AGO9 (ARGONAUTE 9), CMT3 (CHROMOMETHYLASE 3), DCL3 (DICER-LIKE 3), DRM2 (DOMAINS REARRANGED METHYLASE 2), IDN2 (INVOLVED IN DE NOVO 2), MET1 (METHYL TRANSFERASE 1), NPRD1a (NUCLEAR POLYMERASE D 1a), NPRD1b (NUCLEAR POLYMERASE D 1b), NPRD2 (NUCLEAR POLYMERASE D 2), NRPE1 (NUCLEAR RNA POLYMERASE E 1), NRPE2 (NUCLEAR RNA POLYMERASE E 2), RDR2 (RNA-DEPENDENT RNA POLYMERASE 2), RDR6 (RNA-DEPENDENT RNA POLYMERASE 6), SGS3 (SUPPRESSOR OF GENE SILENCING 3), SUVH2 (SUPPRESSOR OF VARIEGATION 3-9 HOMOLOG 2), and SUVH9 (SUPPRESSOR OF VARIEGATION 3-9 HOMOLOG 9).

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, wherein the step of growing progeny plants includes a step of growing seedlings, and wherein the step of distinguishing is performed while the progeny plants are seedlings. In some instances, the step of distinguishing may be performed by optically distinguishing clonal plants from sexually-generated plants.

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, wherein clonal plants are visually distinguishable from sexually-generated plants. In some instances, the step of distinguishing may include a step of performing at least one test on the progeny plants.

For example, the at least one test may include a genetic test such as, but not limited to, genetic profiling.

Disclosed are methods of plant cloning, the method comprising: (A) obtaining one or more maternal plants, each optionally being defective for RNA-dependent DNA methylation; (B) allowing pollination of the maternal plants; (C) growing progeny plants from seeds produced by the one or more maternal plants, the progeny plants including sexually-generated plants and clonal plants, each clonal plant being a clone of a maternal plant; and (D) distinguishing clonal plants from sexually-generated plants, further comprising a step of sorting clonal plants from sexually-generated plants.

Methods of Screening

Disclosed are methods of screening for maternal plants that produce seeds comprising parthenogenically-derived clonal embryos comprising a) obtaining a maternal plant unable to pass on paternally-derived chromosomes to embryos, wherein an activity of a gene of interest in a RNA dependent DNA methylation pathway is silenced in the plant; b) harvesting the seeds; and c) determining whether the seeds comprise clonal embryos, wherein the presence of seeds comprising clonal embryos indicates the maternal plant may produce parthenogenically-derived clonal embryos.

Disclosed are methods of screening for maternal plants that produce seeds comprising parthenogenically-derived clonal embryos comprising a) obtaining a maternal plant unable to pass on paternally-derived chromosomes to embryos, wherein an activity of a gene of interest in a RNA dependent DNA methylation pathway is silenced in the plant; b) harvesting the seeds; and c) determining whether the seeds comprise clonal embryos, wherein the presence of seeds comprising clonal embryos indicates the maternal plant may produce parthenogenically-derived clonal embryos, wherein the activity of the gene of interest is silenced using RNA interference.

Disclosed are methods of screening for maternal plants that produce seeds comprising parthenogenically-derived clonal embryos comprising a) obtaining a maternal plant unable to pass on paternally-derived chromosomes to embryos, wherein an activity of a gene of interest in a RNA dependent DNA methylation pathway is silenced in the plant; b) harvesting the seeds; and c) determining whether the seeds comprise clonal embryos, wherein the presence of seeds comprising clonal embryos indicates the maternal plant may produce parthenogenically-derived clonal embryos, wherein the gene of interest is any of the polynucleotides included in Table 1 and the sequences in the accompanying sequence listing, AGO4, AGO6, AGO8, AGO9, CMT3, DCL3, DRM2, EXS1, IDN2, MET1, NPRD1a, NPRD1b, NPRD2, NRPE1, NRPE2, RDR2, RDR6, SGS3, SUVH2, and SUVH9.

Methods of Increasing Yield of Clonal Seeds

Disclosed are methods of increasing the yield of seeds comprising parthenogenically-derived clonal embryos comprising a) obtaining a maternal plant unable to pass on paternally-derived chromosomes to embryos, wherein an activity of a gene of interest in a RNA dependent DNA methylation pathway is silenced in the plant; b) pollinating the maternal plant; c) collecting seeds produced by the maternal plant; d) sorting the seeds comprising parthenogenically-derived clonal embryos from seeds comprising non-clonal embryos.

Sorting seeds comprising parthenogenically-derived clonal embryos from seeds comprising non-clonal embryos may be based on phenotype or genotype. Sorting based on phenotype comprises determining the size, shape, color, or a combination thereof, of the seeds. Sorting may be performed manually or automatically. Automatic sorting may comprise a machine comprising an optical detector. In some instances, sorting may be done visually Disclosed are methods of increasing the yield of seeds comprising parthenogenically-derived clonal embryos comprising a) obtaining a maternal plant unable to pass on paternally-derived chromosomes to embryos, wherein an activity of a gene of interest in a RNA dependent DNA methylation pathway is silenced in the plant; b) pollinating the maternal plant; c) collecting seeds produced by the maternal plant; d) sorting the seeds comprising parthenogenically-derived clonal embryos from seeds comprising non-clonal embryos, wherein the RNA dependent DNA methylation pathway gene is any of the polynucleotides included in Table 1 and the sequences in the accompanying sequence listing, AGO4, AGO6, AGO8, AGO9, CMT3, DCL3, DRM2, EXS1, IDN2, MET1, NPRD1a, NPRD1b, NPRD2, NRPE1, NRPE2, RDR2, RDR6, SGS3, SUVH2, and SUVH9.

C. Constructs

Disclosed are constructs comprising a nucleic acid sequence. The nucleic acid sequence may render the maternal plant defective for RNA-dependent DNA methylation. The nucleic acid sequence may silence activity of a RNA-dependent DNA methylation pathway gene. The nucleic acid sequence may be exogenous to plant sequences.

Disclosed are construct comprising a nucleic acid sequence that renders the maternal plant defective for RNA-dependent DNA methylation, and wherein the maternal plant produces seeds comprising parthenogenically-derived clonal embryos.

Disclosed are constructs comprising a nucleic acid sequence that renders the maternal plant defective for RNA-dependent DNA methylation, wherein the RNA dependent DNA methylation pathway gene is any of the polynucleotides included in Table 1 and sequences in the accompanying sequence listing, AGO4), AGO6, AGO8, AGO9, CMT3, DCL3, DRM2, EXS1, IDN2, MET1, NPRD1a, NPRD1b, NPRD2, NRPE1, NRPE2, RDR2, RDR6, SGS3, SUVH2, and SUVH9.

The constructs may comprise a vector backbone of any known vector used to deliver nucleic acids to plants. For example the constructs may be plasmids or nanoparticles. Methods for producing transgenic plants are well known to those skilled in the art. Transgenic plants can be produced by a variety of different transformation methods including, but not limited to, microinjection; electroporation; microprojectile bombardment, also known as particle acceleration or biolistic bombardment; viral mediated transformation or *Agrobacterium*-mediated transformation (see for example U.S. Pat. Nos. 5,405,765; 5,472,869; 5,538,877; 5,538,880; 5,550,318; 5,641,664; 5,736,369; Watson et al. Recombinant DNA, Scientific American Books 1992). An example of a commonly used plasmid is pBIN19 (Lee and Gelvin, 2008; Plant Physiology 146:235-332). pBIN19 carries two antibiotic resistance genes, one on the plasmid with a bacterial promoter to allow for selection of bacteria that have the plasmid. A second one is included within the T-DNA region driven by a plant promoter to allow for selection of transformed plant cells. Other examples of commonly used plasmids include pBI101 (Genebank Accession AAC53706) and pBI121 Genebank Accession AF485783), pMDC100 (TAIR Accession 1009003749), and pFGC5941 (Genebank Accession AY310901).

Plant transformation may be accomplished by several methods. DNA may be introduced in single cells and thereafter regenerated into complete plants by tissue culture. Other transformation methods may only be applied to protoplasts (cells from which the walls have been removed). Particle bombardment and the natural vector *Agrobacterium tumefaciens* may be used as they rely on whole plant tissues such as roots and leaves, which are easier to handle and require less of the lengthy steps that are required for plant regeneration. In some species, *Agrobacterium* transformation may also be used by infiltrating or dipping intact flower buds. Several techniques for direct DNA delivery may be used, such as but not limited to, uptake of DNA into isolated protoplasts mediated by chemical procedures, electroporation, and injection and the use of high-velocity particles to introduce DNA into intact tissues. Direct DNA uptake is applicable to both stable and transient gene expression studies and relies on a range of vectors, including those employed for gene cloning. Although the frequency of stable transformation may be low, direct DNA uptake is applicable to those plants not amenable to *Agrobacterium* transformation, particularly monocotyledons. Bacteria and plant tissues are cultured together to allow transfer of foreign DNA into plant cells then transformed plants are regenerated on selection media. Any number of different organs and tissues can serve as targets from *Agrobacterium* mediated transformation as described specifically for members of the Brassicaceae. These include thin cell layers (Charest, P. J., et al, 1988, Theor. Appl. Genet. 75:438-444), hypocotyls (De-Block, M., et al, 1989, Plant Physiol. 91:694-701), leaf discs (Feldman, K. A., and Marks, M. D., 1986, Plant Sci. 47:63-69), stems (Fry J., et al, 1987, Plant Cell Repts. 6:321-325), cotyledons (Moloney M. M., et al, 1989, Plant Cell Repts. 8:238-242) and embryoids (Neuhaus, G., et al, 1987, Theor. Appl. Genet. 75:30-36), or even whole plants using in vacuum infiltration and floral dip or floral spraying transformation procedures available in *Arabidopsis* and *Medicago* at present but likely applicable to other plants in the hear future. It is understood, however, that it may be desirable in some crops to choose a different tissue or method of transformation.

Other methods that have been employed for introducing recombinant molecules into plant cells involve mechanical means such as direct DNA uptake, liposomes, electroporation (Guerche, P. et al, 1987, Plant Science 52:111-116) and micro-injection (Neuhaus, G., et al, 1987, Theor. Appl. Genet. 75:30-36). The possibility of using microprojectiles and a gun or other device to force small metal particles coated with DNA into cells has also received considerable attention (Klein, T. M. et al., 1987, Nature 327:70-73).

It is often desirable to have the DNA sequence in homozygous state which may require more than one transformation event to create a parental line, requiring transformation with a first and second recombinant DNA molecule both of which encode the same gene product. It is further contemplated in some of the embodiments of the process of the invention that a plant cell be transformed with a recombinant DNA molecule containing at least two DNA sequences or be transformed with more than one recombinant DNA molecule. The DNA sequences or recombinant DNA molecules in such embodiments may be physically linked, by being in the same vector, or physically separate on different vectors. A cell may be simultaneously transformed with more than one vector provided that each vector has a unique selection marker gene. Alternatively, a cell may be transformed with more than one vector sequentially allowing an intermediate regeneration step after transformation with the first vector.

Further, it may be possible to perform a sexual cross between individual plants or plant lines containing different DNA sequences or recombinant DNA molecules preferably the DNA sequences or the recombinant molecules are linked or located on the same chromosome, and then selecting from the progeny of the cross, plants containing both DNA sequences or recombinant DNA molecules.

Expression of recombinant DNA molecules containing the DNA sequences and promoters described herein in transformed plant cells may be monitored using Northern blot techniques and/or Southern blot techniques or PCR-based methods known to those of skill in the art.

A large number of plants have been shown capable of regeneration from transformed individual cells to obtain transgenic whole plants. For example, regeneration has been shown for dicots as follows: apple, *Malus pumila* (James et al., Plant Cell Reports (1989) 7:658); blackberry, *Rubus*, Blackberry/raspberry hybrid, *Rubus*, red raspberry, *Rubus* (Graham et al., Plant Cell, Tissue and Organ Culture (1990) 20:35); carrot, *Daucus carota* (Thomas et al., Plant Cell Reports (1989) 8:354; Wurtele and Bulka, Plant Science (1989) 61:253); cauliflower, *Brassica oleracea* (Srivastava et al., Plant Cell Reports (1988) 7:504); celery, *Apium graveolens* (Catlin et al., Plant Cell Reports (1988) 7:100); cucumber, *Cucumis sativus* (Trulson et al., Theor. Appl. Genet. (1986) 73:11); eggplant, *Solanum melonoena* (Guri and Sink, J. Plant Physiol. (1988) 133:52) lettuce, *Lactuca sativa* (Michelmore et al., Plant Cell Reports (1987) 6:439); potato, *Solanum tuberosum* (Sheerman and Bevan, Plant Cell Reports (1988) 7:13); rape, *Brassica napus* (Radke et al., Theor. Appl. Genet. (1988) 75:685; Moloney et al., Plant Cell Reports (1989) 8:238); soybean (wild), *Glycine canescens* (Rech et al., Plant Cell Reports (1989) 8:33); strawberry, *Fragaria x ananassa* (Nehra et al., Plant Cell Reports (1990) 9:10; tomato, *Lycopersicon esculentum* (McCormick et al., Plant Cell Reports (1986) 5:81); walnut, *Juglans regia* (McGranahan et al., Plant Cell Reports (1990) 8:512); melon, *Cucumis melo* (Fang et al., 86th Annual Meeting of the American Society for Horticultural Science Hort. Science (1989) 24:89); grape, *Vitis vinifera* (Colby et al., Symposium on Plant Gene Transfer, UCLA Symposia on Molecular and Cellular Biology J Cell Biochem Suppl (1989) 13D:255; mango, *Mangifera indica* (Mathews, et al., symposium on Plant Gene Transfer, UCLA Symposia on Molecular and Cellular Biology J Cell Biochem Suppl (1989) 13D:264); and for the following monocots: rice, *Oryza sativa* (Shimamoto et al., Nature (1989) 338:274); rye, *Secale cereale* (de la Pena et al., Nature (1987) 325: 274); maize, (Rhodes et al., Science (1988) 240:204).

Examples of vectors are pFGC5941 (Accession AY310901), pRS300 (Accession Addgene plasmid 22846; Schwab et al Plant Cell. 2006 May 18(5): 1121-33.) pHELLSGATE (Accession AJ311874), and pMDC32 (Accession FJ172534.1) listed in Table 1 as SEQ ID NOS: 106-109.

D. Maternal Plants

Disclosed are maternal plants comprising any of the constructs described herein.

Disclosed are maternal plants comprising a construct, wherein the construct comprises a nucleic acid sequence that renders the maternal plant defective for RNA-dependent DNA methylation, and wherein the maternal plant produces seeds comprising parthenogenically-derived clonal embryos Disclosed are maternal plants comprising a construct, wherein the construct comprises a nucleic acid sequence that renders the maternal plant defective for RNA-dependent DNA methylation, wherein the RNA dependent DNA methylation pathway gene is AGO4), AGO6, AGO8, AGO9, CMT3, DCL3, DRM2, EXS1, IDN2, MET1, NPRD1a, NPRD1b, NPRD2, NRPE1, NRPE2, RDR2, RDR6, SGS3, SUVH2, and SUVH9.

Disclosed are maternal plants comprising a construct, wherein the construct comprises an exogenous nucleic acid sequence, wherein the construct renders the maternal plant defective for RNA-dependent DNA methylation. The exogenous nucleic acid sequence may silence activity of a RNA-dependent DNA methylation pathway gene.

Disclosed are maternal plants comprising a construct, wherein the construct comprises an exogenous nucleic acid sequence, wherein the construct renders the maternal plant defective for RNA-dependent DNA methylation, wherein the maternal plant further comprises a clonal seed.

Also disclosed are maternal plants comprising a defective RNA-dependent DNA methylation pathway gene. RNA dependent DNA methylation pathway genes that may be defective may be, but are not limited to, AGO4, AGO6, AGO8, AGO9, CMT3, DCL3, DRM2, EXS1, IDN2, MET1, NPRD1a, NPRD1b, NPRD2, NRPE1, NRPE2, RDR2, RDR6, SGS3, SUVH2, and SUVH9.

Disclosed are maternal plants for production of seeds comprising clonal embryos, the maternal plant being defective for RNA-dependent DNA methylation and, when pollinated, producing seeds comprising sexually-generated embryos and seeds comprising clonal embryos that are each a clone of the maternal plant, the clonal embryos being optically distinguishable from the sexually-generated embryos.

Disclosed are maternal plants for production of clonal seeds, the maternal plant being defective for RNA-dependent DNA methylation and, when pollinated, producing seeds that form sexually-generated progeny plants and clonal progeny plants, with each clonal progeny plant being a clone of the maternal plant, the sexually-generated progeny plants being optically distinguishable from the sexually-generated progeny plants.

Disclosed are maternal plants for production of clonal seeds, the maternal plant being defective for RNA-dependent DNA methylation and unable to form viable pollen.

Disclosed are maternal plants for production of clonal seeds, the maternal plant being defective for RNA-dependent DNA methylation and treated to prevent formation of viable pollen.

E. Seeds

Disclosed are seeds comprising a parthenogenically-derived clonal embryo comprising a defective RNA-dependent DNA methylation pathway gene.

Disclosed are seeds comprising a parthenogenically-derived clonal embryo comprising a defective RNA-dependent DNA methylation pathway gene, wherein the seed, when grown, produces seeds comprising clonal embryos. Disclosed are seeds comprising a parthenogenically-derived clonal embryo comprising a defective RNA-dependent DNA methylation pathway gene.

Disclosed are seeds comprising a parthenogenically-derived clonal embryo comprising a defective RNA-dependent DNA methylation pathway gene, wherein the RNA dependent DNA methylation pathway gene is any of the polynucleotides included in Table 1 and sequences in the accompanying sequence listing, AGO4), AGO6, AGO8, AGO9, CMT3, DCL3, DRM2, EXS1, IDN2, MET1, NPRD1a, NPRD1b, NPRD2, NRPE1, NRPE2, RDR2, RDR6, SGS3, SUVH2, and SUVH9.

Provided herein are methods of increasing the number of seeds comprising parthenogenically-derived clonal embryos in a plant that is defective RdDM activity. In one aspect, the plant having defective RdDM activity is subjected to an abiotic stress. Abiotic stresses include environmental conditions that include but are not limited to low or high temperatures such as chilling, cold, freezing, heat shock, heat stress; light, including but not limited to low or high light; water deficit or drought, flooding or anoxia; chemicals and soil conditions, such as high or low levels or salt or salinity, acid, minerals, such as mineral deficiency or mineral toxicity or combinations thereof. In one aspect the plant defective in RdDM activity is grown under conditions or subjected to at least one abiotic stress. The seeds comprising parthenogenically-derived clonal embryos produced in are increased compared to the number of seeds formed in a control plant. In some examples, the formation of seeds parthenogenically-derived clonal embryos is increased by 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, 65%, 70%, 75%, 80%, 85%, 90%, 95%, 99%, or 100% as compared to seeds produced by a control plant, for example, the control plant is disrupted in RdDM activity and not subjected to grown under conditions of or subjected to the abiotic stress.

In addition, the plant defective in RdDM acivity may be male-sterile. Methods for making the plant male-sterile are known to one skilled in the art and described elsewhere herein.

In another aspect, the plant defective for activity in the RdDM pathway is not pollinated or exposed to pollination.

Alternatively or in addition to subjecting the plant defective in RdDM activity to an abiotic stress, the plant may be pollinated after anthesis to increase the number of seeds comprising parthenogenically-derived clonal embryos. The plant may be pollinated 1 or more days after anthesis, including but not limited to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 days after anthesis. The plant may be pollinated mechanically, manually, or naturally via insects or wind. In some examples, the formation of seeds parthenogenically-derived clonal embryos is increased by 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, 65%, 70%, 75%, 80%, 85%, 90%, 95%, 99%, or 100% as compared to seeds produced by a control plant, for example, the control plant is defective for RdDM activity and pollinated prior to anthesis.

Alternatively or in addition to subjecting the plant defective in RdDM activity to an abiotic stress, the plant may be pollinated with "prickle" pollen to increase the formation of seeds comprising parthenogenically-derived clonal embryos. As used herein, the term "prickle pollen" refers to pollen from another species. In some examples, the formation of seeds comprising parthenogenically-derived clonal embryos is increased by 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, 65%, 70%, 75%, 80%, 85%, 90%, 95%, 99%, or 100% as compared to seeds produced by a control plant, for example, the control plant is defective for RdDM activity and pollinated with pollen from the same species.

Therefore, provided herein are methods to increase the number of seeds comprising parthenogenically-derived clonal embryos by pollinating the plant defective in RdDM activity with pollen from a plant of a different order, family, genus, species, or subspecies. In some examples, the pollen is from but not limited to *Zea mays* L. subspecies, Teosinte, *Zea diploperennis, Zea luxurians, Zea nicaraguensis, Zea perennis*, subspecies *Zea mays* subsp *mays, Zea mays* subsp *huehuetenangensis, Zea mays* subsp *mexicana*, or *Zea mays* subsp *parviglumis*. In some examples, the plant defective for RdDM activity is from but not limited to *Zea mays* L. subspecies, *Teosinte, Zea diploperennis, Zea luxurians, Zea nicaraguensis, Zea perennis*, subspecies *Zea mays* subsp *mays, Zea mays* subsp *huehuetenangensis, Zea mays* subsp *mexicana*, or *Zea mays* subsp *parviglumis*. In one example, a maize, a *Zea mays* L. subspecies mays plant defective for RdDM activity, the *Zea mays* L. subspecies mays plant may be pollinated with pollen including but not limited to pollen from Teosinte, *Zea diploperennis, Zea luxurians, Zea nicaraguensis, Zea perennis*, subspecies *Zea mays* subsp mays, *Zea mays* subsp *huehuetenangensis, Zea mays* subsp *mexicana*, or *Zea mays* subsp *parviglumis*.

In some examples, the plant is from but not limited to soybean (*Glycine max*), *Glycine albicans, Glycine aphyonota, Glycine arenaria, Glycine argyrea, Glycine canescens, Glycine clandestine, Glycine curvata, Glycine cyrtoloba, Glycine falcata, Glycine gracei, Glycine hirticaulis, G. hirticaulis* subsp. *Leptosa, Glycine lactovirens, Glycine latifolia, Glycine latrobeana, Glycine microphylla, Glycine montis-douglas, Glycine peratosa, Glycine pescadrensis, Glycine pindanica, Glycine pullenii, Glycine rubiginosa, Glycine stenophita, Glycine syndetika, Glycine tabacina, Glycine tomentella, Hayata*, or *Glycine soja*. In some examples, the pollen is from but not limited to soybean (*Glycine max*), *Glycine albicans, Glycine aphyonota, Glycine arenaria, Glycine argyrea, Glycine canescens, Glycine clandestine, Glycine curvata, Glycine cyrtoloba, Glycine falcata, Glycine gracei, Glycine hirticaulis, G. hirticaulis* subsp. *Leptosa, Glycine lactovirens, Glycine latifolia, Glycine latrobeana, Glycine microphylla, Glycine montis-douglas, Glycine peratosa, Glycine pescadrensis, Glycine pindanica, Glycine pullenii, Glycine rubiginosa, Glycine stenophita, Glycine syndetika, Glycine tabacina, Glycine tomentella, Hayata*, or *Glycine soja*. In another example, a soybean (*Glycine max*) plant defective for RdDM activity may be pollinated with pollen from including but not limited to *Glycine albicans, Glycine aphyonota, Glycine arenaria, Glycine argyrea, Glycine canescens, Glycine clandestine, Glycine curvata, Glycine cyrtoloba, Glycine falcata, Glycine gracei, Glycine hirticaulis, G. hirticaulis* subsp. *Leptosa, Glycine lactovirens, Glycine latifolia, Glycine latrobeana, Glycine microphylla, Glycine montis-douglas, Glycine peratosa, Glycine pescadrensis, Glycine pindanica, Glycine pullenii, Glycine rubiginosa, Glycine stenophita, Glycine syndetika, Glycine tabacina, Glycine tomentella, Hayata*, or *Glycine soja*.

In one example, the pollen is from but not limited to a *Sorghum bicolor* plant, also known as cultivated sorghum, sorghum durra, jowari or milo, *Sorghum almum, Sorghum amplum, Sorghum angustum, Sorghum arundinaceum, Sorghum bicolor* subsp. *Drummondii* (Sudan grass) *Sorghum brachypodum, Sorghum bulbosum, Sorghum burmahicum, Sorghum ecarinatum, Sorghum exstans, Sorghum grande*, Johnson grass (*Sorghum halepense*), *Sorghum interjectum, Sorghum intrans, Sorghum laxiflorum, Sorghum leiocladum, Sorghum macrospermum, Sorghum matarankense, Sorghum nitidum, Sorghum plumosum, Sorghum propinquum, Sorghum purpureosericeum, Sorghum stipoideum, Sorghum timorense, Sorghum trichocladum, Sorghum versicolor, Sor-*

*ghum verticiliflorum*, or *Sorghum vulgare* var. *technicum*. In one example, the plant defective for RdDM activity is from but not limited to a *Sorghum bicolor* plant, also known as cultivated sorghum, sorghum durra, jowari or milo, *Sorghum almum, Sorghum amplum, Sorghum angustum, Sorghum arundinaceum, Sorghum bicolor* subsp. *Drummondii* (Sudan grass) *Sorghum brachypodum, Sorghum bulbosum, Sorghum burmahicum, Sorghum ecarinatum, Sorghum exstans, Sorghum grande*, Johnson grass (*Sorghum halepense*), *Sorghum interjectum, Sorghum intrans, Sorghum laxiflorum, Sorghum leiocladum, Sorghum macrospermum, Sorghum matarankense, Sorghum nitidum, Sorghum plumosum, Sorghum propinquum, Sorghum purpureosericeum, Sorghum stipoideum, Sorghum timorense, Sorghum trichocladum, Sorghum versicolor, Sorghum verticiliflorum*, or *Sorghum vulgare* var. *technicum*. In one example, a *Sorghum bicolor* plant, also known as cultivated sorghum, sorghum durra, jowari or milo, defective for RdDM activity may be pollinated with pollen from including but not limited to *Sorghum almum, Sorghum amplum, Sorghum angustum, Sorghum arundinaceum, Sorghum bicolor* subsp. *Drummondii* (Sudan grass) *Sorghum brachypodum, Sorghum bulbosum, Sorghum burmahicum, Sorghum ecarinatum, Sorghum exstans, Sorghum grande*, Johnson grass (*Sorghum halepense*), *Sorghum interjectum, Sorghum intrans, Sorghum laxiflorum, Sorghum leiocladum, Sorghum macrospermum, Sorghum matarankense, Sorghum nitidum, Sorghum plumosum, Sorghum propinquum, Sorghum purpureosericeum, Sorghum stipoideum, Sorghum timorense, Sorghum trichocladum, Sorghum versicolor, Sorghum verticiliflorum*, or *Sorghum vulgare* var. *technicum*.

In one example, the pollen is from but not limited to Common wheat or Bread wheat ("*T. aestivum*"), Spelt ("*T. spelta*") also known as "*Triticum aestivum*" subsp. "*spelta*"; Durum ("*T. durum*"), Emmer ("*T. dicoccon*"), Einkorn ("*T. monococcum*"), Durum, Hard Red Spring, Hard Red Winter, Soft Red Winter, Hard White, Soft White, or Red wheat. In one example, the plant defective for RdDM activity is from but not limited to Common wheat or Bread wheat ("*T. aestivum*"); Spelt ("*T. spelta*") also known as "*Triticum aestivum*" subsp. "*spelta*"; Durum ("*T. durum*"), Emmer ("*T. dicoccon*"), Einkorn ("*T. monococcum*"), Durum, Hard Red Spring, Hard Red Winter, Soft Red Winter, Hard White, Soft White, or Red wheat. In another example, Common wheat or Bread wheat ("*T. aestivum*") plant defective for RdDM activity may be pollinated with pollen from including but not limited to Spelt ("*T. spelta*") also known as "*Triticum aestivum*" subsp. "*spelta*", Durum ("*T. durum*"), Emmer ("*T. dicoccon*"), Einkorn ("*T. monococcum*"), Durum, Hard Red Spring, Hard Red Winter, Soft Red Winter, Hard White, Soft White, or Red wheat.

In one example, the prickle pollen is from but not limited to *Arabidopsis thaliana, Arabidopsis arenicola, Arabidopsis arenosa, A. arenosa* subsp. *Arenosa, A. arenosa* subsp. *Borbasii, Arabidopsis cebennensis, Arabidopsis croatica, Arabidopsis halleri, A. halleri* subsp. *Halleri, A. halleri* subsp. *Ovirensis, A. halleri* subsp. *Gemmifera, Arabidopsis lyrata, A. lyrata* subsp. *Lyrata, lyrata* subsp. *Petraea, A. lyrata* subsp. *Kamchatica, Arabidopsis neglecta, Arabidopsis pedemontana*, or *Arabidopsis suecica*, or *Boechera holboellii*. In one example, the plant defective for RdDM activity is from but not limited to *Arabidopsis thaliana, Arabidopsis arenicola, Arabidopsis arenosa, A. arenosa* subsp. *Arenosa, A. arenosa* subsp. *Borbasii, Arabidopsis cebennensis, Arabidopsis croatica, Arabidopsis halleri, A. halleri* subsp. *Halleri, A. halleri* subsp. *Ovirensis, A. halleri* subsp. *Gemmifera, Arabidopsis lyrata, A. lyrata* subsp.

*Lyrata, lyrata* subsp. *Petraea, A. lyrata* subsp. *Kamchatica, Arabidopsis neglecta, Arabidopsis pedemontana*, or *Arabidopsis suecica*, or *Boechera holboellii*. In another example, an *Arabidopsis thaliana* plant defective for RdDM activity may be pollinated with pollen from including but not limited to, *Arabidopsis arenicola, Arabidopsis arenosa, A. arenosa* subsp. *Arenosa, A. arenosa* subsp. *Borbasii, Arabidopsis cebennensis, Arabidopsis croatica, Arabidopsis halleri, A. halleri* subsp. *Halleri, A. halleri* subsp. *Ovirensis, A. halleri* subsp. *Gemmifera, Arabidopsis lyrata, A. lyrata* subsp. *Lyrata, lyrata* subsp. *Petraea, A. lyrata* subsp. *Kamchatica, Arabidopsis neglecta, Arabidopsis pedemontana*, or *Arabidopsis suecica*, or *Boechera holboellii*.

In one example, the prickle pollen is from but not limited to *Oryza sativa, Oryza glaberrima, Oryza sativa, Oryza barthii, Oryza glaberrima, Oryza meridionalis, Oryza nivara, Oryza rufipogon, Oryza punctata, Oryza latifolia, Oryza alta, Oryza grandiglumis, Oryza eichingeri, Oryza officinalis, Oryza rhisomatis, Oryza minuta, Oryza australiensis, Oryza granulata, Oryza meyeriana*, or *Oryza brachyantha*. In one example, the plant defective for RdDM activity is from but not limited to *Oryza sativa, Oryza glaberrima, Oryza sativa, Oryza barthii, Oryza glaberrima, Oryza meridionalis, Oryza nivara, Oryza rufipogon, Oryza punctata, Oryza latifolia, Oryza alta, Oryza grandiglumis, Oryza eichingeri, Oryza officinalis, Oryza rhisomatis, Oryza minuta, Oryza australiensis, Oryza granulata, Oryza meyeriana*, or *Oryza brachyantha*. In another example, an *Oryza sativa* plant defective for RdDM activity may be pollinated with pollen from including but not limited to, *Oryza glaberrima, Oryza sativa, Oryza barthii, Oryza glaberrima, Oryza meridionalis, Oryza nivara, Oryza rufipogon, Oryza punctata, Oryza latifolia, Oryza alta, Oryza grandiglumis, Oryza eichingeri, Oryza officinalis, Oryza rhisomatis, Oryza minuta, Oryza australiensis, Oryza granulata, Oryza meyeriana*, or *Oryza brachyantha*.

In one example, the prickle pollen is from but not limited to *Brassica balearica, Brassica carinata, Brassica elongate, Brassica fruticulosa, Brassica hilarionis, Brassica juncea, Brassica napus, Brassica narinosa, Brassica nigra, Brassica oleracea, Brassica perviridis, Brassica rapa, Brassica rupestris, Brassica septiceps*, or *Brassica tournefortii*. In one example, the plant defective for RdDM activity is from but not limited to *Brassica balearica, Brassica carinata, Brassica elongate, Brassica fruticulosa, Brassica hilarionis, Brassica juncea, Brassica napus, Brassica narinosa, Brassica nigra, Brassica oleracea, Brassica perviridis, Brassica rapa, Brassica rupestris, Brassica septiceps*, or *Brassica tournefortii*. In another example, an *Brassica napus* plant defective for RdDM activity may be pollinated with pollen from including but not limited to, *Brassica balearica, Brassica carinata, Brassica elongate, Brassica fruticulosa, Brassica hilarionis, Brassica juncea, Brassica napus, Brassica narinosa, Brassica nigra, Brassica oleracea, Brassica perviridis, Brassica rapa, Brassica rupestris, Brassica septiceps*, or *Brassica tournefortii*.

The plant defective for RdDM activity may be pollinated with prickle pollen 1 or more days after anthesis, including but not limited to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 days after anthesis. The plant may be pollinated mechanically, manually, or naturally via insects or wind. In some examples, the formation of seeds parthenogenically-derived clonal embryos is increased by 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, 65%, 70%, 75%, 80%, 85%, 90%, 95%, 99%, or 100% as compared to seeds produced by a control plant, for example, the control plant is defective for RdDM activity and pollinated with pollen from the same species. In one aspect, the seeds are screened, for example, to select or sort for those seeds comprising parthenogenically-derived, clonal embryos. The seeds may be identified, selected and/or sorted using any suitable technique. In some examples, the sorting is manual, semi-automated, or automated. In some examples, the seeds are identified, selected and/or sorted based on genotype or phenotype. In some aspects, the seeds comprising parthenogenically-derived clonal embryos are identified, selected and/or sorted based on the absence of a paternal-inherited trait or marker. In some embodiments, paternally provided visual markers may be utilized to score or sort for the absence of the paternally inherited marker. Alternatively or in addition, the seeds may be genotyped using sequencing, restriction-fragment-length polymorphisms (RFLPs), amplified fragment-length polymorphisms (AFLPs), simple sequence repeats (SSRs), single feature polymorphisms (SFPs), single nucleotide polymorphisms (SNPs) and insertion/deletion polymorphisms (Indels) and/or phenotypic markers. Alternatively or in addition, the number of seeds that comprise arthenogenic, clonal embryos may be determined and ascertained for viability.

Provided herein are methods and compositions for enriching for asexual embryos and endosperm in a seed. In one aspect, the seed is from a plant defective for RdDM activity and has an element that disrupts sexual zygote function or development, thereby enriching asexual embryos. In one aspect, altered levels of expression of the element in the sexual zygote precursor cells or sexual zygote results in disruption of the sexual zygote formation or development, including but not limited to the ablation of the sexual zygote In other embodiments, the element may encode a protein capable of causing cell ablation. As used herein, the term "cell ablation" refers to targeted damage of a specific cell. In some embodiments, cell ablation results in the death of the cell or damage to the cell such that the cell no longer divides or differentiates. Proteins capable of causing cell ablation include cytotoxins such as barnase (Yoshida, (2001) Methods Enzymol 341:28-41), Dam Methylase (see, Barras, (1989) Trends in Genetics 5:139-143), ADP ribosylase (see, Fan, (2000) Curr. Opin. Struct. Biol., 10:680-686), nucleases, or any other protein or nucleic acid capable of cell ablation. Exemplary elements include but are not limited to cytotoxic polypeptides such as Barnase (a portmanteau of "BActerial" "RiboNucleASE"), Dam Methylase, ADP ribosylase, RNases, nucleases, methylases, membrane pore forming proteins, apoptosis inducing proteins, and ADP-Ribosyltransferase toxins including but not limited to, PT toxins, C2 toxins, *C. difficile* transferase, iota toxin, *C. spiroforme* toxin, DT toxin, LT1, LT2, Tox A and CT toxin and active variants and fragments thereof that retain cytotoxic activity in the cells in which they are expressed. The element may be any DNA, RNA, protein or mutation that when expressed or repressed may disrupt sexual zygote formation or development, Approaches for repressing expression of the element include RNAi's, that target genes that are required for sexual zygote development may be employed. Approaches and techniques for to silence or suppress genes and expression cassettes are provided elsewhere herein.

In this manner, genetically modified plants, plant cells, plant tissue, seed, root and the like may be obtained. Additional methods and compositions to ablate sexual zygotes, include, for example, an zygote-lethal mutation that is crossed into the plant.

The element may be expressed using one or more cell-type-specific promoters disclosed herein. Any promoter of interest may be operably linked to the sequence encoding the element, so long as the promoter directs expression in a cell of the sexual zygote or sexual zygote precursor cell. Such promoters include, for example, a egg cell or zygote-preferred promoter, including but not limited to DD45, RKD1, or RKD2 (see, for example, patent applicaton publication # US 2013/0180009 A1, published Jul. 11, 2013) Such egg cell or zygote-preferred promoters will not be active in the central cell or the endosperm and thereby these tissues are preserved when the egg cell or zygote-preferred promoter is operably linked to the sequence encoding the element.

In one aspect, the expression or repression of the element may be regulated chemically, for example, through chemical induction, chemical repression or chemical de-repression. The chemical may be provide by any suitable means, including but not limited to foliar application, root drench application, pre-emergence application, or post-emergence application. In another aspect, the element is regulated by a chemical, molecular or gene switch. Exemplary switches include but are not limited to a sulfonylurea-regulated gene switch. The switch may include a repressor that is operably linked to a promoter active in the sexual zygote wherein the promoter is a constitutive promoter, a tissue-preferred promoter, a developmental stage-preferred promoter, an inducible promoter, or a repressible promoter. In other examples, the expression of the element is regulated by a transactivator system, such as Gal4-UAS (upstream activation sequence).

Inteins

Compositions and methods relating to the use of split-intein toxins to ablate embryos or sexual zygotes in plants defective for RdDM activity are provided. Proteins encoded by the heterologous polynucleotides of interest disclosed herein, e.g. barnase, may be assembled by intein-mediated trans-splicing. See, for example, Gils, (2008) Plant Biotech. Journal 6:226-235 and Kempe, (2009) Plant Biotech. Journal 7:283-297, herein incorporated by reference in their entirety. For example, expressed DAM methylase or barnase fragments may be assembled by intein-mediated trans-splicing. The intein-fused DAM methylase or barnase fragments, or polynucleotides encoding the fragments, may be located in different parental plants and may be under control of different developmentally regulated or cell type-preferred promoters. In one example, a female gamete, embryo or zygote-specific promoter is operably linked to a nucleic acid encoding a split-intein toxin where a male gamete-specific promoter is operably linked to a nucleic acid encoding the other half of the split-intein toxin (cognate split intein toxin). The split-intein is brought together upon male- and female-gamete fusion to form an active cytotoxic product as the result of intein-mediated trans-splicing. In other examples, different promoters with different yet partially overlapping expression patterns may be used to confine the split-intein toxin activity to the required tissue, for example, embryo or sexual zygote. Any promoter that expresses the split intein toxin in egg cell, zygote or embryo tissues and other cells may be used so long as the split-intein toxin is not expressed in the central cell or sperm cell. Exemplary promoters include egg-cell specific promoters, DD45, RKD1 and RKD2. In another aspect, the cognate split intein toxin may be expressed in other cells or tissues so long as it is not expressed in the egg cell. Exemplary promoters include sperm-cell specific promoters, MGH3, MSP, EBC, LBC and MPG (Borg et al. Plant Cell 2011; 23:534-5490).

Further provided are methods of selectively ablating an embryo or fertilized zygote using intein-split toxins by pollinating a first plant comprising a construct having a female gamete-specific promoter operably linked to a nucleic acid encoding a split-intein toxin with pollen that includes a male gamete-specific promoter operably linked to a nucleic acid encoding a split-intein toxin. Upon fertilization the split-intein toxins are trans-spliced into an active toxin in the embryo or fertilized zygote and subsequently ablated. In another aspect, the embryo or fertilized zygote is selectively ablated by crossing two plants that contain split-intein toxins that are trans-spliced into an active toxin in the fertilized zygote or embryo. In one aspect, one plant has a construct with a female gamete-specific promoter operably linked to a nucleic acid encoding a split-intein toxin and the other plant has a male gamete-specific promoter operably linked to a nucleic acid encoding the cognate split-intein toxin. In some examples, the plants with the female-gamete specific promter-split intein ablation construct is male-sterile. In one aspect, the non-fertilized zygotes or embryos are viable. In some aspects, the non-fertilized zygotes or embryos are independently repressed. The intein-split toxins may be independently activated.

Disclosed are fertilization independent embryos and fertilization independent seed.

Provided herein are methods and compositions for enriching for asexual embryos and endosperm in a seed comprising parthenogenically-derived clonal embryos in an asexual female gametophyte of a plant that has defective RdDM activity. Alternatively or in addition, the plant is defective in an activity that regulates endosperm development. In one aspect, the plant's endosperm development is disrupted so that autonomous endosperm development is induced in the plant. Autonomous endosperm development may be induced by disrupting the activity of a protein or expression of a gene involved in endosperm formation. In particular embodiments, this is achieved through genetic introduction of mutations known in the literature to lead to autonomous endosperm formation in *Arabidopsis* (Ohad N, Margossian L, Hsu Y-c, Williams C, Repetti P, Fischer RL (1996). Mutations that cause endosperm development in the absence of fertilization belong to the FERTILIZATION-INDEPENDENT SEED (FIS) complex, showing similarities to the Polycomb repressive complex 2 (PrC2) from mammals that mediate histone methylation. The FIS complex comprises at least four subunits in *Arabidopsis*: the SET domain protein MEDEA (MEA; also known as FERTILIZATION-INDEPENDENT SEED 1 (FIS1)), the zinc-finger transcription factor FERTILIZATION-INDEPENDENT SEED 2 (FIS2), the WD40-repeat protein FERTILIZATION-INDEPENDENT ENDOSPERM (FIE), and the WD40-repeat protein MULTICOPY SUPPRESSOR OF IRA 1 (MSI1) (Ohad et al. 1996; Chaudhury et al. 1997; Grossniklaus et al. 1998; Kiyosue et al. 1999; Kohler et al. 2003). A mutation that allows endosperm development without fertilization. Proceedings of the National Academy of Sciences 93:5319-5324; Chaudhury A M, Ming L, Miller C, Craig S, Dennis E S, Peacock W J (1997) Fertilization-independent seed development in *Arabidopsis thaliana*. Proceedings of the National Academy of Sciences 94:4223-4228; Luo M, Bilodeau P, Koltunow A, Dennis E S, Peacock W J, Chaudhury A M (1999) Genes controlling fertilization-independent seed development in *Arabidopsis thaliana*. Proceedings of the National Academy of Sciences 96:296-301; Ohad N, Yadegari R, Margossian L, Hannon M, Michaeli D, Harada J J, Goldberg R B, Fischer R L (1999) Mutations in FIE, a WD polycomb group gene, allow endosperm development without fertilization. Plant Cell 11:407-416; Kiyosue T, Ohad N, Yadegari R, Hannon M, Dinneny J, Wells D, Katz A, Margossian L, Harada J J, Goldberg R B, Fischer R L (1999) Control of fertilization-independent endosperm development by the MEDEA polycomb gene in *Arabidopsis*. Proc Natl Acad Sci USA 96:4186-4191). SWINGER (SWN), is a SET-domain that partners with FIS2 that when interrupted also causes autonomous endosperm formation (Dongfang et al, PNAS 2006). Other genes that when interrupted cause autonomous endosperm development include the cell cycle regulator CYCLIN DEPENDENT KINASE A;1, a yeast cdc2a/CDC28 homolog that allows a genetic dissection of seed development (Iwakawa et al. 2006; Nowack et al. 2006). cdka;1 mutant pollen contains only a single haploid gamete that exclusively fertilizes the egg cell, leaving an unfertilized central cell that undergoes autonomous nuclear divisions. Mutations in MULTIPLE SUPPRESSOR OF IRA1 (MSI1) also cause the autonomous formation of endosperm (Ingouff et al., 2006); mutations in CUL4-DDB1 complex interact with MSI1 and also cause the same phenotype (Dumbliauskas E, et al. 2011. EMBO J); mutations in SIRENE (srn) affect male-female gametophyte interactions during pollen tube reception and develop autonomous endosperm (Rotman, N, et al. 2008. Mol Plant).

Exemplary genes or proteins that effect endosperm development include but are not limited to those in the Polycomb repressive complex 2 (PrC2) complex, CYCLIN DEPENDENT KINASE A, cdka, or MULTIPLE SUPPRESSOR OF IRA1 (MSI1) CUL4-DDB1, Fertilization Independent Embryo (FIE), Fertilization Independent Seed-1 (FIS1), Fertilization Independent Seed-1(FIS2), or Fertilization Independent Seed-3 (FIS3). In some embodiments, when combined with RdDM pathway disruption, ovules with endosperm development, developing seeds, seeds comprising viable clonal embryos, total seed number, and/or viable seed number will increase. In some examples, the sexual female gametophyte of a plant defective for RdDM activity is fertilized with pollen from a plant disrupted in an activity that regulates endosperm development, Exemplary genes or proteins include but are not limited to those in the Polycomb repressive complex 2 (PrC2) complex, CYCLIN DEPENDENT KINASE A, cdka, or MULTIPLE SUPPRESSOR OF IRA1 (MSI1) CUL4-DDB1, Fertilization Independent Embryo (FIE), Fertilization Independent Seed-1 (FIS1), Fertilization Independent Seed-1(FIS2), or Fertilization Independent Seed-3 (FIS3). Seeds obtained from this cross may be germinated and grown giving rise to adults plants that when allowed to self-pollinate produce modulated RdDM plants that are homozygous for genes or proteins disrupted in an activity that regulates endosperm development.

F. Plant Transformation Methods

Numerous methods for introducing foreign genes into plants are known and may be used to insert a polynucleotide into a plant host, including biological and physical plant transformation protocols. See, e.g., Miki et al., "Procedure for Introducing Foreign DNA into Plants," in *Methods in Plant Molecular Biology and Biotechnology*, Glick and Thompson, eds., CRC Press, Inc., Boca Raton, pp. 67-88 (1993). The methods chosen vary with the host plant and include chemical transfection methods such as calcium phosphate, microorganism-mediated gene transfer such as *Agrobacterium* (Horsch, et al., (1985) *Science* 227:1229-31), electroporation, micro-injection and biolistic bombardment.

Expression cassettes and vectors and in vitro culture methods for plant cell or tissue transformation and regeneration of plants are known and available. See, e.g., Gruber, et al., "Vectors for Plant Transformation," in *Methods in Plant Molecular Biology and Biotechnology*, supra, pp. 89-119.

The isolated polynucleotides or polypeptides may be introduced into the plant by one or more techniques typically used for direct delivery into cells. Such protocols may vary depending on the type of organism, cell, plant or plant cell, i.e., monocot or dicot, targeted for gene modification. Suitable methods of transforming plant cells include microinjection (Crossway, et al., (1986) *Biotechniques* 4:320-334 and U.S. Pat. No. 6,300,543), electroporation (Riggs, et al., (1986) *Proc. Natl. Acad. Sci. USA* 83:5602-5606, direct gene transfer (Paszkowski et al., (1984) *EMBO J.* 3:2717-2722) and ballistic particle acceleration (see, for example, Sanford, et al., U.S. Pat. No. 4,945,050; WO 1991/10725 and McCabe, et al., (1988) *Biotechnology* 6:923-926). Also see, Tomes, et al., "Direct DNA Transfer into Intact Plant Cells Via Microprojectile Bombardment". pp. 197-213 in *Plant Cell, Tissue and Organ Culture, Fundamental Methods*. eds. Gamborg and Phillips. Springer-Verlag Berlin Heidelberg New York, 1995; U.S. Pat. No. 5,736,369 (meristem); Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); WO 1991/10725 (maize); Klein, et al., (1988) *Plant Physiol.* 91:440-444 (maize); Fromm, et al., (1990) *Biotechnology* 8:833-839 and Gordon-Kamm, et al., (1990) *Plant Cell* 2:603-618 (maize); Hooydaas-Van Slogteren and Hooykaas, (1984) *Nature* (London) 311:763-764; Bytebierm, et al., (1987) *Proc. Natl. Acad. Sci. USA* 84:5345-5349 (Liliaceae); De Wet, et al., (1985) *In The Experimental Manipulation of Ovule Tissues*, ed. G. P. Chapman, et al., pp. 197-209. Longman, NY (pollen); Kaeppler, et al., (1990) *Plant Cell Reports* 9:415-418 and Kaeppler, et al., (1992) *Theor. Appl. Genet.* 84:560-566 (whisker-mediated transformation); U.S. Pat. No. 5,693,512 (sonication); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotech.* 14:745-750; *Agrobacterium* mediated maize transformation (U.S. Pat. No. 5,981,840); silicon carbide whisker methods (Frame, et al., (1994) *Plant J.* 6:941-948); laser methods (Guo, et al., (1995) *Physiologia Plantarum* 93:19-24); sonication methods (Bao, et al., (1997) *Ultrasound in Medicine & Biology* 23:953-959; Finer and Finer, (2000) *Lett Appl Microbiol.* 30:406-10; Amoah, et al., (2001) *J Exp Bot* 52:1135-42); polyethylene glycol methods (Krens, et al., (1982) *Nature* 296:72-77); protoplasts of monocot and dicot cells may be transformed using electroporation (Fromm, et al., (1985) *Proc. Natl. Acad. Sci. USA* 82:5824-5828) and microinjection (Crossway, et al., (1986) *Mol. Gen. Genet.* 202:179-185), all of which are herein incorporated by reference.

*Agrobacterium*-Mediated Transformation

*A. tumefaciens* and *A. rhizogenes* are plant pathogenic soil bacteria, which genetically transform plant cells. The Ti and Ri plasmids of *A. tumefaciens* and *A. rhizogenes*, respectively, carry genes responsible for genetic transformation of plants. See, e.g., Kado, (1991) *Crit. Rev. Plant Sci.* 10:1. Descriptions of the *Agrobacterium* vector systems and methods for *Agrobacterium*-mediated gene transfer are provided in Gruber, et al., supra; Miki, et al., supra and Moloney, et al., (1989) *Plant Cell Reports* 8:238.

Once constructed, plasmids may be placed into *A. rhizogenes* or *A. tumefaciens* and these vectors used to transform cells of plant species, which are ordinarily susceptible to *Fusarium* or *Alternaria* infection. Several other transgenic plants are also contemplated by the present disclosure including but not limited to soybean, corn, sorghum, alfalfa, rice, clover, cabbage, banana, coffee, celery, tobacco, cowpea, cotton, melon and pepper. The selection of either *A. tumefaciens* or *A. rhizogenes* will depend on the plant being transformed thereby. In general *A. tumefaciens* is the preferred organism for transformation. Most dicotyledonous plants, some gymnosperms and a few monocotyledonous plants (e.g., certain members of the Liliales and Arales) are susceptible to infection with *A. tumefaciens. A. rhizogenes* also has a wide host range, embracing most dicots and some gymnosperms, which includes members of the Leguminosae, Compositae, and Chenopodiaceae. Monocot plants may now be transformed with some success. EP Patent Application Number 604 662 A1 discloses a method for transforming monocots using *Agrobacterium*. EP Patent Application Number 672 752 A1 discloses a method for transforming monocots with *Agrobacterium* using the scutellum of immature embryos. Ishida, et al., discuss a method for transforming maize by exposing immature embryos to *A. tumefaciens* (*Nature Biotechnology* 14:745-50 (1996)).

Once transformed, these cells may be used to regenerate transgenic plants. For example, whole plants may be infected with these vectors by wounding the plant and then introducing the vector into the wound site. Any part of the plant may be wounded, including leaves, stems and roots. Alternatively, plant tissue, in the form of an explant, such as cotyledonary tissue or leaf disks, may be inoculated with these vectors, and cultured under conditions, which promote plant regeneration. Roots or shoots transformed by inoculation of plant tissue with *A. rhizogenes* or *A. tumefaciens*, containing the gene coding for the fumonisin degradation enzyme, may be used as a source of plant tissue to regenerate fumonisin-resistant transgenic plants, either via somatic embryogenesis or organogenesis. Examples of such methods for regenerating plant tissue are disclosed in Shahin, (1985) *Theor. Appl. Genet.* 69:235-40; U.S. Pat. No. 4,658,082; Simpson, et al., supra and U.S. patent application Ser. Nos. 913,913 and 913,914, both filed Oct. 1, 1986, as referenced in U.S. Pat. No. 5,262,306, issued Nov. 16, 1993, the entire disclosures therein incorporated herein by reference.

Direct Gene Transfer

Several methods of plant transformation, collectively referred to as direct gene transfer, have been developed as an alternative to *Agrobacterium*-mediated transformation.

A generally applicable method of plant transformation is microprojectile-mediated transformation, where DNA is carried on the surface of microprojectiles measuring about 1 to 4 m. The expression vector is introduced into plant tissues with a biolistic device that accelerates the microprojectiles to speeds of 300 to 600 m/s which is sufficient to penetrate the plant cell walls and membranes (Sanford, et al., (1987) *Part. Sci. Technol.* 5:27; Sanford, (1988) *Trends Biotech* 6:299; Sanford, (1990) *Physiol. Plant* 79:206 and Klein, et al., (1992) *Biotechnology* 10:268).

Another method for physical delivery of DNA to plants is sonication of target cells as described in Zang, et al., (1991) *BioTechnology* 9:996. Alternatively, liposome or spheroplast fusions have been used to introduce expression vectors into plants. See, e.g., Deshayes, et al., (1985) *EMBO J.* 4:2731 and Christou, et al., (1987) *Proc. Natl. Acad. Sci. USA* 84:3962. Direct uptake of DNA into protoplasts using $CaCl_2$ precipitation, polyvinyl alcohol, or poly-L-ornithine has also been reported. See, e.g., Hain, et al., (1985) *Mol. Gen. Genet.* 199:161 and Draper, et al., (1982) *Plant Cell Physiol.* 23:451.

G. Reducing the Activity and/or Level of a Polypeptide

Methods are provided to reduce or eliminate the activity of a polypeptide, for example, a polypeptide that has RdDM activity, or a polypeptide that induces endosperm development, by transforming a plant cell with an expression cassette that expresses a polynucleotide that inhibits the expression of the polypeptide. The polynucleotide may inhibit the expression of the polypeptide directly, by preventing transcription or translation of the messenger RNA, or indirectly, by encoding a polypeptide that inhibits the transcription or translation of a gene encoding polypeptide. Methods for inhibiting or eliminating the expression of a gene in a plant are well known in the art and any such method may be used in the present disclosure to inhibit the expression of polypeptide.

In accordance with the present disclosure, the expression of polypeptide is inhibited if the protein level of the polypeptide is less than 70% of the protein level of the same polypeptide in a plant that has not been genetically modified or mutagenized to inhibit the expression of that polypeptide. In particular embodiments of the disclosure, the protein level of the polypeptide in a modified plant according to the disclosure is less than 60%, less than 50%, less than 40%, less than 30%, less than 20%, less than 10%, less than 5% or less than 2% of the protein level of the same polypeptide in a plant that is not a mutant or that has not been genetically modified to inhibit the expression of that polypeptide. The expression level of the polypeptide may be measured directly, for example, by assaying for the level of polypeptide expressed in the plant cell or plant, or indirectly, for example, by measuring the RNA-dependent DNA methylation activity of the polypeptide in the plant cell or plant or by measuring the phenotypic changes in the plant, for example, endosperm development. Methods for performing such assays are described elsewhere herein.

In other embodiments of the disclosure, the activity of the polypeptides is reduced or eliminated by transforming a plant cell with an expression cassette comprising a polynucleotide encoding a polypeptide that inhibits the activity of a polypeptide. In some examples, RdDM activity or endosperm development activity is reduced or eliminated. The RdDM activity of a polypeptide is inhibited according to the present disclosure if the activity of the polypeptide is less than 70% of the activity of the same polypeptide in a plant that has not been modified to inhibit the activity of that polypeptide. In particular embodiments of the disclosure, the activity of the polypeptide in a modified plant according to the disclosure is less than 60%, less than 50%, less than 40%, less than 30%, less than 20%, less than 10% or less than 5% of the activity of the same polypeptide in a plant that that has not been modified to inhibit the expression of that polypeptide. The activity of a polypeptide is "eliminated" according to the disclosure when it is not detectable by the assay methods described elsewhere herein. Methods of determining the alteration of RdDM activity of a polypeptide are described elsewhere herein.

In other embodiments, the activity of a polypeptide may be reduced or eliminated by disrupting the gene encoding the polypeptide. The disclosure encompasses mutagenized plants that carry mutations in genes, where the mutations reduce expression of the gene or inhibit the RdDM activity of the encoded polypeptide. Thus, many methods may be used to reduce or eliminate the activity of a polypeptide. In addition, more than one method may be used to reduce the activity of a single polypeptide.

1. Polynucleotide-Based Methods:

In some embodiments of the present disclosure, a plant is transformed with an expression cassette that is capable of expressing a polynucleotide that inhibits the expression of a polypeptide of the disclosure. The term "expression" as used herein refers to the biosynthesis of a gene product, including the transcription and/or translation of said gene product. For example, for the purposes of the present disclosure, an expression cassette capable of expressing a polynucleotide that inhibits the expression of at least one polypeptide is an expression cassette capable of producing an RNA molecule that inhibits the transcription and/or translation of at least one polypeptide of the disclosure. The "expression" or "production" of a protein or polypeptide from a DNA molecule refers to the transcription and translation of the coding sequence to produce the protein or polypeptide, while the "expression" or "production" of a protein or polypeptide from an RNA molecule refers to the translation of the RNA coding sequence to produce the protein or polypeptide.

Examples of polynucleotides that inhibit the expression of a polypeptide are given below.

i. Sense Suppression/Cosuppression

In some embodiments of the disclosure, inhibition of the expression of a polypeptide may be obtained by sense suppression or cosuppression. For cosuppression, an expression cassette is designed to express an RNA molecule corresponding to all or part of a messenger RNA encoding a polypeptide in the "sense" orientation. Over expression of the RNA molecule may result in reduced expression of the native gene. Accordingly, multiple plant lines transformed with the cosuppression expression cassette are screened to identify those that show the desired degree of inhibition of polypeptide expression.

The polynucleotide used for cosuppression may correspond to all or part of the sequence encoding the polypeptide, all or part of the 5' and/or 3' untranslated region of a polypeptide transcript or all or part of both the coding sequence and the untranslated regions of a transcript encoding a polypeptide. In some embodiments where the polynucleotide comprises all or part of the coding region for the polypeptide, the expression cassette is designed to eliminate the start codon of the polynucleotide so that no protein product will be translated.

Cosuppression may be used to inhibit the expression of plant genes to produce plants having undetectable protein levels for the proteins encoded by these genes. See, for example, Broin, et al., (2002) Plant Cell 14:1417-1432. Cosuppression may also be used to inhibit the expression of multiple proteins in the same plant. See, for example, U.S. Pat. No. 5,942,657. Methods for using cosuppression to inhibit the expression of endogenous genes in plants are described in Flavell, et al., (1994) Proc. Natl. Acad. Sci. USA 91:3490-3496; Jorgensen, et al., (1996) Plant Mol. Biol. 31:957-973; Johansen and Carrington, (2001) Plant Physiol. 126:930-938; Broin, et al., (2002) Plant Cell 14:1417-1432; Stoutjesdijk, et al., (2002) Plant Physiol. 129:1723-1731; Yu, et al., (2003) Phytochemistry 63:753-763 and U.S. Pat. Nos. 5,034,323, 5,283,184 and 5,942,657, each of which is herein incorporated by reference. The efficiency of cosuppression may be increased by including a poly-dT region in the expression cassette at a position 3' to the sense sequence and 5' of the polyadenylation signal. See, US Patent Application Publication Number 2002/0048814, herein incorporated by reference. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity. See U.S. Pat. Nos. 5,283,184 and 5,034,323, herein incorporated by reference.

ii. Antisense Suppression

In some embodiments of the disclosure, inhibition of the expression of the polypeptide may be obtained by antisense suppression. For antisense suppression, the expression cassette is designed to express an RNA molecule complementary to all or part of a messenger RNA encoding the polypeptide. Over expression of the antisense RNA molecule may result in reduced expression of the target gene. Accordingly, multiple plant lines transformed with the antisense suppression expression cassette are screened to identify those that show the desired degree of inhibition of polypeptide expression.

The polynucleotide for use in antisense suppression may correspond to all or part of the complement of the sequence encoding the polypeptide, all or part of the complement of the 5' and/or 3' untranslated region of the target transcript or all or part of the complement of both the coding sequence and the untranslated regions of a transcript encoding the polypeptide. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. See, for example, U.S. Pat. No. 5,942,657. Furthermore, portions of the antisense nucleotides may be used to disrupt the expression of the target gene. Generally, sequences of at least 50 nucleotides, 100 nucleotides, 200 nucleotides, 300, 400, 450, 500, 550 or greater may be used. Methods for using antisense suppression to inhibit the expression of endogenous genes in plants are described, for example, in Liu, et al., (2002) Plant Physiol. 129:1732-1743 and U.S. Pat. Nos. 5,759,829 and 5,942,657, each of which is herein incorporated by reference. Efficiency of antisense suppression may be increased by including a poly-dT region in the expression cassette at a position 3' to the antisense sequence and 5' of the polyadenylation signal. See, US Patent Application Publication Number 2002/0048814, herein incorporated by reference.

iii. Double-Stranded RNA Interference

In some embodiments of the disclosure, inhibition of the expression of a polypeptide may be obtained by double-stranded RNA (dsRNA) interference. For dsRNA interference, a sense RNA molecule like that described above for cosuppression and an antisense RNA molecule that is fully or partially complementary to the sense RNA molecule are expressed in the same cell, resulting in inhibition of the expression of the corresponding endogenous messenger RNA.

Expression of the sense and antisense molecules may be accomplished by designing the expression cassette to comprise both a sense sequence and an antisense sequence. Alternatively, separate expression cassettes may be used for the sense and antisense sequences. Multiple plant lines transformed with the dsRNA interference expression cassette or expression cassettes are then screened to identify plant lines that show the desired degree of inhibition of polypeptide expression. Methods for using dsRNA interference to inhibit the expression of endogenous plant genes are described in Waterhouse, et al., (1998) *Proc. Natl. Acad. Sci. USA* 95:13959-13964, Liu, et al., (2002) *Plant Physiol.* 129:1732-1743 and WO 1999/49029, WO 1999/53050, WO 1999/61631 and WO 2000/49035, each of which is herein incorporated by reference.

iv. Hairpin RNA Interference and Intron-Containing Hairpin RNA Interference

In some embodiments of the disclosure, inhibition of the expression of a polypeptide may be obtained by hairpin RNA (hpRNA) interference or intron-containing hairpin RNA (ihpRNA) interference. These methods are highly efficient at inhibiting the expression of endogenous genes. See, Waterhouse and Helliwell, (2003) *Nat. Rev. Genet.* 4:29-38 and the references cited therein.

For hpRNA interference, the expression cassette is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited, and an antisense sequence that is fully or partially complementary to the sense sequence. Alternatively, the base-paired stem region may correspond to a portion of a promoter sequence controlling expression of the gene whose expression is to be inhibited. Thus, the base-paired stem region of the molecule generally determines the specificity of the RNA interference. hpRNA molecules are highly efficient at inhibiting the expression of endogenous genes and the RNA interference they induce is inherited by subsequent generations of plants. See, for example, Chuang and Meyerowitz, (2000) *Proc. Natl. Acad. Sci. USA* 97:4985-4990; Stoutjesdijk, et al., (2002) *Plant Physiol.* 129:1723-1731 and Waterhouse and Helliwell, (2003) *Nat. Rev. Genet.* 4:29-38. Methods for using hpRNA interference to inhibit or silence the expression of genes are described, for example, in Chuang and Meyerowitz, (2000) *Proc. Natl. Acad. Sci. USA* 97:4985-4990; Stoutjesdijk, et al., (2002) *Plant Physiol.* 129:1723-1731; Waterhouse and Helliwell, (2003) *Nat. Rev. Genet.* 4:29-38; Pandolfini et al., *BMC Biotechnology* 3:7 and US Patent Application Publication Number 2003/0175965, each of which is herein incorporated by reference. A transient assay for the efficiency of hpRNA constructs to silence gene expression in vivo has been described by Panstruga, et al., (2003) *Mol. Biol. Rep.* 30:135-140, herein incorporated by reference.

For ihpRNA, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) *Nature* 407:319-320. In fact, Smith, et al., show 100% suppression of endogenous gene expression using ihpRNA-mediated interference. Methods for using ihpRNA interference to inhibit the expression of endogenous plant genes are described, for example, in Smith, et al., (2000) *Nature* 407:319-320; Wesley, et al., (2001) *Plant J.* 27:581-590; Wang and Waterhouse, (2001) *Curr. Opin. Plant Biol.* 5:146-150; Waterhouse and Helliwell, (2003) *Nat. Rev. Genet.* 4:29-38; Helliwell and Waterhouse, (2003) *Methods* 30:289-295 and US Patent Application Publication Number 2003/0180945, each of which is herein incorporated by reference.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 2002/00904; Mette, et al., (2000) *EMBO J* 19:5194-5201; Matzke, et al., (2001) *Curr. Opin. Genet. Devel.* 11:221-227; Scheid, et al., (2002) *Proc. Natl. Acad. Sci., USA* 99:13659-13662; Aufsaftz, et al., (2002) *Proc. Nat'l. Acad. Sci.* 99(4):16499-16506; Sijen, et al., *Curr. Biol.* (2001) 11:436-440), herein incorporated by reference.

v. Amplicon-Mediated Interference

Amplicon expression cassettes comprise a plant virus-derived sequence that contains all or part of the target gene but generally not all of the genes of the native virus. The viral sequences present in the transcription product of the expression cassette allow the transcription product to direct its own replication. The transcripts produced by the amplicon may be either sense or antisense relative to the target sequence (i.e., the messenger RNA for the polypeptide). Methods of using amplicons to inhibit the expression of endogenous plant genes are described, for example, in Angell and Baulcombe, (1997) *EMBO J.* 16:3675-3684, Angell and Baulcombe, (1999) *Plant J.* 20:357-362 and U.S. Pat. No. 6,646,805, each of which is herein incorporated by reference.

vi. Ribozymes

In some embodiments, the polynucleotide expressed by the expression cassette of the disclosure is catalytic RNA or has ribozyme activity specific for the messenger RNA of the polypeptide. Thus, the polynucleotide causes the degradation of the endogenous messenger RNA, resulting in reduced expression of the polypeptide. This method is described, for example, in U.S. Pat. No. 4,987,071, herein incorporated by reference.

vii. Small Interfering RNA or Micro RNA

In some embodiments of the disclosure, inhibition of the expression of a polypeptide may be obtained by RNA interference by expression of a gene encoding a micro RNA (miRNA). miRNAs are regulatory agents consisting of about 22 ribonucleotides. miRNA are highly efficient at inhibiting the expression of endogenous genes. See, for example Javier, et al., (2003) *Nature* 425:257-263, herein incorporated by reference.

For miRNA interference, the expression cassette is designed to express an RNA molecule that is modeled on an endogenous miRNA gene. For example, the miRNA gene encodes an RNA that forms a hairpin structure containing a 22-nucleotide sequence that is complementary to another endogenous gene (target sequence). For suppressing the expression of a gene in the RNA-dependent DNA methylation pathway, the 22-nucleotide sequence is selected from a transcript sequence from a gene in the RdDM pathway and contains 22 nucleotides of said gene in the RNA-dependent DNA methylation pathway sequence in sense orientation and 21 nucleotides of a corresponding antisense sequence that is complementary to the sense sequence. In some cases, the expression of a gene in the R in endosperm development activity is suppressed. A fertility gene, whether endogenous or exogenous, may be an miRNA target. miRNA molecules are highly efficient at inhibiting the expression of endogenous genes, and the RNA interference they induce is inherited by subsequent generations of plants.

2. Polypeptide-Based Inhibition of Gene Expression

In one embodiment, the polynucleotide encodes a zinc finger protein that binds to a gene encoding a polypeptide, resulting in reduced expression of the gene. In particular embodiments, the zinc finger protein binds to a regulatory region of a gene in the RdDM pathway. In other embodiments, the zinc finger protein binds to a messenger RNA encoding a polypeptide and prevents its translation. Methods of selecting sites for targeting by zinc finger proteins have been described, for example, in U.S. Pat. No. 6,453,242, and methods for using zinc finger proteins to inhibit the expression of genes in plants are described, for example, in US Patent Application Publication Number 2003/0037355, each of which is herein incorporated by reference.

3. Polypeptide-Based Inhibition of Protein Activity

In some embodiments of the disclosure, the polynucleotide encodes an antibody that binds to at least one polypeptide and reduces the RdDM activity of the polypeptide. In another embodiment, the binding of the antibody results in increased turnover of the antibody-RdDM complex by cellular quality control mechanisms. The expression of antibodies in plant cells and the inhibition of molecular pathways by expression and binding of antibodies to proteins in plant cells are well known in the art. See, for example, Conrad and Sonnewald, (2003) *Nature Biotech.* 21:35-36, incorporated herein by reference.

4. Gene Disruption

In some embodiments of the present disclosure, the activity of a polypeptide is reduced or eliminated by disrupting the gene encoding the polypeptide. The gene encoding the polypeptide may be disrupted by any method known in the art. For example, in one embodiment, the gene is disrupted by transposon tagging. In another embodiment, the gene is disrupted by mutagenizing plants using random or targeted mutagenesis and selecting for plants that have reduced RdDM activity.

i. Transposon Tagging

In one embodiment of the disclosure, transposon tagging is used to reduce or eliminate the activity of one or more polypeptide. Transposon tagging comprises inserting a transposon within an endogenous gene in the RdDM pathway to reduce or eliminate expression of the polypeptide. "RdDM gene" is intended to mean the gene in the RdDM pathway that encodes a polypeptide according to the disclosure.

In this embodiment, the expression of one or more polypeptide is reduced or eliminated by inserting a transposon within a regulatory region or coding region of the gene encoding the polypeptide. A transposon that is within an exon, intron, 5' or 3' untranslated sequence, a promoter or any other regulatory sequence of a RdDM gene may be used to reduce or eliminate the expression and/or activity of the encoded polypeptide.

Methods for the transposon tagging of specific genes in plants are well known in the art. See, for example, Maes, et al., (1999) *Trends Plant Sci.* 4:90-96; Dharmapuri and Sonti, (1999) *FEMS Microbiol. Lett.* 179:53-59; Meissner, et al., (2000) *Plant J.* 22:265-274; Phogat, et al., (2000) *J. Biosci.* 25:57-63; Walbot, (2000) *Curr. Opin. Plant Biol.* 2:103-107; Gai, et al., (2000) *Nucleic Acids Res.* 28:94-96; Fitzmaurice, et al., (1999) *Genetics* 153:1919-1928). In addition, the TUSC process for selecting Mu insertions in selected genes has been described in Bensen, et al., (1995) *Plant Cell* 7:75-84; Mena, et al., (1996) *Science* 274:1537-1540 and U.S. Pat. No. 5,962,764, each of which is herein incorporated by reference.

ii. Mutant Plants with Reduced Activity

Additional methods for decreasing or eliminating the expression of endogenous genes in plants are also known in the art and may be similarly applied to the instant disclosure. These methods include other forms of mutagenesis, such as ethyl methanesulfonate-induced mutagenesis, deletion mutagenesis and fast neutron deletion mutagenesis used in a reverse genetics sense (with PCR) to identify plant lines in which the endogenous gene has been deleted. For examples of these methods see, Ohshima, et al., (1998) *Virology* 243:472-481; Okubara, et al., (1994) *Genetics* 137:867-874 and Quesada, et al., (2000) *Genetics* 154:421-436, each of which is herein incorporated by reference. In addition, a fast and automatable method for screening for chemically induced mutations, TILLING (Targeting Induced Local Lesions In Genomes), using denaturing HPLC or selective endonuclease digestion of selected PCR products is also applicable to the instant disclosure. See, McCallum, et al., (2000) *Nat. Biotechnol.* 18:455-457, herein incorporated by reference.

Mutations may impact gene expression or that interfere with RdDM activity of an encoded protein. Insertional mutations in gene exons usually result in null-mutants. Mutations in conserved residues are particularly effective in inhibiting the activity of the encoded protein. Conserved residues of plant polypeptides suitable for mutagenesis with the goal to eliminate activity have been described. Such mutants may be isolated according to well-known procedures and mutations in different RdDM loci may be stacked by genetic crossing. See, for example, Gruis, et al., (2002) *Plant Cell* 14:2863-2882.

In another embodiment of this disclosure, dominant mutants may be used to trigger RNA silencing due to gene inversion and recombination of a duplicated gene locus. See, for example, Kusaba, et al., (2003) *Plant Cell* 15:1455-1467.

The disclosure encompasses additional methods for reducing or eliminating the activity of one or more polypeptide. Examples of other methods for altering or mutating a genomic nucleotide sequence in a plant are known in the art and include, but are not limited to, the use of RNA:DNA vectors, RNA:DNA mutational vectors, RNA:DNA repair vectors, mixed-duplex oligonucleotides, self-complementary RNA:DNA oligonucleotides and recombinogenic oligonucleobases. Such vectors and methods of use are known in the art. See, for example, U.S. Pat. Nos. 5,565,350; 5,731,181; 5,756,325; 5,760,012; 5,795,972 and 5,871,984, each of which are herein incorporated by reference. See also, WO 1998/49350, WO 1999/07865, WO 1999/25821 and Beetham, et al., (1999) *Proc. Natl. Acad. Sci. USA* 96:8774-8778, each of which is herein incorporated by reference.

H. Genome Editing and Induced Mutagenesis

In general, methods to modify or alter the host endogenous genomic DNA are available. This includes altering the host native DNA sequence or a pre-existing transgenic sequence including regulatory elements, coding and non-coding sequences. These methods are also useful in targeting nucleic acids to pre-engineered target recognition sequences in the genome. As an example, the genetically modified cell or plant described herein, is generated using "custom" meganucleases produced to modify plant genomes (see, e.g., WO 2009/114321; Gao, et al., (2010) *Plant Journal* 1:176-187). Another site-directed engineering is through the use of zinc finger domain recognition coupled with the restriction properties of restriction enzyme. See, e.g., Urnov, et al., (2010) *Nat Rev Genet.* 11(9):636-46; Shukla, et al., (2009) *Nature* 459(7245):437-41.

Also provided herein are methods for making the plant where elements or mutations are introduced into the plant genome by use of CRISPR technology. CRISPR loci (Clustered Regularly Interspaced Short Palindromic Repeats) (also known as SPIDRs—SPacer Interspersed Direct Repeats) constitute a family of recently described DNA loci. CRISPR loci consist of short and highly conserved DNA repeats (typically 24 to 40 bp, repeated from 1 to 140 times—also referred to as CRISPR-repeats) which are partially palindromic. The repeated sequences (usually specific to a species) are interspaced by variable sequences of constant length (typically 20 to 58 by depending on the CRISPR locus (WO2007/025097 published Mar. 1, 2007).

CRISPR loci were first recognized in *E. coli* (Ishino et al. (1987) J. Bacterial. 169:5429-5433; Nakata et al. (1989) J. Bacterial. 171:3553-3556). Similar interspersed short sequence repeats have been identified in *Haloferax mediterranei, Streptococcus pyogenes, Anabaena,* and *Mycobacterium tuberculosis* (Groenen et al. (1993) Mol. Microbiol. 10:1057-1065; Hoe et al. (1999) Emerg. Infect. Dis. 5:254-263; Masepohl et al. (1996) Biochim. Biophys. Acta 1307: 26-30; Mojica et al. (1995) Mol. Microbiol. 17:85-93). The CRISPR loci differ from other SSRs by the structure of the repeats, which have been termed short regularly spaced repeats (SRSRs) (Janssen et al. (2002) OMICS J. Integ. Biol. 6:23-33; Mojica et al. (2000) Mol. Microbiol. 36:244-246). The repeats are short elements that occur in clusters, that are always regularly spaced by variable sequences of constant length (Mojica et al. (2000) Mol. Microbiol. 36:244-246).

Cas gene relates to a gene that is generally coupled, associated or close to or in the vicinity of flanking CRISPR loci. The terms "Cas gene", "CRISPR-associated (Cas) gene" are used interchangeably herein. A comprehensive review of the Cas protein family is presented in Haft et al. (2005) Computational Biology, PLoS Comput Biol 1(6): e60. doi:10.1371/journal.pcbi.0010060. As described therein, 41 CRISPR-associated (Cas) gene families are described, in addition to the four previously known gene families. It shows that CRISPR systems belong to different classes, with different repeat patterns, sets of genes, and species ranges. The number of Cas genes at a given CRISPR locus may vary between species.

Cas endonuclease relates to a Cas protein encoded by a Cas gene, wherein said Cas protein is capable of introducing a double strand break into a DNA target sequence. The Cas endonuclease is guided by a guide polynucleotide to recognize and optionally introduce a double strand break at a specific target site into the genome of a cell (U.S. Provisional Application No. 62/023,239, filed Jul. 11, 2014). The guide polynucleotide/Cas endonuclease system includes a complex of a Cas endonuclease and a guide polynucleotide that is capable of introducing a double strand break into a DNA target sequence. The Cas endonuclease unwinds the DNA duplex in close proximity of the genomic target site and cleaves both DNA strands upon recognition of a target sequence by a guide RNA if a correct protospacer-adjacent motif (PAM) is approximately oriented at the 3' end of the target sequence.

The Cas endonuclease gene may be Cas9 endonuclease, or a functional fragment thereof, such as but not limited to, Cas9 genes listed in SEQ ID NOs: 462, 474, 489, 494, 499, 505, and 518 of WO2007/025097 published Mar. 1, 2007. The Cas endonuclease gene may be a plant, maize or soybean optimized Cas9 endonuclease, such as but not limited to a plant codon optimized *Streptococcus pyogenes* Cas9 gene that may recognize any genomic sequence of the form N(12-30)NGG. The Cas endonuclease may be introduced directly into a cell by any method known in the art, for example, but not limited to transient introduction methods, transfection and/or topical application.

As used herein, the term "guide RNA" relates to a synthetic fusion of two RNA molecules, a crRNA (CRISPR RNA) comprising a variable targeting domain, and a tracrRNA. In one embodiment, the guide RNA comprises a variable targeting domain of 12 to 30 nucleotide sequences and a RNA fragment that may interact with a Cas endonuclease.

As used herein, the term "guide polynucleotide", relates to a polynucleotide sequence that may form a complex with a Cas endonuclease and enables the Cas endonuclease to recognize and optionally cleave a DNA target site (U.S. Provisional Application No. 62/023,239, filed Jul. 11, 2014). The guide polynucleotide may be a single molecule or a double molecule. The guide polynucleotide sequence may be a RNA sequence, a DNA sequence, or a combination thereof (a RNA-DNA combination sequence). Optionally, the guide polynucleotide may comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotride that solely comprises ribonucleic acids is also referred to as a "guide RNA".

The guide polynucleotide may be a double molecule (also referred to as duplex guide polynucleotide) comprising a first nucleotide sequence domain (referred to as Variable Targeting domain or VT domain) that is complementary to a nucleotide sequence in a target DNA and a second nucleotide sequence domain (referred to as Cas endonuclease recognition domain or CER domain) that interacts with a Cas endonuclease polypeptide. The CER domain of the double molecule guide polynucleotide comprises two separate molecules that are hybridized along a region of complementarity. The two separate molecules may be RNA, DNA, and/or RNA-DNA-combination sequences. In some embodiments, the first molecule of the duplex guide polynucleotide comprising a VT domain linked to a CER domain is referred to as "crDNA" (when composed of a contiguous stretch of DNA nucleotides) or "crRNA" (when composed of a contiguous stretch of RNA nucleotides), or "crDNA-RNA" (when composed of a combination of DNA and RNA nucleotides). The crNucleotide may comprise a fragment of the cRNA naturally occurring in Bacteria and Archaea. In one embodiment, the size of the fragment of the cRNA naturally occurring in Bacteria and Archaea that is present in a crNucleotide disclosed herein may range from, but is not limited to, 2, 3, 4, 5, 6, 7, 8, 9, 10, 11, 12, 13, 14, 15, 16, 17, 18, 19, 20 or more nucleotides. In some embodiments the second molecule of the duplex guide polynucleotide comprising a CER domain is referred to as "tracrRNA" (when composed of a contiguous stretch of RNA nucleotides) or "tracrDNA" (when composed of a contiguous stretch of DNA nucleotides) or "tracrDNA-RNA" (when composed of a combination of DNA and RNA nucleotides In one embodiment, the RNA that guides the RNA/Cas9 endonuclease complex, is a duplexed RNA comprising a duplex crRNA-tracrRNA.

The guide polynucleotide may also be a single molecule comprising a first nucleotide sequence domain (referred to as Variable Targeting domain or VT domain) that is complementary to a nucleotide sequence in a target DNA and a second nucleotide domain (referred to as Cas endonuclease recognition domain or CER domain) that interacts with a Cas endonuclease polypeptide. By "domain" it is meant a contiguous stretch of nucleotides that may be RNA, DNA, and/or RNA-DNA-combination sequence. The VT domain and/or the CER domain of a single guide polynucleotide may comprise a RNA sequence, a DNA sequence, or a RNA-DNA-combination sequence. In some embodiments the single guide polynucleotide comprises a crNucleotide (comprising a VT domain linked to a CER domain) linked to a tracrNucleotide (comprising a CER domain), wherein the linkage is a nucleotide sequence comprising a RNA sequence, a DNA sequence, or a RNA-DNA combination sequence. The single guide polynucleotide being comprised of sequences from the crNucleotide and tracrNucleotide may be referred to as "single guide RNA" (when composed of a contiguous stretch of RNA nucleotides) or "single guide DNA" (when composed of a contiguous stretch of DNA nucleotides) or "single guide RNA-DNA" (when composed of a combination of RNA and DNA nucleotides). In one embodiment of the disclosure, the single guide RNA comprises a cRNA or cRNA fragment and a tracrRNA or tracrRNA fragment of the type II CRISPR/Cas system that may form a complex with a type II Cas endonuclease, wherein said guide RNA/Cas endonuclease complex may direct the Cas endonuclease to a plant genomic target site, enabling the Cas endonuclease to introduce a double strand break into the genomic target site. One aspect of using a single guide polynucleotide versus a duplex guide polynucleotide is that only one expression cassette needs to be made to express the single guide polynucleotide.

The term "variable targeting domain" or "VT domain" is used interchangeably herein and includes a nucleotide sequence that is complementary to one strand (nucleotide sequence) of a double strand DNA target site. The % complementation between the first nucleotide sequence domain (VT domain) and the target sequence may be at least 50%, 51%, 52%, 53%, 54%, 55%, 56%, 57%, 58%, 59%, 60%, 61%, 62%, 63%, 63%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. The variable target domain may be at least 12, 13, 14, 15, 16, 17, 18, 19, 20, 21, 22, 23, 24, 25, 26, 27, 28, 29 or 30 nucleotides in length. In some embodiments, the variable targeting domain comprises a contiguous stretch of 12 to 30 nucleotides. The variable targeting domain may be composed of a DNA sequence, a RNA sequence, a modified DNA sequence, a modified RNA sequence, or any combination thereof.

The term "Cas endonuclease recognition domain" or "CER domain" of a guide polynucleotide is used interchangeably herein and includes a nucleotide sequence (such as a second nucleotide sequence domain of a guide polynucleotide), that interacts with a Cas endonuclease polypeptide. The CER domain may be composed of a DNA sequence, a RNA sequence, a modified DNA sequence, a modified RNA sequence (see for example modifications described herein), or any combination thereof.

The nucleotide sequence linking the crNucleotide and the tracrNucleotide of a single guide polynucleotide may comprise a RNA sequence, a DNA sequence, or a RNA-DNA combination sequence. In one embodiment, the nucleotide sequence linking the crNucleotide and the tracrNucleotide of a single guide polynucleotide may be at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 78, 79, 80, 81, 82, 83, 84, 85, 86, 87, 88, 89, 90, 91, 92, 93, 94, 95, 96, 97, 98, 99 or 100 nucleotides in length. In another embodiment, the nucleotide sequence linking the crNucleotide and the tracrNucleotide of a single guide polynucleotide may comprise a tetraloop sequence, such as, but not limiting to a GAAA tetraloop seqence.

Nucleotide sequence modification of the guide polynucleotide, VT domain and/or CER domain may be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications may result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

"TILLING" or "Targeting Induced Local Lesions IN Genomics" refers to a mutagenesis technology useful to generate and/or identify and to eventually isolate mutagenised variants of a particular nucleic acid with modulated expression and/or activity (McCallum, et al., (2000), *Plant Physiology* 123:439-442; McCallum, et al., (2000) *Nature Biotechnology* 18:455-457 and Colbert, et al., (2001) *Plant Physiology* 126:480-484). Methods for TILLING are well known in the art (U.S. Pat. No. 8,071,840).

Other mutagenic methods may also be employed to introduce mutations in the RdDM and/or autonomous endosperm formation genes. Methods for introducing genetic mutations into plant genes and selecting plants with desired traits are well known. For instance, seeds or other plant material may be treated with a mutagenic chemical substance, according to standard techniques. Such chemical substances include, but are not limited to, the following: diethyl sulfate, ethylene imine, and N-nitroso-N-ethylurea. Alternatively, ionizing radiation from sources such as X-rays or gamma rays may be used.

I. Regulatory Elements

Exemplary constitutive promoters include the 35S cauliflower mosaic virus (CaMV) promoter promoter (Odell, et al., (1985) *Nature* 313:810-812), the maize ubiquitin promoter (Christensen, et al., (1989) *Plant Mol. Biol.* 12:619-632 and Christensen, et al., (1992) *Plant Mol. Biol.* 18:675-689); the core promoter of the Rsyn7 promoter and other constitutive promoters disclosed in WO 1999/43838 and U.S. Pat. No. 6,072,050; rice actin (McElroy, et al., (1990)

Plant Cell 2:163-171); pEMU (Last, et al., (1991) Theor. Appl. Genet. 81:581-588); MAS (Velten, et al., (1984) EMBO J. 3:2723-2730); ALS promoter (U.S. Pat. No. 5,659, 026); rice actin promoter (U.S. Pat. No. 5,641,876; WO 2000/70067), maize histone promoter (Brignon, et al., (1993) Plant Mol Bio 22(6):1007-1015; Rasco-Gaunt, et al., (2003) Plant Cell Rep. 21(6):569-576) and the like. Other constitutive promoters include, for example, those described in U.S. Pat. Nos. 5,608,144 and 6,177,611 and PCT Publication Number WO 2003/102198.

Tissue-specific, tissue-preferred or stage-specific regulatory elements further include, for example, the AGL8/FRUITFULL regulatory element, which is activated upon floral induction (Hempel, et al., (1997) Development 124:3845-3853); root-specific regulatory elements such as the regulatory elements from the RCP 1 gene and the LRP 1 gene (Tsugeki and Fedoroff, (1999) Proc. Natl. Acad., USA 96:12941-12946; Smith and Fedoroff, (1995) Plant Cell 7:735-745); flower-specific regulatory elements such as the regulatory elements from the LEAFY gene and the APETALA1 gene (Blazquez, et al., (1997) Development 124:3835-3844; Hempel, et al., supra, 1997); seed-specific regulatory elements such as the regulatory element from the oleosin gene (Plant, et al., (1994) Plant Mol. Biol. 25:193-205) and dehiscence zone specific regulatory element. Additional tissue-specific or stage-specific regulatory elements include the Znl3 promoter, which is a pollen-specific promoter (Hamilton, et al., (1992) Plant Mol. Biol. 18:211-218); the UNUSUAL FLORAL ORGANS (UFO) promoter, which is active in apical shoot meristem; the promoter active in shoot meristems (Atanassova, et al., (1992) Plant J. 2:291), the cdc2 promoter and cyc07 promoter (see, for example, Ito, et al., (1994) Plant Mol. Biol. 24:863-878; Martinez, et al., (1992) Proc. Natl. Acad. Sci., USA 89:7360); the meristematic-preferred meri-5 and H3 promoters (Medford, et al., (1991) Plant Cell 3:359; Terada, et al., (1993) Plant J. 3:241); meristematic and phloem-preferred promoters of Myb-related genes in barley (Wissenbach, et al., (1993) Plant J. 4:411); Arabidopsis cyc3aAt and cyc1At (Shaul, et al., (1996) Proc. Natl. Acad. Sci. 93:4868-4872); C. roseus cyclins CYS and CYM (Ito, et al., (1997) Plant J. 11:983-992); and Nicotiana CyclinB1 (Trehin, et al., (1997) Plant Mol. Biol. 35:667-672); the promoter of the APETALA3 gene, which is active in floral meristems (Jack, et al., (1994) Cell 76:703; Hempel, et al., supra, 1997); a promoter of an agamous-like (AGL) family member, for example, AGL8, which is active in shoot meristem upon the transition to flowering (Hempel, et al., supra, 1997); floral abscission zone promoters; L-specific promoters; the ripening-enhanced tomato polygalacturonase promoter (Nicholass, et al., (1995) Plant Mol. Biol. 28:423-435), the E8 promoter (Deikman, et al., (1992) Plant Physiol. 100:2013-2017) and the fruit-specific 2A1 promoter, U2 and U5 snRNA promoters from maize, the Z4 promoter from a gene encoding the Z4 22 kD zein protein, the Z10 promoter from a gene encoding a 10 kD zein protein, a Z27 promoter from a gene encoding a 27 kD zein protein, the A20 promoter from the gene encoding a 19 kD zein protein, and the like. Additional tissue-specific promoters may be isolated using well known methods (see, e.g., U.S. Pat. No. 5,589,379). Shoot-preferred promoters include shoot meristem-preferred promoters such as promoters disclosed in Weigel, et al., (1992) Cell 69:843-859 (Accession Number M91208); Accession Number AJ131822; Accession Number Z71981; Accession Number AF049870 and shoot-preferred promoters disclosed in McAvoy, et al., (2003) Acta Hort. (ISHS) 625:379-385. Inflorescence-preferred promoters include the promoter of chalcone synthase (Van der Meer, et al., (1992) Plant J. 2(4):525-535), anther-specific LAT52 (Twell, et al., (1989) Mol. Gen. Genet. 217:240-245), pollen-specific Bp4 (Albani, et al., (1990) Plant Mol Biol. 15:605, maize pollen-specific gene Zml3 (Hamilton, et al., (1992) Plant Mol. Biol. 18:211-218; Guerrero, et al., (1993) Mol. Gen. Genet. 224:161-168), microspore-specific promoters such as the apg gene promoter (Twell, et al., (1993) Sex. Plant Reprod. 6:217-224) and tapetum-specific promoters such as the TA29 gene promoter (Mariani, et al., (1990) Nature 347:737; U.S. Pat. No. 6,372,967) and other stamen-specific promoters such as the MS45 gene promoter, 5126 gene promoter, BS7 gene promoter, PG47 gene promoter (U.S. Pat. Nos. 5,412,085; 5,545,546; Plant J 3(2):261-271 (1993)), SGB6 gene promoter (U.S. Pat. No. 5,470,359), G9 gene promoter (U.S. Pat. No. 5,8937,850; U.S. Pat. No. 5,589,610), SB200 gene promoter (WO 2002/26789), or the like (see, Example 1). Tissue-preferred promoters of interest further include a sunflower pollen-expressed gene SF3 (Baltz, et al., (1992) The Plant Journal 2:713-721), B. napus pollen specific genes (Amoldo, et al., (1992) J. Cell. Biochem, Abstract Number Y101204). Tissue-preferred promoters further include those reported by Yamamoto, et al., (1997) Plant J. 12(2):255-265 (psaDb); Kawamata, et al., (1997) Plant Cell Physiol. 38(7):792-803 (PsPAL1); Hansen, et al., (1997) Mol. Gen Genet. 254(3):337-343 (ORF13); Russell, et al., (1997) Transgenic Res. 6(2):157-168 (waxy or ZmGBS; 27 kDa zein, ZmZ27; osAGP; osGT1); Rinehart, et al., (1996) Plant Physiol. 112(3):1331-1341 (Fbl2A from cotton); Van Camp, et al., (1996) Plant Physiol. 112(2):525-535 (Nicotiana SodA1 and SodA2); Canevascini, et al., (1996) Plant Physiol. 112(2):513-524 (Nicotiana ltp1); Yamamoto, et al., (1994) Plant Cell Physiol. 35(5):773-778 (Pinus cab-6 promoter); Lam, (1994) Results Probl. Cell Differ. 20:181-196; Orozco, et al., (1993) Plant Mol Biol. 23(6):1129-1138 (spinach rubisco activase (Rca)); Matsuoka, et al., (1993) Proc Natl. Acad. Sci. USA 90(20):9586-9590 (PPDK promoter) and Guevara-Garcia, et al., (1993) Plant J 4(3):495-505 (Agrobacterium pmas promoter). A tissue-specific promoter that is active in cells of male or female reproductive organs may be particularly useful in certain aspects of the present disclosure.

"Seed-preferred" promoters include both "seed-developing" promoters (those promoters active during seed development such as promoters of seed storage proteins) as well as "seed-germinating" promoters (those promoters active during seed germination). See, Thompson, et al., (1989) BioEssays 10:108. Such seed-preferred promoters include, but are not limited to, Cim1 (cytokinin-induced message), cZI9B1 (maize 19 kDa zein), mi1ps (myo-inositol-1-phosphate synthase); see, WO 2000/11177 and U.S. Pat. No. 6,225,529. Gamma-zein is an endosperm-specific promoter. Globulin-1 (Glob-1) is a representative embryo-specific promoter. For dicots, seed-specific promoters include, but are not limited to, bean β-phaseolin, napin, β-conglycinin, soybean lectin, cruciferin, and the like. For monocots, seed-specific promoters include, but are not limited to, maize 15 kDa zein, 22 kDa zein, 27 kDa zein, gamma-zein, waxy, shrunken 1, shrunken 2, globulin 1, etc. See also, WO 2000/12733 and U.S. Pat. No. 6,528,704, where seed-preferred promoters from end1 and end2 genes are disclosed. Additional embryo specific promoters are disclosed in Sato, et al., (1996) Proc. Natl. Acad. Sci. 93:8117-8122 (rice homeobox, OSH1) and Postma-Haarsma, et al., (1999) Plant Mol. Biol. 39:257-71 (rice KNOX genes). Additional endosperm specific promoters are disclosed in Albani, et al., (1984) EMBO 3:1405-15; Albani, et al., (1999) Theor. Appl.

Gen. 98:1253-62; Albani, et al., (1993) *Plant J* 4:343-55; Mena, et al., (1998) *The Plant Journal* 116:53-62 (barley DOF); Opsahl-Ferstad, et al., (1997) *Plant J* 12:235-46 (maize Esr) and Wu, et al., (1998) *Plant Cell Physiology* 39:885-889 (rice GluA-3, GluB-1, NRP33, RAG-1).

An inducible regulatory element is one that is capable of directly or indirectly activating transcription of one or more DNA sequences or genes in response to an inducer. The inducer may be a chemical agent such as a protein, metabolite, growth regulator, herbicide or phenolic compound or a physiological stress, such as that imposed directly by heat, cold, salt, or toxic elements or indirectly through the action of a pathogen or disease agent such as a virus or other biological or physical agent or environmental condition. A plant cell containing an inducible regulatory element may be exposed to an inducer by externally applying the inducer to the cell or plant such as by spraying, watering, heating or similar methods. An inducing agent useful for inducing expression from an inducible promoter is selected based on the particular inducible regulatory element. In response to exposure to an inducing agent, transcription from the inducible regulatory element generally is initiated de novo or is increased above a basal or constitutive level of expression. Typically the protein factor that binds specifically to an inducible regulatory element to activate transcription is present in an inactive form which is then directly or indirectly converted to the active form by the inducer. Any inducible promoter may be used in the instant disclosure (See, Ward, et al., (1993) *Plant Mol. Biol.* 22:361-366).

Examples of inducible regulatory elements include a metallothionein regulatory element, a copper-inducible regulatory element or a tetracycline-inducible regulatory element, the transcription from which may be effected in response to divalent metal ions, copper or tetracycline, respectively (Furst, et al., (1988) *Cell* 55:705-717; Mett, et al., (1993) *Proc. Natl. Acad. Sci., USA* 90:4567-4571; Gatz, et al., (1992) *Plant J.* 2:397-404; Roder, et al., (1994) *Mol. Gen. Genet.* 243:32-38). Inducible regulatory elements also include an ecdysone regulatory element or a glucocorticoid regulatory element, the transcription from which may be effected in response to ecdysone or other steroid (Christopherson, et al., (1992) *Proc. Natl. Acad. Sci., USA* 89:6314-6318; Schena, et al., (1991) *Proc. Natl. Acad. Sci. USA* 88:10421-10425; U.S. Pat. No. 6,504,082); a cold responsive regulatory element or a heat shock regulatory element, the transcription of which may be effected in response to exposure to cold or heat, respectively (Takahashi, et al., (1992) *Plant Physiol.* 99:383-390); the promoter of the alcohol dehydrogenase gene (Gerlach, et al., (1982) *PNAS USA* 79:2981-2985; Walker, et al., (1987) *PNAS* 84(19):6624-6628), inducible by anaerobic conditions; and the light-inducible promoter derived from the pea rbcS gene or pea psaDb gene (Yamamoto, et al., (1997) *Plant J.* 12(2):255-265); a light-inducible regulatory element (Feinbaum, et al., (1991) *Mol. Gen. Genet.* 226:449; Lam and Chua, (1990) *Science* 248:471; Matsuoka, et al., (1993) *Proc. Natl. Acad. Sci. USA* 90(20):9586-9590; Orozco, et al., (1993) *Plant Mol. Bio.* 23(6): 1129-1138), a plant hormone inducible regulatory element (Yamaguchi-Shinozaki, et al., (1990) *Plant Mol. Biol.* 15:905; Kares, et al., (1990) *Plant Mol. Biol.* 15:225), and the like. An inducible regulatory element also may be the promoter of the maize In2-1 or In2-2 gene, which responds to benzenesulfonamide herbicide safeners (Hershey, et al., (1991) *Mol. Gen. Gene.* 227:229-237; Gatz, et al., (1994) *Mol. Gen. Genet.* 243:32-38) and the Tet repressor of transposon Tnl0 (Gatz, et al., (1991) *Mol. Gen. Genet.* 227:229-237). Stress inducible promoters include salt/water stress-inducible promoters such as P5CS (Zang, et al., (1997) *Plant Sciences* 129:81-89); cold-inducible promoters, such as, cor15a (Hajela, et al., (1990) *Plant Physiol.* 93:1246-1252), cor15b (Wlihelm, et al., (1993) *Plant Mol Biol* 23:1073-1077), wscl20 (Ouellet, et al., (1998) *FEBS Lett.* 423:324-328), ci7 (Kirch, et al., (1997) *Plant Mol Biol.* 33:897-909), ci21A (Schneider, et al., (1997) *Plant Physiol.* 113:335-45); drought-inducible promoters, such as, Trg-31 (Chaudhary, et al., (1996) *Plant Mol. Biol.* 30:1247-57), rd29 (Kasuga, et al., (1999) *Nature Biotechnology* 18:287-291); osmotic inducible promoters, such as Rab17 (Vilardell, et al., (1991) *Plant Mol. Biol.* 17:985-93) and osmotin (Raghothama, et al., (1993) *Plant Mol Biol* 23:1117-28) and heat inducible promoters, such as heat shock proteins (Barros, et al., (1992) *Plant Mol.* 19:665-75; Marrs, et al., (1993) *Dev. Genet.* 14:27-41), smHSP (Waters, et al., (1996) *J. Experimental Botany* 47:325-338) and the heat-shock inducible element from the parsley ubiquitin promoter (WO 03/102198). Other stress-inducible promoters include rip2 (U.S. Pat. No. 5,332,808 and US Patent Application Publication Number 2003/0217393) and rd29a (Yamaguchi-Shinozaki, et al., (1993) *Mol. Gen. Genetics* 236:331-340). Certain promoters are inducible by wounding, including the *Agrobacterium* pmas promoter (Guevara-Garcia, et al., (1993) *Plant J.* 4(3):495-505) and the *Agrobacterium* ORF13 promoter (Hansen, et al., (1997) *Mol. Gen. Genet.* 254(3):337-343).

Plants suitable for purposes of the present disclosure may be monocots or dicots and include, but are not limited to, maize, wheat, barley, rye, sweet potato, bean, pea, chicory, lettuce, cabbage, cauliflower, broccoli, turnip, radish, spinach, asparagus, onion, garlic, pepper, celery, squash, pumpkin, hemp, zucchini, apple, pear, quince, melon, plum, cherry, peach, nectarine, apricot, strawberry, grape, raspberry, blackberry, pineapple, avocado, papaya, mango, banana, soybean, tomato, sorghum, sugarcane, sugar beet, sunflower, rapeseed, clover, tobacco, carrot, cotton, alfalfa, rice, potato, eggplant, cucumber, *Arabidopsis thaliana* and woody plants such as coniferous and deciduous trees. Thus, a transgenic plant or genetically modified plant cell of the disclosure may be an angiosperm or gymnosperm.

Cereal plants, which produce an edible grain, include, for example, corn, rice, wheat, barley, oat, rye, orchardgrass, guinea grass and sorghum. Leguminous plants include members of the pea family (Fabaceae) and produce a characteristic fruit known as a legume. Examples of leguminous plants include, for example, soybean, pea, chickpea, moth bean, broad bean, kidney bean, lima bean, lentil, cowpea, dry bean and peanut, as well as alfalfa, birdsfoot trefoil, clover and sainfoin. Oilseed plants, which have seeds that are useful as a source of oil, include soybean, sunflower, rapeseed (canola) and cottonseed. Angiosperms also include hardwood trees, which are perennial woody plants that generally have a single stem (trunk). Examples of such trees include alder, ash, aspen, basswood (linden), beech, birch, cherry, cottonwood, elm, eucalyptus, hickory, locust, maple, oak, persimmon, poplar, sycamore, walnut, sequoia and willow. Trees are useful, for example, as a source of pulp, paper, structural material and fuel.

Homozygosity is a genetic condition existing when identical alleles reside at corresponding loci on homologous chromosomes. Heterozygosity is a genetic condition existing when different alleles reside at corresponding loci on homologous chromosomes. Hemizygosity is a genetic condition existing when there is only one copy of a gene (or set of genes) with no allelic counterpart on the sister chromosome.

The plant breeding methods used herein are well known to one skilled in the art. For a discussion of plant breeding techniques, see, Poehlman, (1987) *Breeding Field Crops* AVI Publication Co., Westport Conn. Many of the plants which would be most preferred in this method are bred through techniques that take advantage of the plant's method of pollination.

Backcrossing methods may be used to introduce a gene into the plants. This technique has been used for decades to introduce traits into a plant. An example of a description of this and other plant breeding methodologies that are well known may be found in references such as Plant Breeding Methodology, edit. Neal Jensen, John Wiley & Sons, Inc. (1988). In a typical backcross protocol, the original variety of interest (recurrent parent) is crossed to a second variety (nonrecurrent parent) that carries the single gene of interest to be transferred. The resulting progeny from this cross are then crossed again to the recurrent parent and the process is repeated until a plant is obtained wherein essentially all of the desired morphological and physiological characteristics of the recurrent parent are recovered in the converted plant, in addition to the single transferred gene from the nonrecurrent parent.

By transgene, it is meant any nucleic acid sequence which is introduced into the genome of a cell by genetic engineering techniques. A transgene may be a native DNA sequence or a heterologous DNA sequence (i.e., "foreign DNA"). The term native DNA sequence refers to a nucleotide sequence which is naturally found in the cell but that may have been modified from its original form.

Using well-known techniques, additional promoter sequences may be isolated based on their sequence homology. In these techniques, all or part of a known promoter sequence is used as a probe which selectively hybridizes to other sequences present in a population of cloned genomic DNA fragments (i.e. genomic libraries) from a chosen organism. Methods that are readily available in the art for the hybridization of nucleic acid sequences may be used to obtain sequences which correspond to these promoter sequences in species including, but not limited to, maize (corn; *Zea cans*), canola (*Brassica napus, Brassica rapa* ssp.), alfalfa (*Medicago sativa*), rice (*Oryza sativa*), rye (*Secale cereale*), sorghum (*Sorghum bicolor, Sorghum vulgare*), sunflower (*Helianthus annuus*), wheat (*Triticum aestivum*), soybean (*Glycine max*), tobacco (*Nicotiana tabacum*), potato (*Solanum tuberosum*), peanuts (*Arachis hypogaea*), cotton (*Gossypium hirsutum*), sweet potato (*Ipomoea batatus*), cassava (*Manihot esculenta*), coffee (*Cofea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), oats, barley, vegetables, ornamentals and conifers. Preferably, plants include maize, soybean, sunflower, safflower, canola, wheat, barley, rye, alfalfa and sorghum.

The entire promoter sequence or portions thereof may be used as a probe capable of specifically hybridizing to corresponding promoter sequences. To achieve specific hybridization under a variety of conditions, such probes include sequences that are unique and are preferably at least about 10 nucleotides in length and most preferably at least about 20 nucleotides in length. Such probes may be used to amplify corresponding promoter sequences from a chosen organism by the well-known process of polymerase chain reaction (PCR). This technique may be used to isolate additional promoter sequences from a desired organism or as a diagnostic assay to determine the presence of the promoter sequence in an organism. Examples include hybridization screening of plated DNA libraries (either plaques or colonies; see e.g., Innis, et al., (1990) *PCR Protocols, A Guide to Methods and Applications*, eds., Academic Press).

In general, sequences that correspond to a promoter sequence of the present disclosure and hybridize to a promoter sequence disclosed herein will be at least 50% homologous, 55% homologous, 60% homologous, 65% homologous, 70% homologous, 75% homologous, 80% homologous, 85% homologous, 90% homologous, 95% homologous and even 98% homologous or more with the disclosed sequence.

Fragments of a particular promoter sequence may be used to drive the expression of a gene of interest. These fragments will comprise at least about 20 contiguous nucleotides, preferably at least about 50 contiguous nucleotides, more preferably at least about 75 contiguous nucleotides, even more preferably at least about 100 contiguous nucleotides of the particular promoter nucleotide sequences disclosed herein. The nucleotides of such fragments will usually comprise the TATA recognition sequence of the particular promoter sequence. Such fragments may be obtained by use of restriction enzymes to cleave the naturally-occurring promoter sequences disclosed herein; by synthesizing a nucleotide sequence from the naturally-occurring DNA sequence or through the use of PCR technology. See particularly, Mullis, et al., (1987) *Methods Enzymol.* 155:335-350 and Erlich, ed. (1989) *PCR Technology* (Stockton Press, New York). Again, variants of these fragments, such as those resulting from site-directed mutagenesis, are encompassed by the compositions of the present disclosure.

The nucleotide sequence operably linked to the regulatory elements disclosed herein may be an antisense sequence for a targeted gene. By "antisense DNA nucleotide sequence" is intended a sequence that is in inverse orientation to the 5'-to-3' normal orientation of that nucleotide sequence. When delivered into a plant cell, expression of the antisense DNA sequence prevents normal expression of the DNA nucleotide sequence for the targeted gene. The antisense nucleotide sequence encodes an RNA transcript that is complementary to and capable of hybridizing with the endogenous messenger RNA (mRNA) produced by transcription of the DNA nucleotide sequence for the targeted gene. In this case, production of the native protein encoded by the targeted gene is inhibited to achieve a desired phenotypic response. Thus the regulatory sequences claimed herein may be operably linked to antisense DNA sequences to reduce or inhibit expression of a native or exogenous protein in the plant.

J. Exemplary Embodiments

In certain embodiments, seeds comprising parthenogenically-derived clonal embryos are obtained by collecting one or more seeds produced by a maternal plant defective for RdDM activity for any one of the polynucleotides or polypeptides of Table 1, wherein the maternal plant is unable to be pollinated, and wherein one or more seeds comprise parthenogenically-derived clonal embryo that is a clone of the maternal plant.

In another embodiment, seeds comprising clonal embryos are obtained by collecting one or more seeds produced by a maternal plant defective for RdDM activity for any one of the polynucleotides or polypeptides of Table 1, and the seeds are sorted to separate the seeds comprising clonal embryos from the seeds comprising non-clonal embryos; wherein the maternal plant is pollinated prior to collecting the seeds; and wherein one or more seeds produced by the maternal plant comprise an embryo that is a clone of the maternal plant.

In another embodiment, maternal plants are screened for those plants that produce seeds comprising parthenogenically-derived clonal embryos; the screening method comprising: (a) obtaining a maternal plant unable to pass on paternally-derived chromosomes to embryos, wherein the plant is silenced for RdDM activity for any one of the polynucleotides or polypeptides of Table 1; (b) harvesting the seeds; and (c) determining whether the seeds comprise clonal embryos, wherein the presence of seeds comprising clonal embryos indicates the maternal plant can produce parthenogenically-derived clonal embryos.

In another embodiment, the yield of seeds is increased by using methods comprising parthenogenically-derived clonal embryos, the method comprising: (a) obtaining a maternal plant unable to pass-on paternally-derived chromosomes to embryos, wherein the plant is silenced for RdDM activity or any one of the polynucleotides or polypeptides of Table 1; (b) pollinating the maternal plant; (c) collecting seeds produced by the maternal plant; and (d) sorting the seeds comprising parthenogenically-derived clonal embryos from seeds comprising non-clonal embryos.

In another embodiment, maternal plant comprises a construct, wherein the construct comprises a nucleic acid sequence that renders the maternal plant defective for RdDM activity or any one of the polynucleotides or polypeptides of Table 1, and wherein the maternal plant produces seeds comprising parthenogenically-derived clonal embryos. In other embodiments, the plant defective for RdDM activity is a dicot or monocot. In still other embodikments, the plant defective for RdDM activity is maize, rice, sorghum, sugarcane, barley, oat, wheat, turfgrass, soybean, canola, cotton, tobacco, sunflower, safflower, or alfalfa.

In another embodiment, maternal plant comprises a construct, wherein the construct comprises a nucleic acid sequence that renders the maternal plant defective for RdDM activity or any one of the polynucleotides or polypeptides of Table 1; wherein the maternal plant produces seeds comprising parthenogenically-derived clonal embryos; and wherein the seed, when grown, produces seeds comprising clonal embryo. In other embodiments, the plant defective for RdDM activity is a dicot or monocot. In still other embodikments, the plant defective for RdDM activity is maize, rice, sorghum, sugarcane, barley, oat, wheat, turfgrass, soybean, canola, cotton, tobacco, sunflower, safflower, or alfalfa.

In another embodiment, the number of seeds is increased by methods comprising parthenogenically-derived clonal embryos comprising: (a) subjecting a plant that is defective for RdDM activity to an abiotic stress; and (b) forming seeds in the plant; where in the number of seeds comprising parthenogenically-derived clonal embryos formed are increased compared to seeds formed in a control plant. In other embodiments, the control plant is defective for activity in the RdDM-pathway and not subjected to an abiotic stress. In still other embodiments, the abiotic stress comprises a low temperature, a high temperature, light, water deficit, flooding, anoxia, a chemical stress, a high level of salt, a low level of salt, a high level of acid, a low level of acid, a high level of mineral, a low level of mineral, or combinations thereof. In yet other embodiments, the method further comprises not pollinating the plant or exposing the plants to pollen.

In another embodiment, the number of seeds comprising parthenogenically-derived clonal embryos is increased in a plant defective for RdDM activity by a method comprising: (a) pollinating after anthesis a plant that is defective for RdDM activity; and (b) forming seeds in the plant, wherein the number of seeds comprising parthenogenically-derived clonal embryos formed are increased compared to seeds comprising parthenogenically-derived clonal embryos formed in a control plant. In other embodiments, the control plant is defective for RdDM activity and pollinated prior to anthesis. In still other embodiments, the method comprises pollinating the plant that is defective for RdDM activity one or more days after anthesis. In yet other embodiments, the method comprises pollinating the plant that is defective for RdDM activity 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 days after anthesis.

In another embodiment, the number of seeds comprising parthenogenically-derived clonal embryos is increased in a plant defective for RdDM activity by method comprising: (a) pollinating the plant that is defective for RdDM activity with pollen from a plant of a different species than the plant that is defective for RdDM activity; and (b) forming seeds in the plant, wherein the number of seeds comprising parthenogenically-derived clonal embryos formed are increased compared to seeds comprising parthenogenically-derived clonal embryos formed in a control plant. In other embodiments, the control plant is disupted in for RdDM activity and pollinated with pollen from the same species. In still other embodiments, the plant that is defective for RdDM activity and pollen are from related species of the same genera or related genera. In yet other embodiments, the method comprises pollinating the plant defective for RdDM activity 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 days after anthesis. In still other embodiments, the number of seeds comprising parthenogenically-derived clonal embryos formed in the plant is increased by 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, 65%, 70%, 75%, 80%, 85%, 90%, 95%, 99%, or 100% as compared to seeds produced by a control plant. In yet other embodiments, the plant is defective for RdDM activity for any one of the polynucleotides or polypeptides of Table 1.

In other embodiments, the plant that is defective for RdDM activity and pollen are from related species of the same genera or related genera, and the plant that is defective for RdDM activity is *Zea mays* L. subspecies Teosinte, *Zea diploperennus, Zea luxurians, Zea nicaraguensis, Zea perennis*, subspecies *Zea mays* subsp mays, *Zea mays* subsp *huehuetenangensis, Zea mays* subsp *mexicana*, or *Zea mays* subsp *parviglumis*.

In other embodiments, the plant that is defective for RdDM activity and pollen are from related species of the same genera or related genera, and the pollen is from *Zea mays* L. subspecies, Teosinte, *Zea diploperennus, Zea luxurians, Zea nicaraguensis, Zea perennis*, subspecies *Zea mays* subsp mays. *Zea mays* subsp *huehuetenangensis, Zea mays* subsp *mexicana*, or *Zea mays* subsp *parviglumis*.

In other embodiments, the plant that is defective for RdDM activity and pollen are from related species of the same genera or related genera: (a) the plant that is defective for RdDM activity is *Zea mays* L. subspecies Teosinte, *Zea diploperennus, Zea luxurians, Zea nicaraguensis, Zea perennis*, subspecies *Zea mays* subsp mays, *Zea mays* subsp *huehuetenangensis, Zea mays* subsp *mexicana*, or *Zea mays* subsp *parviglumis*; and (b) and the pollen is from *Zea mays* L. subspecies, Teosinte, *Zea diploperennus, Zea luxurians, Zea nicaraguensis, Zea perennis*, subspecies *Zea mays* subsp mays, *Zea mays* subsp *huehuetenangensis*, *Zea mays* subsp *mexicana*, or *Zea mays* subsp *parviglumis*.

In other embodiments, the plant that is defective for RdDM activity and pollen are from related species of the same genera or related genera, and the plant that is defective for RdDM activity is *Glycine max*, *Glycine albicans*, *Glycine aphyonota*, *Glycine arenaria*, *Glycine argyrea*, *Glycine canescens*, *Glycine clandestine*, *Glycine curvata*, *Glycine cyrtoloba*, *Glycine falcata*, *Glycine gracei*, *Glycine hirticaulis*, *G. hirticaulis* subsp. *Leptosa*, *Glycine lactovirens*, *Glycine latifolia*, *Glycine latrobeana*, *Glycine microphylla*, *Glycine montis-douglas*, *Glycine peratosa*, *Glycine pescadrensis*, *Glycine pindanica*, *Glycine pullenii*, *Glycine rubiginosa*, *Glycine stenophita*, *Glycine syndetika*, *Glycine tabacina*, *Glycine tomentella*, *Hayata*, or *Glycine soja*.

In other embodiments, the plant that is defective for RdDM activity and pollen are from related species of the same genera or related genera, and the pollen is from a soybean (*Glycine max*), *Glycine albicans*, *Glycine aphyonota*, *Glycine arenaria*, *Glycine argyrea*, *Glycine canescens*, *Glycine clandestine*, *Glycine curvata*, *Glycine cyrtoloba*, *Glycine falcata*, *Glycine gracei*, *Glycine hirticaulis*, *G. hirticaulis* subsp. *Leptosa*, *Glycine lactovirens*, *Glycine latifolia*, *Glycine latrobeana*, *Glycine microphylla*, *Glycine montis-douglas*, *Glycine peratosa*, *Glycine pescadrensis*, *Glycine pindanica*, *Glycine pullenii*, *Glycine rubiginosa*, *Glycine stenophita*, *Glycine syndetika*, *Glycine tabacina*, *Glycine tomentella*, *Hayata*, or *Glycine soja*.

In other embodiments, the plant that is defective for RdDM activity and pollen are from related species of the same genera or related genera: (a) the plant that is defective for RdDM activity is *Glycine max*, *Glycine albicans*, *Glycine aphyonota*, *Glycine arenaria*, *Glycine argyrea*, *Glycine canescens*, *Glycine clandestine*, *Glycine curvata*, *Glycine cyrtoloba*, *Glycine falcata*, *Glycine gracei*, *Glycine hirticaulis*, *G. hirticaulis* subsp. *Leptosa*, *Glycine lactovirens*, *Glycine latifolia*, *Glycine latrobeana*, *Glycine microphylla*, *Glycine montis-douglas*, *Glycine peratosa*, *Glycine pescadrensis*, *Glycine pindanica*, *Glycine pullenii*, *Glycine rubiginosa*, *Glycine stenophita*, *Glycine syndetika*, *Glycine tabacina*, *Glycine tomentella*, *Hayata*, or *Glycine soja*; and (b) the pollen is from a soybean (*Glycine max*), *Glycine albicans*, *Glycine aphyonota*, *Glycine arenaria*, *Glycine argyrea*, *Glycine canescens*, *Glycine clandestine*, *Glycine curvata*, *Glycine cyrtoloba*, *Glycine falcata*, *Glycine gracei*, *Glycine hirticaulis*, *G. hirticaulis* subsp. *Leptosa*, *Glycine lactovirens*, *Glycine latifolia*, *Glycine latrobeana*, *Glycine microphylla*, *Glycine montis-douglas*, *Glycine peratosa*, *Glycine pescadrensis*, *Glycine pindanica*, *Glycine pullenii*, *Glycine rubiginosa*, *Glycine stenophita*, *Glycine syndetika*, *Glycine tabacina*, *Glycine tomentella*, *Hayata*, or *Glycine soja*.

In other embodiments, the plant that is defective for RdDM activity and pollen are from related species of the same genera or related genera, and the plant that is defective for RdDM activity is *Sorghum almum*, *Sorghum amplum*, *Sorghum angustum*, *Sorghum arundinaceum*, *Sorghum bicolor* subsp. *Drummondii* (Sudan grass) *Sorghum brachypodum*, *Sorghum bulbosum*, *Sorghum burmahicum*, *Sorghum ecarinatum*, *Sorghum exstans*, *Sorghum grande*, Johnson grass (*Sorghum halepense*), *Sorghum interjectum*, *Sorghum intrans*, *Sorghum laxiflorum*, *Sorghum leiocladum*, *Sorghum macrospermum*, *Sorghum matarankense*, *Sorghum nitidum*, *Sorghum plumosum*, *Sorghum propinquum*, *Sorghum purpureosericeum*, *Sorghum stipoideum*, *Sorghum timorense*, *Sorghum trichocladum*, *Sorghum versicolor*, *Sorghum verticiliflorum*, or *Sorghum vulgare* var. *technicum*.

In other embodiments, the plant that is defective for RdDM activity and pollen are from related species of the same genera or related genera, and the pollen is from *Sorghum bicolor* plant, *Sorghum almum*, *Sorghum amplum*, *Sorghum angustum*, *Sorghum arundinaceum*, *Sorghum bicolor* subsp. *Drummondii* (Sudan grass) *Sorghum brachypodum*, *Sorghum bulbosum*, *Sorghum burmahicum*, *Sorghum ecarinatum*, *Sorghum exstans*, *Sorghum grande*, Johnson grass (*Sorghum halepense*), *Sorghum interjectum*, *Sorghum intrans*, *Sorghum laxiflorum*, *Sorghum leiocladum*, *Sorghum macrospermum*, *Sorghum matarankense*, *Sorghum nitidum*, *Sorghum plumosum*, *Sorghum propinquum*, *Sorghum purpureosericeum*, *Sorghum stipoideum*, *Sorghum timorense*, *Sorghum trichocladum*, *Sorghum versicolor*, *Sorghum verticiliflorum*, or *Sorghum vulgare* var. *technicum*.

In other embodiments, the plant that is defective for RdDM activity and pollen are from related species of the same genera or related genera: (a) the plant that is defective for RdDM activity is *Sorghum almum*, *Sorghum amplum*, *Sorghum angustum*, *Sorghum arundinaceum*, *Sorghum bicolor* subsp. *Drummondii* (Sudan grass) *Sorghum brachypodum*, *Sorghum bulbosum*, *Sorghum burmahicum*, *Sorghum ecarinatum*, *Sorghum exstans*, *Sorghum grande*, Johnson grass (*Sorghum halepense*), *Sorghum interjectum*, *Sorghum intrans*, *Sorghum laxiflorum*, *Sorghum leiocladum*, *Sorghum macrospermum*, *Sorghum matarankense*, *Sorghum nitidum*, *Sorghum plumosum*, *Sorghum propinquum*, *Sorghum purpureosericeum*, *Sorghum stipoideum*, *Sorghum timorense*, *Sorghum trichocladum*, *Sorghum versicolor*, *Sorghum verticiliflorum*, or *Sorghum vulgare* var. *technicum*; and (b) the pollen is from *Sorghum bicolor* plant, *Sorghum almum*, *Sorghum amplum*, *Sorghum angustum*, *Sorghum arundinaceum*, *Sorghum bicolor* subsp. *Drummondii* (Sudan grass) *Sorghum brachypodum*, *Sorghum bulbosum*, *Sorghum burmahicum*, *Sorghum ecarinatum*, *Sorghum exstans*, *Sorghum grande*, Johnson grass (*Sorghum halepense*), *Sorghum interjectum*, *Sorghum intrans*, *Sorghum laxiflorum*, *Sorghum leiocladum*, *Sorghum macrospermum*, *Sorghum matarankense*, *Sorghum nitidum*, *Sorghum plumosum*, *Sorghum propinquum*, *Sorghum purpureosericeum*, *Sorghum stipoideum*, *Sorghum timorense*, *Sorghum trichocladum*, *Sorghum versicolor*, *Sorghum verticiliflorum*, or *Sorghum vulgare* var. *technicum*.

In other embodiments, the plant that is defective for RdDM activity and pollen are from related species of the same genera or related genera and the plant defective for RdDM activity is from the species comprising *Triticum aestivum*, Spelt ("*Triticum spelta*") or "*Triticum aestivum*" subsp. "*spelta*", Durum ("*Triticum. durum*"), Emmer ("*Triticum dicoccon*"), Einkorn ("*Triticum monococcum*"), Durum, Hard Red Spring, Hard Red Winter, Soft Red Winter, Hard White, Soft White, or Red wheat.

In other embodiments, the plant that is defective for RdDM activity and pollen are from related species of the same genera or related genera and the pollen is from *Triticum aestivum*, Spelt ("*Triticum spelta*") or "*Triticum aestivum*" subsp. "*spelta*", Durum ("*Triticum. durum*"), Emmer ("*Triticum dicoccon*"), Einkorn ("*Triticum monococcum*"), Durum, Hard Red Spring, Hard Red Winter, Soft Red Winter, Hard White, Soft White, or Red wheat.

In other embodiments, the plant that is defective for RdDM activity and pollen are from related species of the same genera or related genera: (a) the plant defective for RdDM activity is from the species comprising *Triticum aestivum*, Spelt ("*Triticum spelta*") or "*Triticum aestivum*" subsp. "*spelta*", Durum ("*Triticum. durum*"), Emmer ("*Triticum dicoccon*"), Einkorn ("*Triticum monococcum*"), Durum, Hard Red Spring, Hard Red Winter, Soft Red Winter, Hard White, Soft White, or Red wheat; and (b) the pollen is from *Triticum aestivum*, Spelt ("*Triticum spelta*") or "*Triticum aestivum*" subsp. "*spelta*", Durum ("*Triticum. durum*"), Emmer ("*Triticum dicoccon*"), Einkorn ("*Triticum monococcum*"), Durum, Hard Red Spring, Hard Red Winter, Soft Red Winter, Hard White, Soft White, or Red wheat.

In other embodiments, the plant that is defective for RdDM activity and pollen are from related species of the same genera or related genera and the plant defective for RdDM activity is from *Arabidopsis thaliana*, *Arabidopsis arenicola*, *Arabidopsis arenosa*, *A. arenosa* subsp. *Arenosa*, *A. arenosa* subsp. *Borbasii*, *Arabidopsis cebennensis*, *Arabidopsis croatica*, *Arabidopsis halleri*, *A. halleri* subsp. *Halleri*, *A. halleri* subsp. *Ovirensis*, *A. halleri* subsp. *Gemmifera*, *Arabidopsis lyrata*, *A. lyrata* subsp. *Lyrata*, *lyrata* subsp. *Petraea*, *A. lyrata* subsp. *Kamchatica*, *Arabidopsis neglecta*, *Arabidopsis pedemontana*, or *Arabidopsis suecica*, or *Boechera holboellii*.

In other embodiments, the plant that is defective for RdDM activity and pollen are from related species of the same genera or related genera and the pollen is from *Arabidopsis thaliana*, *Arabidopsis arenicola*, *Arabidopsis arenosa*, *A. arenosa* subsp. *Arenosa*, *A. arenosa* subsp. *Borbasii*, *Arabidopsis cebennensis*, *Arabidopsis croatica*, *Arabidopsis halleri*, *A. halleri* subsp. *Halleri*, *A. halleri* subsp. *Ovirensis*, *A. halleri* subsp. *Gemmifera*, *Arabidopsis lyrata*, *A. lyrata* subsp. *Lyrata*, *lyrata* subsp. *Petraea*, *A. lyrata* subsp. *Kamchatica*, *Arabidopsis neglecta*, *Arabidopsis pedemontana*, or *Arabidopsis suecica*, or *Boechera holboellii*.

In other embodiments, the plant that is defective for RdDM activity and pollen are from related species of the same genera or related genera: (a) the plant defective for RdDM activity is from *Arabidopsis thaliana*, *Arabidopsis arenicola*, *Arabidopsis arenosa*, *A. arenosa* subsp. *Arenosa*, *A. arenosa* subsp. *Borbasii*, *Arabidopsis cebennensis*, *Arabidopsis croatica*, *Arabidopsis halleri*, *A. halleri* subsp. *Halleri*, *A. halleri* subsp. *Ovirensis*, *A. halleri* subsp. *Gemmifera*, *Arabidopsis lyrata*, *A. lyrata* subsp. *Lyrata*, *lyrata* subsp. *Petraea*, *A. lyrata* subsp. *Kamchatica*, *Arabidopsis neglecta*, *Arabidopsis pedemontana*, or *Arabidopsis suecica*, or *Boechera holboellii*; and (b) the pollen is from *Arabidopsis thaliana*, *Arabidopsis arenicola*, *Arabidopsis arenosa*, *A. arenosa* subsp. *Arenosa*, *A. arenosa* subsp. *Borbasii*, *Arabidopsis cebennensis*, *Arabidopsis croatica*, *Arabidopsis halleri*, *A. halleri* subsp. *Halleri*, *A. halleri* subsp. *Ovirensis*, *A. halleri* subsp. *Gemmifera*, *Arabidopsis lyrata*, *A. lyrata* subsp. *Lyrata*, *lyrata* subsp. *Petraea*, *A. lyrata* subsp. *Kamchatica*, *Arabidopsis neglecta*, *Arabidopsis pedemontana*, or *Arabidopsis suecica*, or *Boechera holboellii*.

In another embodiment, the number of seeds comprising parthenogenically-derived clonal embryos is increased in a plant defective for RdDM activity by method comprising: (a) pollinating the plant that is defective for RdDM activity with pollen from a plant of a different species than the plant that is defective for RdDM activity; and (b) forming seeds in the plant, wherein the number of seeds comprising parthenogenically-derived clonal embryos formed are increased compared to seeds comprising parthenogenically-derived clonal embryos formed in a control plant, wherein the number of seeds comprising parthenogenically-derived clonal embryos formed in the plant is increased by 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, 65%, 70%, 75%, 80%, 85%, 90%, 95%, 99%, or 100% as compared to seeds produced by a control plant.

In another embodiment, the number of seeds comprising parthenogenically-derived clonal embryos is increased in a plant defective for RdDM activity by method comprising: (a) pollinating the plant that is defective for RdDM activity with pollen from a plant of a different species than the plant that is defective for RdDM activity; and (b) forming seeds in the plant, wherein the number of seeds comprising parthenogenically-derived clonal embryos formed are increased compared to seeds comprising parthenogenically-derived clonal embryos formed in a control plant, wherein the number of seeds comprising parthenogenically-derived clonal embryos formed in the plant is increased by 1%, 2%, 3%, 4%, 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, 65%, 70%, 75%, 80%, 85%, 90%, 95%, 99%, or 100% as compared to seeds produced by a control plant.

In another embodiment, a seed is enriched for asexual embryos by a method comprising: (a) introducing in a plant defective for RdDM activity an element that disrupts sexual zygote function or development; and (b) regulating expression of the element in the sexual zygote precursor cells or sexual zygote so that sexual zygote formation or development is disrupted. In other embodiments, the element is operatively linked to a promoter or operatively linked to a sexual zygote preferred promoter. In other embodiments, the promoter is a chemically inducible promoter. In other embodiments, the method further comprises exposing the plant to an inducer to effect sexual zygote formation or development. In other embodiments, the element is lethal to the sexual zygote precursor cells or sexual zygote, the element is a toxin, or the element is barnase or dam methylase. In other embodiments, the sexual zygote is ablated when the element is expressed, is ablated when the element is repressed, or is repressed using gene or post-transcriptional silencing. In other embodiments, the method further comprises regulating the expression of the element chemically. In other embodiments, the method further comprises regulating the expression of the element chemically by chemical induction or chemical repression or chemical de-repression. In other embodiments, the method further comprises regulating the expression of the element chemically by providing a chemical to the plant by foliar application, root drench application, pre-emergence application, post-emergence application, or seed treatment application. In other embodiments, the method further comprises, regulating the expression of the element using a molecular or genetic switch. In other embodiments, the method further comprises regulating the expression of the element using a genetic switch, wherein the genetic switch is a sulfonylurea-regulated gene switch or wherein the genetic switch comprises a repressor, wherein the repressor is operably linked to a promoter active in the plant wherein the promoter is a constitutive promoter, a tissue-preferred promoter, a developmental stage-preferred promoter, an inducible promoter, or a repressible promoter. In other embodiments, the method further comprises regulating the expression of the element using a transactivator system.

In another embodiment, a plant is produced by the immediately foregoing embodiment, and the method comprises a transgenic plant defective for RdDM activity, enriched for asexual embryos, and lacking a sexual zygote, and wherein the plant comprises an element that disrupts sexual zygote function or development. In other embodiments, the plant is dicot or monocot. In other embodiments, the plant is maize, rice, sorghum, sugarcane, barley, oat, wheat, turfgrass, soybean, canola, cotton, tobacco, sunflower, safflower, or alfalfa.

In another embodiment, a seed comprising an asexual embryo produced is produced from the plant of the preceding paragraph, and the method comprises an element that disrupts sexual zygote function or development from the plant of claim 104, and wherein the plant comprises an element that disrupts sexual zygote function or development. In other embodiments, the plant seed is a dicot or monot. In other embodiments, the plant seeds is maize, rice, sorghum, sugarcane, barley, oat, wheat, turfgrass, soybean, canola, cotton, tobacco, sunflower, safflower, or alfalfa.

In another embodiment, a plant cell from the plant of the preceding paragraph. In other embodiments, the plant cell is dicot or monocot. In other embodiments, the plant cell is maize, rice, sorghum, sugarcane, barley, oat, wheat, turfgrass, soybean, canola, cotton, tobacco, sunflower, safflower, or alfalfa.

In another embodiment, a sexual zygote or embryo is selectively ablated by a method comprising: providing in an embryo or sexual zygote a first construct and a second construct, said first construct having a promoter that expresses in the female gametophyte or sexual zygote operably linked to a nucleic acid encoding a split-intein toxin, said second construct having a male gamete-preferred promoter operably linked to a nucleic acid encoding the cognate split-intein toxin; wherein the split intein toxins are trans-spliced into an active toxin; thereby ablating the sexual zygote or embryo.

In another embodiment, a sexual zygote or embryo is selectively ablated by a method comprising: (a) providing in a first plant comprising a construct having a promoter that expresses in the female gamete or sexual zygote operably linked to a nucleic acid encoding a split-intein toxin; and (b) pollinating the first plant with pollen having a male gamete-preferred promoter operably linked to a nucleic acid encoding a cognate split-intein toxin to produce a plant wherein the split intein toxins are trans-spliced into an active toxin in the sexual zygote or embryo so that the sexual zygote or embryo is ablated.

In another embodiment, a sexual zygote or embryo is selectively ablated by a method comprising: (a) providing in a first plant comprising a construct having a promoter that expresses in the female gamete or sexual zygote operably linked to a nucleic acid encoding a split-intein toxin; (b) providing a second plant comprising a male gamete-preferred promoter operably linked to a nucleic acid encoding a cognate split-intein toxin; and (c) crossing the first plant with second plant to produce a plant wherein the split intein toxins are trans-spliced into an active toxin in the sexual zygote or embryo so that the sexual zygote or embryo is ablated.

In other embodiments of the foregoing method pertaining to selectively ablating a sexual zygote or embryo, the promoter that expresses in the female gamete or sexual zygote is a female gamete preferred promoter.

In other embodiments of the foregoing method pertaining to selectively ablating a sexual zygote or embryo, the promoter that expresses in the female gamete or sexual zygote is a female gamete preferred promoter, and the female gamete-preferred promoter is an egg cell-preferred promoter.

In other embodiments of the foregoing method pertaining to selectively ablating a sexual zygote or embryo, the promoter that expresses in the female gamete or sexual zygote is a sexual zygote preferred promoter.

In other embodiments of the foregoing method pertaining to selectively ablating a sexual zygote or embryo, In other embodiments of the foregoing method pertaining to selectively ablating a sexual zygote or embryo, the promoter that does not express in the central cell or sperm cell.

In other embodiments of the foregoing method pertaining to selectively ablating a sexual zygote or embryo, the male gamete preferred promoter is sperm cell-preferred promoter.

In other embodiments of the foregoing method pertaining to selectively ablating a sexual zygote or embryo, the male gamete preferred promoter is sperm cell-preferred promoter, and the male gamete preferred promoter does not express in the egg cell.

In other embodiments of the foregoing method pertaining to selectively ablating a sexual zygote or embryo, the element is a toxin or the element is barnase or DAM.

In other embodiments of the foregoing method pertaining to selectively ablating a sexual zygote or embryo, the first plant is male sterile.

In other embodiments of the foregoing method pertaining to selectively ablating a sexual zygote or embryo, the sexual zygotes or embryos are non-viable.

In other embodiments of the foregoing method pertaining to selectively ablating a sexual zygote or embryo, the non-sexual zygotes or embryos are viable.

In other embodiments of the foregoing method pertaining to selectively ablating a sexual zygote or embryo, one or both of the plants are defective for RdDM activity.

In other embodiments of the foregoing method pertaining to selectively ablating a sexual zygote or embryo, wherein one or both of the intein-split toxins are independently repressed.

In other embodiments of the foregoing method pertaining to selectively ablating a sexual zygote or embryo, wherein one or both of the intein-split toxins are independently activated.

In other embodiments of the foregoing method pertaining to selectively ablating a sexual zygote or embryo, wherein the inteins are regulated by chemical induction, chemical repression, chemical de-repression.

In other embodiments of the foregoing method pertaining to selectively ablating a sexual zygote or embryo, wherein the inteins are regulated by using a molecular or genetic switch.

In another embodiment, a plant is produced by one of the foregoing methods pertaining to selectively ablating a sexual zygote or embryo, comprising a transgenic plant defective for RdDM activity, enriched for asexual embryos, and lacking a sexual zygote, and wherein the plant comprises split inteins. In other embodiments, the plant is a dicot or monocot. In other embodiments, the plant is maize, rice, sorghum, sugarcane, barley, oat, wheat, turfgrass, soybean, canola, cotton, tobacco, sunflower, safflower, or alfalfa.

In another embodiment, a seed is produced from a plant is produced by one of the foregoing methods pertaining to selectively ablating a sexual zygote or embryo, comprising a transgenic plant defective for RdDM activity, enriched for asexual embryos, and lacking a sexual zygote, and wherein the plant comprises split inteins., wherein the seed is enriched for asexual embryos, lacks a sexual zygote, and wherein the plant comprises split inteins. In other embodiments, the seed is a dicot or monocot. In other embodiments, the seed is maize, rice, sorghum, sugarcane, barley, oat, wheat, turfgrass, soybean, canola, cotton, tobacco, sunflower, safflower, or alfalfa.

In another embodiment, a plant cell from a plant is produced by one of the foregoing methods pertaining to selectively ablating a sexual zygote or embryo, comprising a transgenic plant defective for RdDM activity, enriched for asexual embryos, and lacking a sexual zygote, and wherein the plant comprises split inteins. In other embodiments, the plant cell is a dicot or monocot. In other embodiments, the plant cell is maize, rice, sorghum, sugarcane, barley, oat, wheat, turfgrass, soybean, canola, cotton, tobacco, sunflower, safflower, or alfalfa.

In another embodiment, a seed population of a plant is enriched for asexual embryos and endosperm by a method comprising providing a plant comprising an asexual female gametophyte defective for RdDM activity, wherein the plant is disrupted for an activity that regulates endosperm development and wherein the seeds formed comprise parthenogenically-derived clonal embryos.

In another embodiment, a seed population comprising parthenogenically-derived clonal embryos of a plant is enriched for asexual embryos and endosperm by a method comprising fertilizing a sexual female gametophyte of a plant defective for RdDM activity with pollen from a plant disrupted for an activity that regulates endosperm development, wherein the plant is homozygous for a gene or mutation that leads to autonomous endosperm formation.

In another embodiment, a seed population comprising parthenogenically-derived clonal embryos of a plant is enriched for asexual embryos and endosperm by a method comprising: (a) fertilizing a sexual female gametophyte of a plant defective for RdDM activity with pollen from a plant disrupted for an activity that regulates endosperm development, wherein the plant is homozygous for a gene or mutation that leads to autonomous endosperm formation; (b) obtaining seeds from the cross; (c) germinating the seeds and growing the seeds into plants; and (d) allowing the plants to self-pollinate to obtain modulated RdDM plants that are homozygous for gene mutations that allow endosperm development without fertilization.

In other embodiments of the preceding methods comprising a seed population for asexual embryos and endosperm, autonomous endosperm development is induced in the plant.

In other embodiments of the preceding methods comprising a seed population for asexual embryos and endosperm, the seed is formed independent of fertilization.

In other embodiments of the preceding methods comprising a seed population for asexual embryos and endosperm, an activity that regulates endosperm development in the PRC2 complex is disrupted.

In other embodiments of the preceding methods comprising a seed population for asexual embryos and endosperm, the asexual female gametophyte is disrupted for activity in for CYCLIN DEPENDENT KINASE A, cdka, or MULTIPLE SUPPRESSOR OF IRA1 (MSI1) CUL4-DDB1, Fertilization Independent Embryo (FIE), Fertilization Independent Seed-1 (FIS1), Fertilization Independent Seed-1 (FIS2), or Fertilization Independent Seed-3 (FIS3).

In other embodiments of the preceding methods comprising a seed population for asexual embryos and endosperm, the plant comprises an element that disrupts CYCLIN DEPENDENT KINASE A, cdka, or MULTIPLE SUPPRESSOR OF IRA1 (MSI1) CUL4-DDB1, Fertilization Independent Embryo (FIE), Fertilization Independent Seed-1 (FIS1), Fertilization Independent Seed-1(FIS2), or Fertilization Independent Seed-3 (FIS3) activity.

In other embodiments of the preceding methods comprising a seed population for asexual embryos and endosperm, an element is a mutation in CYCLIN DEPENDENT KINASE A, cdka, or MULTIPLE SUPPRESSOR OF IRA1 (MSI1) CUL4-DDB1, Fertilization Independent Embryo (FIE), Fertilization Independent Seed-1 (FIS1), Fertilization Independent Seed-1(FIS2), or Fertilization Independent Seed-3 (FIS3).

In other embodiments of the preceding methods comprising a seed population for asexual embryos and endosperm, the element disrupts the formation or activity of the FERTILIZATION-INDEPENDENT SEED (FIS) complex.

In another embodiment, a plant enriched for asexual embryos and endosperm in the seed population, the plant being produced by the method comprising providing a plant comprising an asexual female gametophyte defective for RdDM activity, wherein the plant is disrupted for an activity that regulates endosperm development and wherein the seeds formed comprise parthenogenically-derived clonal embryos, wherein the plant comprises disrupted activity in the regulation of endosperm formation and an asexual female gametophyte disrupted in activity in the RdDM-pathway and seeds comprising clonal embryos.

In another embodiment, a plant enriched for asexual embryos and endosperm in the seed population, the plant being produced by the method comprising fertilizing a sexual female gametophyte of a plant defective for RdDM activity with pollen from a plant disrupted for an activity that regulates endosperm development, wherein the plant is homozygous for a gene or mutation that leads to autonomous endosperm formation, wherein the plant comprises disrupted activity in the regulation of endosperm formation and an asexual female gametophyte disrupted in activity in the RdDM-pathway and seeds comprising clonal embryos.

In another embodiment, a seed from a plant enriched for asexual embryos and endosperm in the seed population, the plant being produced by the method comprising providing a plant comprising an asexual female gametophyte defective for RdDM activity, wherein the plant is disrupted for an activity that regulates endosperm development and wherein the seeds formed comprise parthenogenically-derived clonal embryos, wherein the plant comprises disrupted activity in the regulation of endosperm formation and an asexual female gametophyte disrupted in activity in the RdDM-pathway and seeds comprising clonal embryos.

In another embodiment, a seed from a plant enriched for asexual embryos and endosperm in the seed population, the plant being produced by the method comprising fertilizing a sexual female gametophyte of a plant defective for RdDM activity with pollen from a plant disrupted for an activity that regulates endosperm development, wherein the plant is homozygous for a gene or mutation that leads to autonomous endosperm formation, wherein the plant comprises disrupted activity in the regulation of endosperm formation and an asexual female gametophyte disrupted in activity in the RdDM-pathway and seeds comprising clonal embryos.

In any of the foregoing embodiments, the plant defective for RdDM activity for a nucleic acid having at least 100% identity to the full length of a nucleic acid of any the nucleotide sequences set forth in Table 1, or a fragment, complement, or combination thereof. In still other embodiments, the plant defective for RdDM activity for a nucleic acid having at least 90% identity to the full length of a nucleic acid of any the nucleotide sequences set forth in Table 1, or a fragment, complement, or combination thereof. In yet other embodiments, the plant defective for RdDM activity for a nucleic acid having at least 80% identity to the full length of a nucleic acid of any the nucleotide sequences set forth in Table 1, or a fragment, complement, or combination thereof. In even other embodiments, the plant defective for RdDM activity for a nucleic acid having at least 70% identity to the full length of a nucleic acid of any the nucleotide sequences set forth in Table 1, or a fragment, complement, or combination thereof.

In any of the foregoing embodiments, the plant defective for RdDM activity for a nucleic acid having at least 100% identity to the full length of a nucleic acid of any the nucleotide sequences set forth in SEQ ID NOs: 1-64, 100-230, 300-365, 399-541, 616-708, 757-820, 853-911, or 942-980, or a fragment, complement, or combination thereof. In still other embodiments, the plant defective for RdDM activity for a nucleic acid having at least 90% identity to the full length of a nucleic acid of any the nucleotide sequences set forth in SEQ ID NOs: 1-64, 100-230, 300-365, 399-541, 616-708, 757-820, 853-911, or 942-980, or a fragment, complement, or combination thereof. In yet other embodiments, the plant defective for RdDM activity for a nucleic acid having at least 80% identity to the full length of a nucleic acid of any the nucleotide sequences set forth in SEQ ID NOs: 1-64, 100-230, 300-365, 399-541, 616-708, 757-820, 853-911, or 942-980, or a fragment, complement, or combination thereof. In even other embodiments, the plant defective for RdDM activity for a nucleic acid having at least 70% identity to the full length of a nucleic acid of any the nucleotide sequences set forth in SEQ ID NOs: 1-64, 100-230, 300-365, 399-541, 616-708, 757-820, 853-911, or 942-980, or a fragment, complement, or combination thereof.

In any of the foregoing embodiments, the plant defective for RdDM activity for a polypeptide having at least 100% identity to the full length of a polypeptide of any of the amino acid sequences set forth in Table 1, or a fragment, complement, or combination thereof. In still other embodiments, the plant defective for RdDM activity for a polypeptide having at least 90% identity to the full length of a polypeptide of any of the amino acid sequences set forth in Table 1, or a fragment, complement, or combination thereof. In yet other embodiments, the plant defective for RdDM activity for a polypeptide having at least 80% identity to the full length of a polypeptide of any of the amino acid sequences set forth in Table 1, or a fragment, complement, or combination thereof. In even other embodiments, the plant defective for RdDM activity for a polypeptide having at least 70% identity to the full length of a polypeptide of any of the amino acid sequences set forth in Table 1, or a fragment, complement, or combination thereof.

In any of the foregoing embodiments, the plant defective for RdDM activity for a polypeptide having at least 100% identity to the full length of a polypeptide of any of the amino acid sequences set forth in SEQ ID NOs: 65-99, 231-299, 366-398, 542-615, 709-756, 821-852, 912-941, or 981-1005, or a fragment, complement, or combination thereof. In still other embodiments, the plant defective for RdDM activity for a polypeptide having at least 90% identity to the full length of a polypeptide of any of the amino acid sequences set forth in SEQ ID NOs: 65-99, 231-299, 366-398, 542-615, 709-756, 821-852, 912-941, or 981-1005, or a fragment, complement, or combination thereof. In yet other embodiments, the plant defective for RdDM activity for a polypeptide having at least 80% identity to the full length of a polypeptide of any of the amino acid sequences set forth in SEQ ID NOs: 65-99, 231-299, 366-398, 542-615, 709-756, 821-852, 912-941, or 981-1005, or a fragment, complement, or combination thereof. In even other embodiments, the plant defective for RdDM activity for a polypeptide having at least 70% identity to the full length of a polypeptide of any of the amino acid sequences set forth in SEQ ID NOs: 65-99, 231-299, 366-398, 542-615, 709-756, 821-852, 912-941, or 981-1005, or a fragment, complement, or combination thereof.

In any of the foregoing embodiments, the plant defective for RdDM activity for AGO4 (ARGONAUTE 4), AGO6 (ARGONAUTE 6), AGO8 (ARGONAUTE 8), AGO9 (ARGONAUTE 9), CMT3 (CHROMOMETHYLASE 3), DCL3 (DICER-LIKE 3), DRM2 (DOMAINS REARRANGED METHYLASE 2), EXS1 (EXTRA SPOROGENOUS CELLS1), IDN2 (INVOLVED IN DE NOVO 2), MET1 (METHYL TRANSFERASE 1), NPRD1a (NUCLEAR POLYMERASE D 1a), NRPD1b (NUCLEAR POLYMERASE D 1b), NRPD2 (NUCLEAR POLYMERASE D 2), NRPE1 (NUCLEAR RNA POLYMERASE E 1), NRPE2 (NUCLEAR RNA POLYMERASE E 2), RDR2 (RNA-DEPENDENT RNA POLYMERASE 2), RDR6 (RNA-DEPENDENT RNA POLYMERASE 6), SGS3 (SUPPRESSOR OF GENE SILENCING 3), SUVH2 (SUPPRESSOR OF VARIEGATION 3-9 HOMOLOG 2), and SUVH9 (SUPPRESSOR OF VARIEGATION 3-9 HOMOLOG 9). In other embodiments, the AGO4 allele is ago4-6 or ago4-1. In still other embodiments, the AGO6 allele is ago6-2. In yet other embodimetns, the AGO9 allele is 9-2, 9-3 or 9-4. In other embodiments, the AGO8 allele is ago 8-1. In still other embodiments, the RDR2 allele is rdr2-1. In yet other embodiments, the RDR6 allele is rdr6-15 or rdr6-11. In other embodiments, the SGS3 allele is sgs3-11. In still other embodiments, the DRM2 allele is drm2-2. In yet other embodiments, the MET1 allele is met1-7.

In any of the foregoing embodiments, the plant defective for RdDM activity has an insertion, deletion, substitution or mutation of one or more nucleotides that makes RdDM activity defective.

In any of the foregoing embodiments, the plant defective for RdDM activity has an insertion, deletion, substitution or mutation that is introduced using CRISPR technology.

In any of the foregoing embodiments, the RdDM activity is silenced in the plant defective for RdDM activity.

In any of the foregoing embodiments, the RdDM activity is silenced in the plant defective for RdDM activity, and the RdDM activity is silenced using an element selected from the group consisting of antisense, RNAi, and hairpin molecules directed to a nuclear gene or promoter conferring RdDM activity.

In any of the foregoing embodiments, the RdDM activity is silenced in the plant defective for RdDM activity, and the RdDM activity is silenced using a promoter inverted repeat targeting the promoter driving a nuclear gene or promoter conferring RdDM activity.

In any of the foregoing embodiments, the plant defective for RdDM activity is male-sterile.

In any of the foregoing embodiments, the maternal plan is unable to self-pollinate.

In any of the foregoing embodiments, the maternal plan is unable to self-pollinate, and the maternal plant's ability to self-pollinate is disrupted physically, chemically or genetically.

In any of the foregoing embodiments, the methods described therein further comprise sorting the seeds comprising parthenogenically-derived clonal embryos based on phenotype or genotype.

In any of the foregoing embodiments, the methods therein described further comprise sorting the seeds comprising parthenogenically-derived clonal embryos based on phenotype, wherein the phenotype comprises size, shape, color, or a combination thereof of the seeds.

In any of the foregoing embodiments, the methods therein described further comprise sorting the seeds comprising parthenogenically-derived clonal embryos based on phenotype or genotype, and wherein the sorting is done visually.

In any of the foregoing embodiments, the methods described therein further comprise selecting for seeds comprising parthenogenically-derived clonal embryos.

In any of the foregoing embodiments, the methods described therein further comprise selecting for seeds comprising parthenogenically-derived clonal embryos from seeds not comprising parthenogenically-derived clonal embryos.

In any of the foregoing embodiments, the methods described therein further comprise sorting the seeds comprising parthenogenically-derived clonal embryos based on phenotype or genotype, and wherein the sorting is manual, semi-automated, or automated.

In any of the foregoing embodiments, the methods described therein further comprise sorting the seeds comprising parthenogenically-derived clonal embryos based on phenotype or genotype; wherein the sorting is automated; and wherein the automated sorting comprises a machine comprising an optical detector.

In any of the foregoing embodiments, the methods described therein further comprise sorting the seeds comprising parthenogenically-derived clonal embryos based on the absence of a paternal-inherited trait or marker in the seeds.

In any of the foregoing embodiments, the methods described therein further comprise determining the number of seeds comprising parthenogenically-derived clonal embryos.

In any of the foregoing embodiments, the methods described therein further comprise determining the number of viable seeds comprising parthenogenically-derived clonal embryos.

In any of the foregoing embodiments, the plant defective for RdDM activity is a dicot or monocot.

In any of the foregoing embodiments, the plant defective for RdDM activity is maize, rice, sorghum, sugarcane, barley, oat, wheat, turfgrass, soybean, canola, cotton, tobacco, sunflower, safflower, or alfalfa.

In another embodiment, an isolated or recombinant polynucleotide comprising a nucleic acid selected from the group consisting of: (a) a nucleic acid having at least 100% identity to the full length of a nucleic acid of any the nucleotide sequences set forth in Table 1; (b) a nucleic acid having at least 90% identity to the full length of a nucleic acid of any of the nucleotide sequences set forth in Table 1; (c) a nucleic acid having at least 80% identity to the full length of a nucleic acid of any of the nucleotide sequences set forth in Table 1; (d) a nucleic acid having at least 70% identity to the full length of a nucleic acid of any of the nucleotide sequences set forth in Table 1; and (e) any fragments, complements or combinations thereof.

In another embodiment, an isolated or recombinant polynucleotide comprising a nucleic acid selected from the group consisting of: (a) a nucleic acid having at least 100% identity to the full length of a nucleic acid of any the nucleotide sequences set forth in SEQ ID NOs: 1-64, 100-230, 300-365, 399-541, 616-708, 757-820, 853-911, or 942-980; (b) a nucleic acid having at least 90% identity to the full length of a nucleic acid of any of the nucleotide sequences set forth in SEQ ID NOs: 1-64, 100-230, 300-365, 399-541, 616-708, 757-820, 853-911, or 942-980; (c) a nucleic acid having at least 80% identity to the full length of a nucleic acid of any of the nucleotide sequences set forth in SEQ ID NOs: 1-64, 100-230, 300-365, 399-541, 616-708, 757-820, 853-911, or 942-980; (d) a nucleic acid having at least 70% identity to the full length of a nucleic acid of any of the nucleotide sequences set forth in SEQ ID NOs: 1-64, 100-230, 300-365, 399-541, 616-708, 757-820, 853-911, or 942-980; and (e) any fragments, complements or combinations thereof.

In another embodiment, an isolated or recombinant polypeptide comprising an amino acid sequence selected from the group consisting of: (a) a polypeptide having at least 100% identity to the full length of a polypeptide of any of the amino acid sequences set forth in Table 1; (b) a polypeptide having at least 90% identity to the full length of a polypeptide of any of the amino acid sequences set forth in Table 1; (c) a polypeptide having at least 80% identity to the full length of a polypeptide of any of the amino acid sequences set forth in Table 1; (d) a polypeptide having at least 70% identity to the full length of a polypeptide of any of the amino acid sequences set forth in Table 1; and (e) and any fragments, complements or combinations thereof.

In another embodiment, an isolated or recombinant polypeptide comprising an amino acid sequence selected from the group consisting of: (a) a polypeptide having at least 100% identity to the full length of a polypeptide of any of the amino acid sequences set forth in SEQ ID NOs: 65-99, 231-299, 366-398, 542-615, 709-756, 821-852, 912-941, or 981-1005; (b) a polypeptide having at least 90% identity to the full length of a polypeptide of any of the amino acid sequences set forth in SEQ ID NOs: 65-99, 231-299, 366-398, 542-615, 709-756, 821-852, 912-941, or 981-1005; (c) a polypeptide having at least 80% identity to the full length of a polypeptide of any of the amino acid sequences set forth in SEQ ID NOs: 65-99, 231-299, 366-398, 542-615, 709-756, 821-852, 912-941, or 981-1005; (d) a polypeptide having at least 70% identity to the full length of a polypeptide of any of the amino acid sequences set forth in SEQ ID NOs: 65-99, 231-299, 366-398, 542-615, 709-756, 821-852, 912-941, or 981-1005; and (e) and any fragments, complements or combinations thereof.

In another embodiment, an expression cassette comprising an element operably linked to a heterologous promoter, that when element is expressed silences a nucleic acid selected from the group consisting of: (a) a nucleic acid having at least 100% identity to the full length of a nucleic acid of any the nucleotide sequences set forth in Table 1; (b) a nucleic acid having at least 90% identity to the full length of a nucleic acid of any of the nucleotide sequences set forth in Table 1; (c) a nucleic acid having at least 80% identity to the full length of a nucleic acid of any of the nucleotide sequences set forth in Table 1; (d) a nucleic acid having at least 70% identity to the full length of a nucleic acid of any of the nucleotide sequences set forth in Table 1; and (e) any fragments, complements or combinations thereof.

In another embodiment, an expression cassette comprising an element operably linked to a heterologous promoter, that when element is expressed silences a nucleic acid selected from the group consisting of: (a) a nucleic acid having at least 100% identity to the full length of a nucleic acid of any the nucleotide sequences set forth in SEQ ID NOs: 1-64, 100-230, 300-365, 399-541, 616-708, 757-820, 853-911, or 942-980; (b) a nucleic acid having at least 90% identity to the full length of a nucleic acid of any of the nucleotide sequences set forth in SEQ ID NOs: 1-64, 100-

230, 300-365, 399-541, 616-708, 757-820, 853-911, or 942-980; (c) a nucleic acid having at least 80% identity to the full length of a nucleic acid of any of the nucleotide sequences set forth in SEQ ID NOs: 1-64, 100-230, 300-365, 399-541, 616-708, 757-820, 853-911, or 942-980; (d) a nucleic acid having at least 70% identity to the full length of a nucleic acid of any of the nucleotide sequences set forth in SEQ ID NOs: 1-64, 100-230, 300-365, 399-541, 616-708, 757-820, 853-911, or 942-980; and (e) any fragments, complements or combinations thereof.

EXAMPLES

The following examples describe selected aspects and embodiments of the present disclosure, such as exemplary methods of generating and using maternal plants that produce clonal seeds, methods of distinguishing clonal seeds/progeny from sexually-generated seeds/progeny, and methods of obtaining clonal seeds/progeny from a mixture/set of clonal seeds/progeny and sexually-generated seeds/progeny, among others. The examples are presented for illustration only and are not intended to define or limit the scope of the present disclosure.

Example 1: Single Gene Mutations in *Arabidopsis*

Figure 6A:
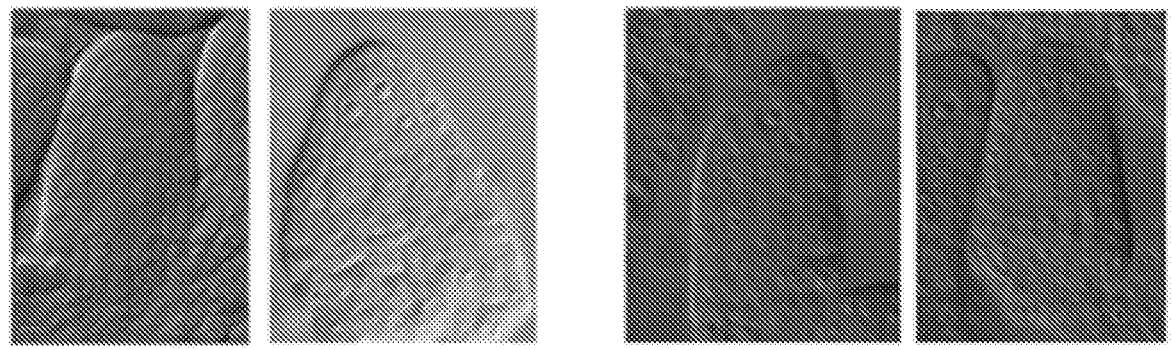
FIGS. 6A and 6B show ectopic gametic precursors and gametophytes in homozygous ago4 individuals. Several ectopic pre-meiotic cells differentiated in the young ovule primordial (FIG. 6A), which resulted in several developing female gametophytes ectopically ocated at the micropylar and chalazal regions of the ovule (FIG. 6B).
Figure 6B:
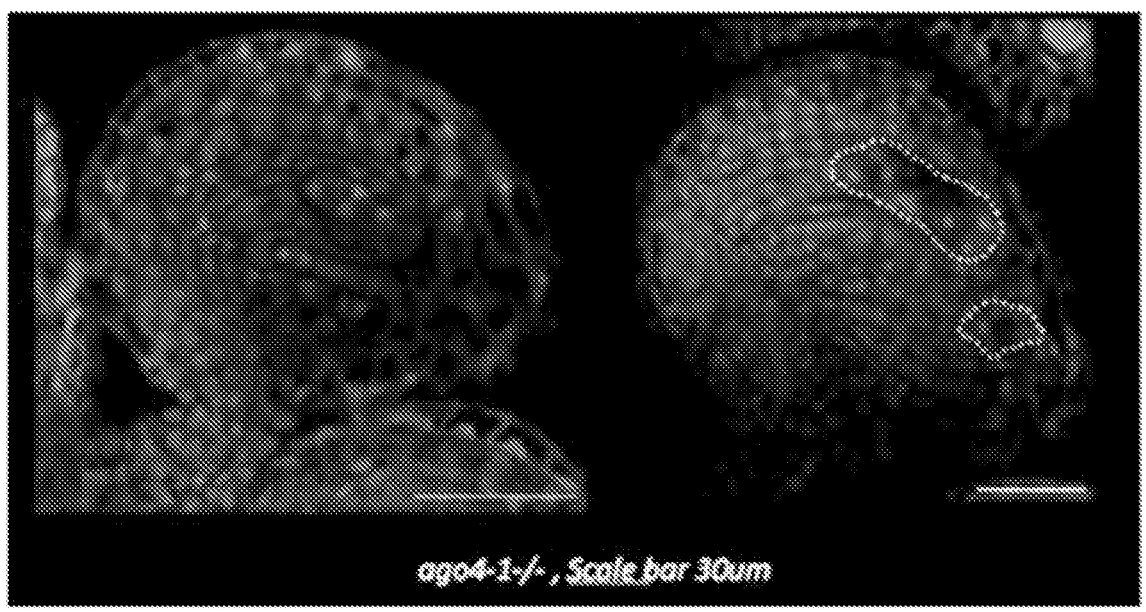
Figures 7A, 7B, 7C, 7D, 7E, 7F:
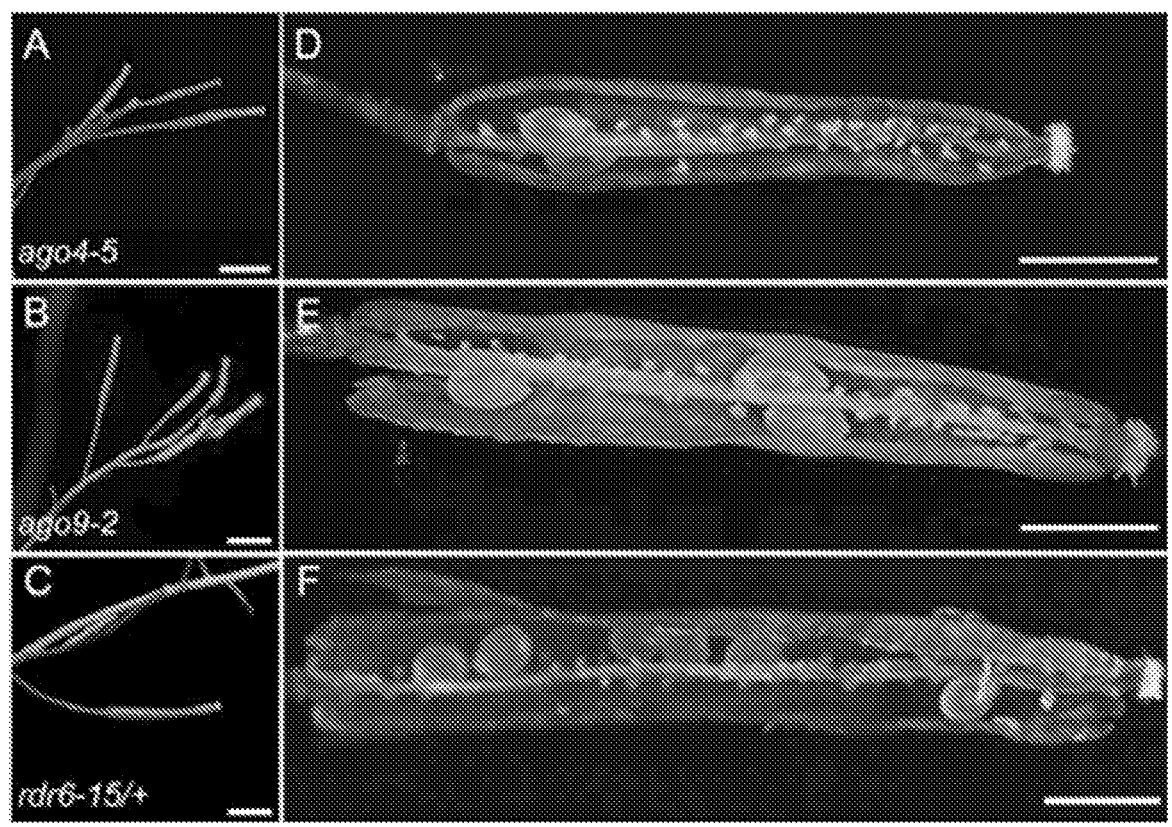
FIGS. 7A-7F show emasculated inflorescences and siliques bearing developing seeds.

Single Gene Mutations Causing Self-propagated Asexual Reproduction Through Seeds (Apomixis) in *Arabidopsis* Description—This example presents experimental results demonstrating the ability to clone a maternal plant through seeds. Results—Previous results showed that dominant mutations in ARGONAUTE9 (AGO9) and RNA-DEPENDENT RNA POLYMERASE6 (RDR6) lead to differentiation of multiple female gametic cells that are able to initiate gametogenesis without undergoing meiosis by a mechanism reminiscent of apospory, a specific type of apomixis (Olmedo-Monfil et al., 2010; Duran-Figueroa and Vielle-Calzada, 2010). This phenotype was also found in mutants of the RNA-dependent DNA methylation (RdDM) pathway such as RNA-DEPENDENT RNA POLYMERASE2 (RDR2) and DICER-LIKE3 (DCL3). Mutations in the 24-nucleotide small RNA binding protein ARGONAUTE4 (AGO4), that is also a key member of the RdDM pathway required for de novo DNA methylation of heterochromatic regions (Law and Jacobsen, 2010), show an equivalent phenotype. Plants heterozygous for ago4-1 or ago4-6 were fertile and did not show signs of seed abortion; however, they showed pre-meiotic ovules with enlarged sub-epidermal cells containing a conspicuous nucleus, and at later developmental stages, several developing female gametophytes ectopically growing at both the micropylar and chalazal regions of the ovule (FIG. 1 and FIG. 6). A complete list of mutants identified as showing these ectopic female gametophytes reminiscent of apospory is provided in FIG. 25. To determine if defects in these mutants could lead to the formation of viable diploid female gametes, heterozygous rdr6-15, ago4-1, and ago9-3 individuals were crossed to wild-type pollen and ploidy levels in the resulting progeny were determined. For all three mutants crossed as a female parent, triploid individuals were recovered at frequencies ranging between 11.3 and 17.1% (FIG. 1), indicating that plants defective in RDR6, AGO4 and AGO9 may form triploid embryos resulting from the fertilization of a diploid female gamete by a haploid sperm cell.

Example 2: Pistillata Plant Analysis

Figures 2A, 2B, 2C:
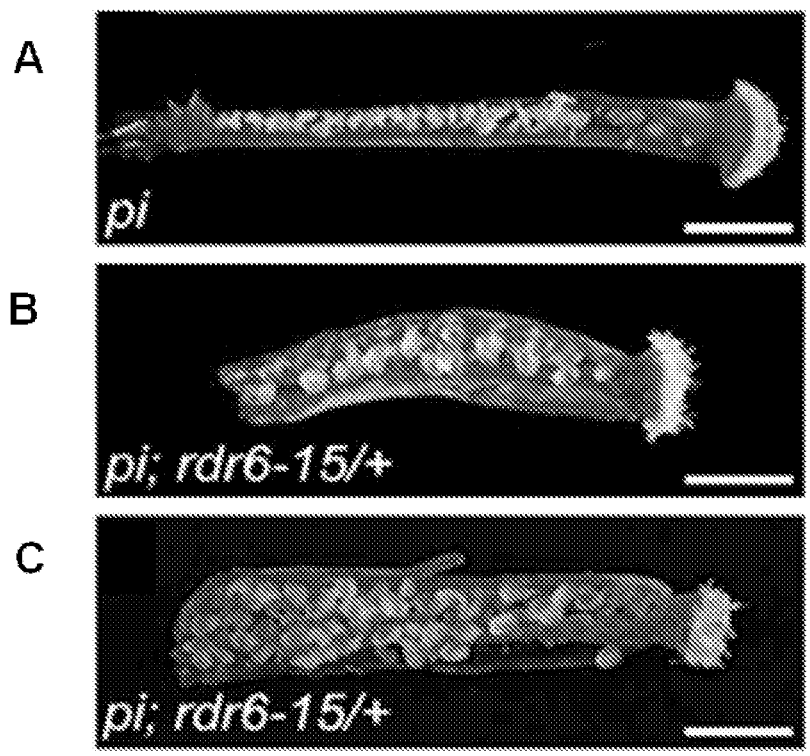
Figures 13A, 13B:
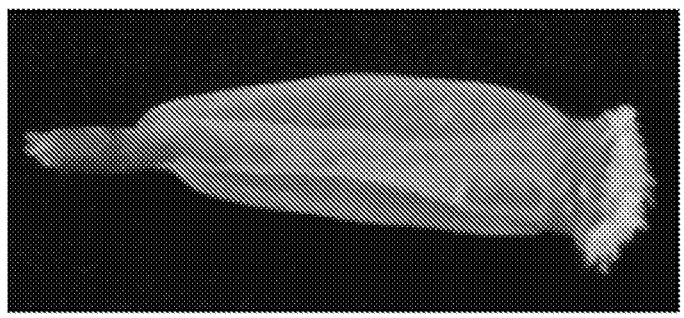
FIGS. 13A and 13B show the quantitation of ploidy levels and seed recovery in nonpollinated pi individuals that carried the mutations pistillata and rdr6-15 or ago4-1. Screening used a male sterile background and showed the potential of small RNA mutants for autonomous seed formation.

To determine if female gametes in some of these mutants are capable of initiating autonomous development of either an embryo or the endosperm, fully male sterile pistillata (pi) plants that completely lack stamens were crossed to homozygous ago4-1 or rdr6-15 individuals, and generated a corresponding F2 population. Previous reports showed that fertilized ovules of pi individuals develop into seeds, but unfertilized ovules remain small and eventually shrivel (Chaudhury et al., 1997). To avoid any cross-pollination, each F2 individual was genotyped before flowering and 79 pi rdr6-15/+, and 122 pi ago4-1/+ or pi ago4-1/ago4-1 diploid plants that were grown to maturity in full isolation from any source of pollen were identified. In contrast to ago4 for which homozygous pi ago4-1 individuals could be recovered, all rdr6-15 F2 segregants showing the pi phenotype were heterozygous for the rdr6-15 allele, a result indicating a male gametophytic lethal effect or a prevalence of clonal seeds. Because the elongation of individual siliques—presumed to be indicative of seed initiation (Ohad et al., 1996; Chadhury et al., 1997)—was not observed in any male sterile individual showing the pi phenotype, each consecutive developing silique was manually dissected from a group of selected pi rdr6-15/+ stems, scoring the number of developing seeds that showed significant enlargement and prevalent turgidity when compared to unfertilized ovules, a morphology comparable to the seeds developing after pollination of the pi plants. No reversion of the pi phenotype was observed in any of the individuals grown to maturity. Strikingly, pi rdr6-15/+ siliques showed an unusual frequency of developing seeds at stages when most ovules present in unpollinated gynoecia of pi control plants have collapsed (FIG. 2A to 2D and FIG. 8). Most of these developing seeds grow and persist for several days without showing dehydration or shriveling. The phenotype was consistently observed in individuals from both F2 and F3 generations. A detailed observation of whole-mount cleared developing seeds showed the presence of free nuclei in the central cell and a developing embryo at the micropylar region, confirming that these plants do initiate the formation of both an embryo and its companion endosperm (FIGS. 2E and 2G). To determine if some of these developing seeds reach maturity, ten diploid F2 and ten F3 individuals showing the pi phenotype and carrying mutations in either rdr6-15 or ago4-1 were systematically harvested and searched for phenotypic evidence of seed formation by manually dissecting each independent silique at maturity. Strikingly, whereas progeny was completely absent in pi controls, all individuals carrying rdr6-15 or ago4-1 mutations produced a variable number of phenotypically normal mature seeds. For pi rdr6-15/+ individuals, the number of seeds per plant ranged between 11 and 125, whereas pi ago4-1/+ and pi ago4-1/ago4-1 plants produced between 10 and 293 seeds per plant, with no clear quantitative distinction between both genotypes or a specific generation (FIG. 5 and FIGS. 13A and 13B).

To determine if this autonomous formation of seeds is the result of a genetic interaction of pi with rdr6-15 and/or ago4-1, or if this phenotype is also present in single gene mutants involved in the RdDM pathway, immature flowers of rdr6-15/+, ago4-6/ago4-6 and ago9-2/ago9-2 individuals were emasculated, and resulting gynoecia were cytologically analyzed seven days after emasculation (dae). As in the case of plants showing the pi phenotype, the number of developing seeds that showed significant enlargement and prevalent turgidity compared to neighboring unfertilized ovules were quantified (FIGS. 7A to 7F, FIGS. 16C; and 17A to 17C). In the case of twelve rdr6-15/+ individuals analyzed (116 emasculated flowers), the average percentage of seeds developing without pollination at seven dae was 26.39%

Figure 20A:
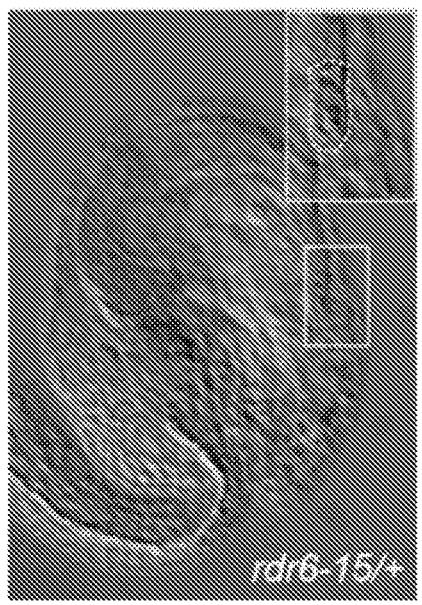
FIGS. 20A-20C show data pertaining to the seed coat formation in non-fertilized ovules. Detailed cytological analysis of non-pollinated wild type and mutant ovules after 7, 10 and 14 DAE confirmed that ago9, ago4, and rdr6 single mutants initiated autonomous seed formation.
Figure 20B:
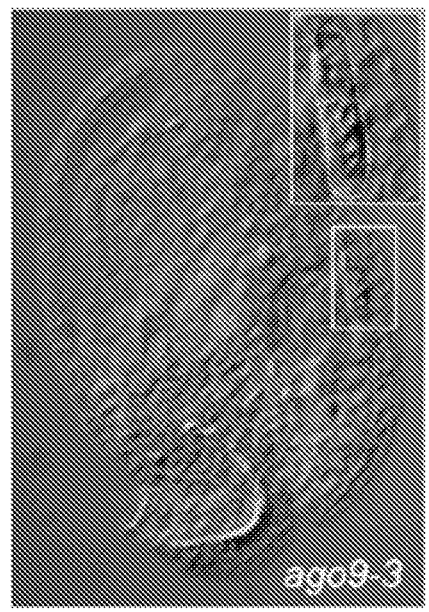
Figure 20C:
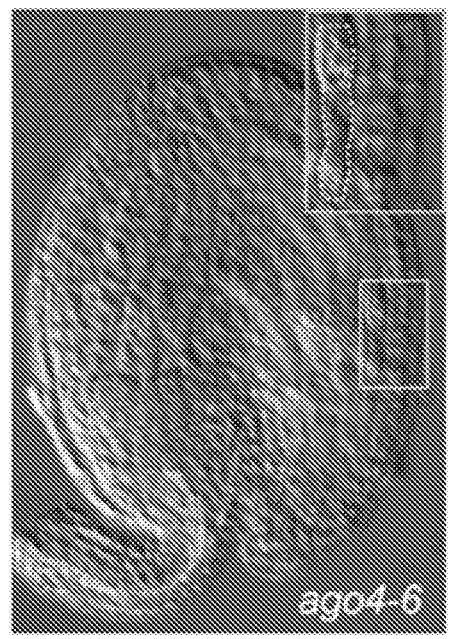
Figures 21A, 21B, 21C, 21D, 21E:
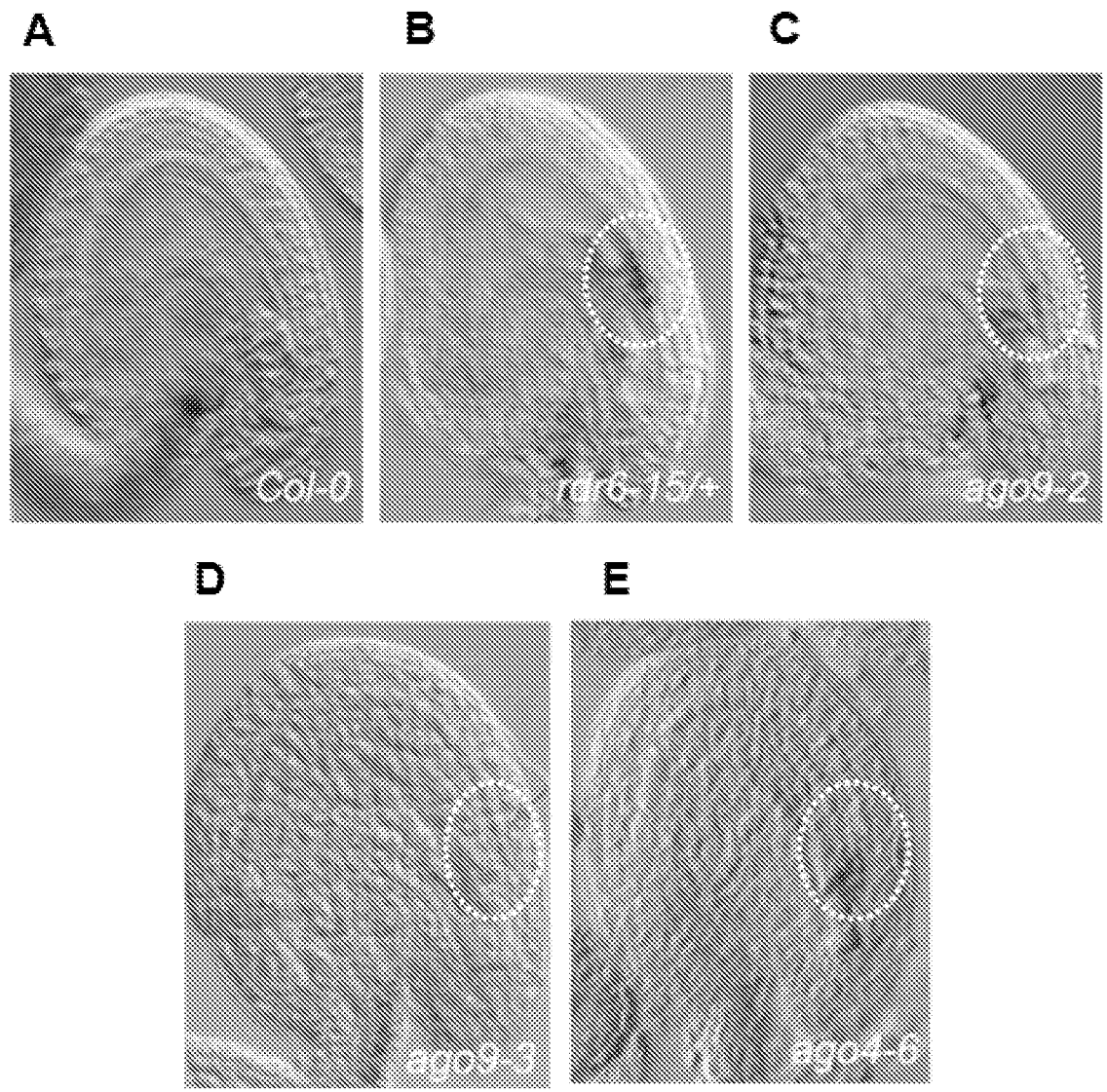
FIGS. 21A-21E show data pertaining to proanthocyanidin accumulation in the endothelium in Col-0, rdr6-15/+, ago9-2, ago9-3, and ago4-6 mutants. Vanilin red staining, as indicated by the white dashed circles, was positive for the presence of proanthocyanidins.
Figure 22A:
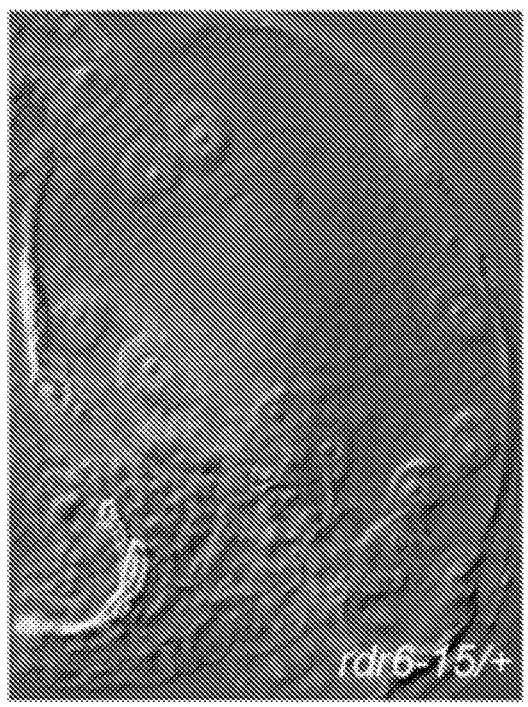
FIGS. 22A-22C show data demonstrating that all three mutants, rdr6-15, ago9-3 and ago4-6, were able to form autonomous endosperms in the absence of pollination.
Figure 22B:
Figure 22C:
Figure 23:
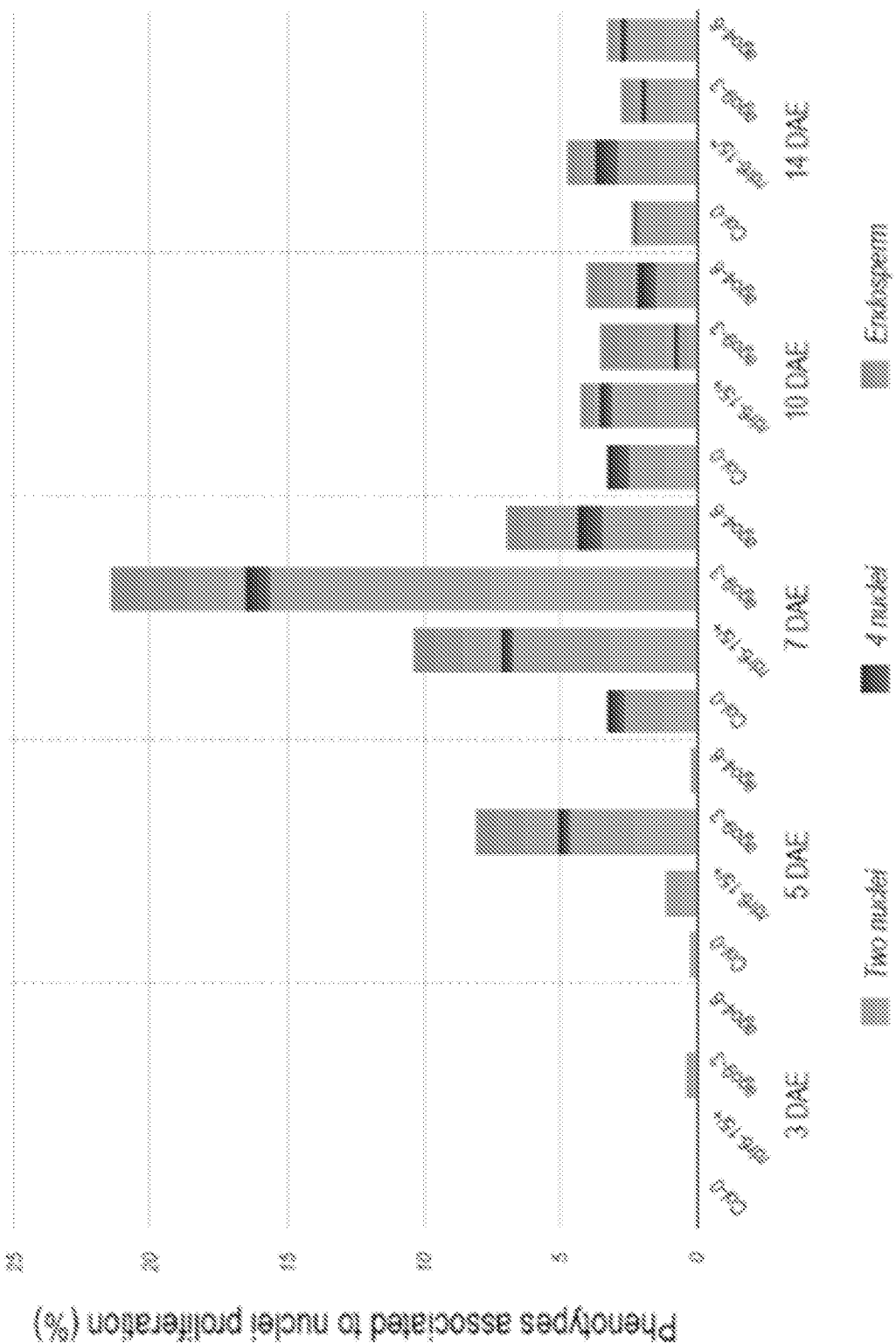
FIG. 23 shows data demonstrating that ago9 ovules showed premature and higher frequency of autonomous endosperm proliferation than ago4 or rdr6.
Figures 24A, 24B, 24C, 24D:
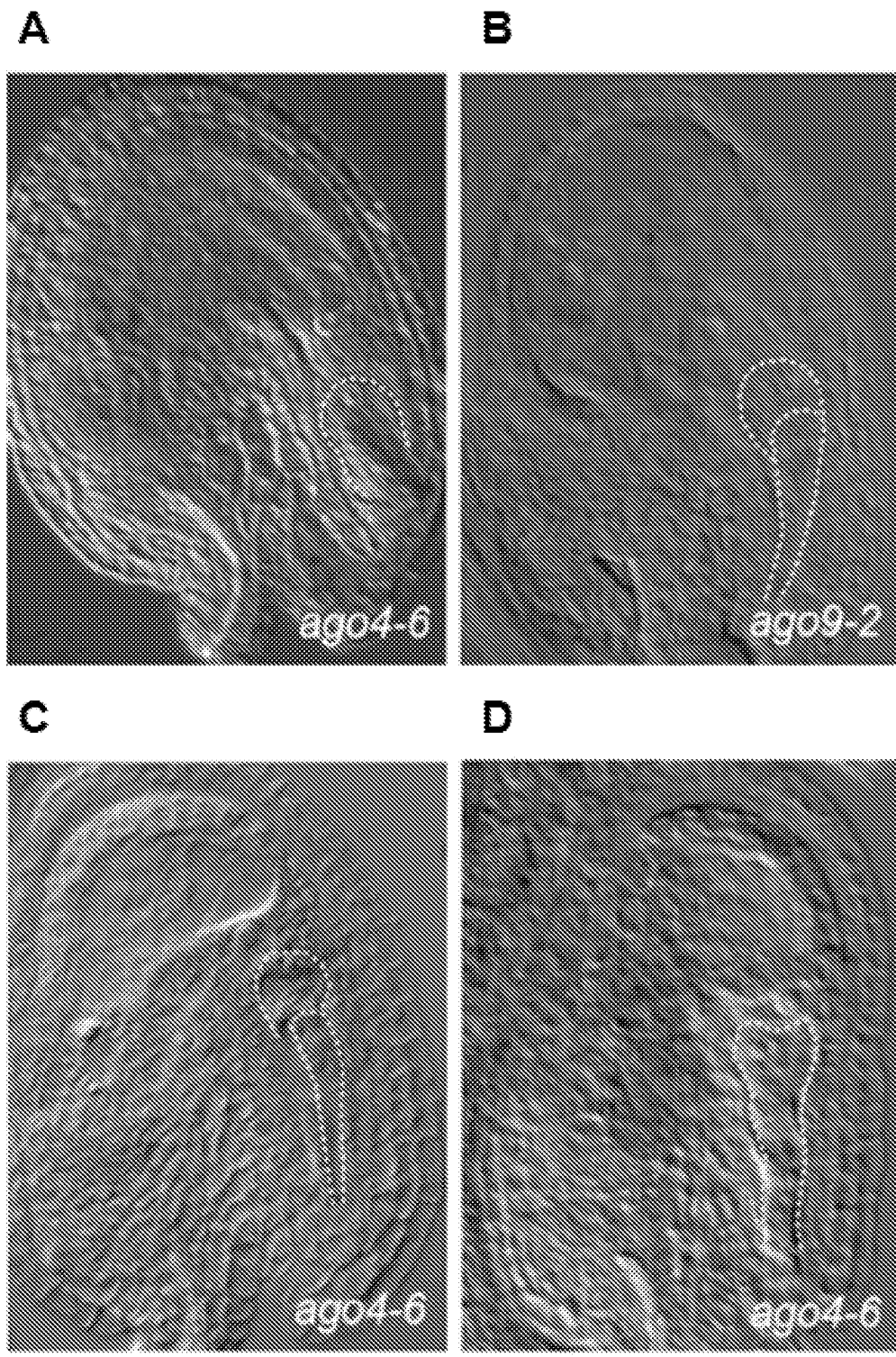
FIG. 24A-24D show data demonstrating that autonomous embryo development was also detected at low frequencies.

(n=5849); in the case of six ago4-6/ago4-6 individuals (68 emasculated flowers), this same average was 37.93% (n=3200); and in the case of eight ago9-2/ago9-2 individuals (103 emasculated flowers), the average was 67.96% (n=4792; FIGS. 9-12). The cytological analysis of some of these seeds confirmed that in most cases they contain a developing embryo and endosperm with morphologies equivalent to wild-type (FIG. 8 to 12; FIG. 3A to 3I and FIG. 18A to 18C). In a handful of cases, mature defective or normal seeds were recovered for all three mutants (FIG. 19A to 19D). Whole-mounted cleared specimens showed that non-fertilized ovules exhibit cytological evidence of seed coat initiation in the endothelial layer (FIG. 20A to 20C). Fertilization of a wild-type female gametophyte triggers the accumulation of proanthocyanidin pigments in the endothelium cell layer, which may be detected as a red stain by a vanillin assay (Debeaujon et al., 2003). In contrast to control unpollinated pistils, autonomously developing seeds showed red staining deposits in the endothelium, confirming that endosperm formation is activated (FIG. 21A to 21E). Many seeds developing in the absence of fertilization contained free nuclei in the central cell, reminiscent of normal endosperm development (FIG. 22A to 22C); for all three mutants the highest percentage was found at 7 dae (FIG. 23). Sporadically, developing seeds exhibited an early embryo (FIG. 24A to 24D). Finally, the analysis of non-pollinated siliques that reached full maturity revealed that all three genotypes are able to form viable seeds that germinate and give rise to diploid plants that are fertile. These results demonstrated that plants defective in RDR6, AGO4 or AGO9 may produce viable and fertile seeds in the absence of pollination.

Figure 14A:
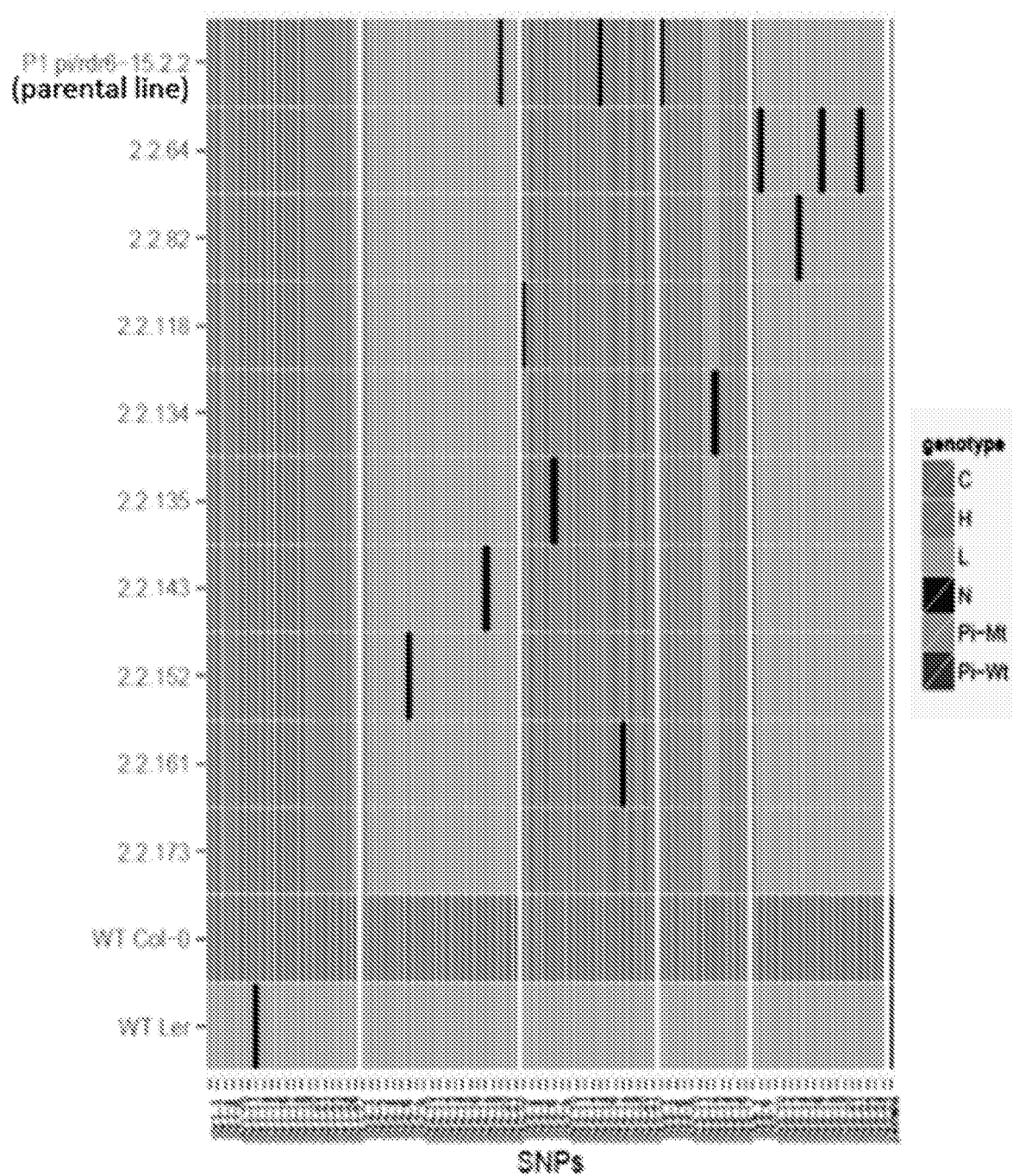
FIGS. 14A and 14B show demonstrating that genotyping using 89 SNPs markers proved that part of the recovered progeny was clonal. The parental lines and progeny were confirmed to be 2n by flow cytometry.
Figure 14B:
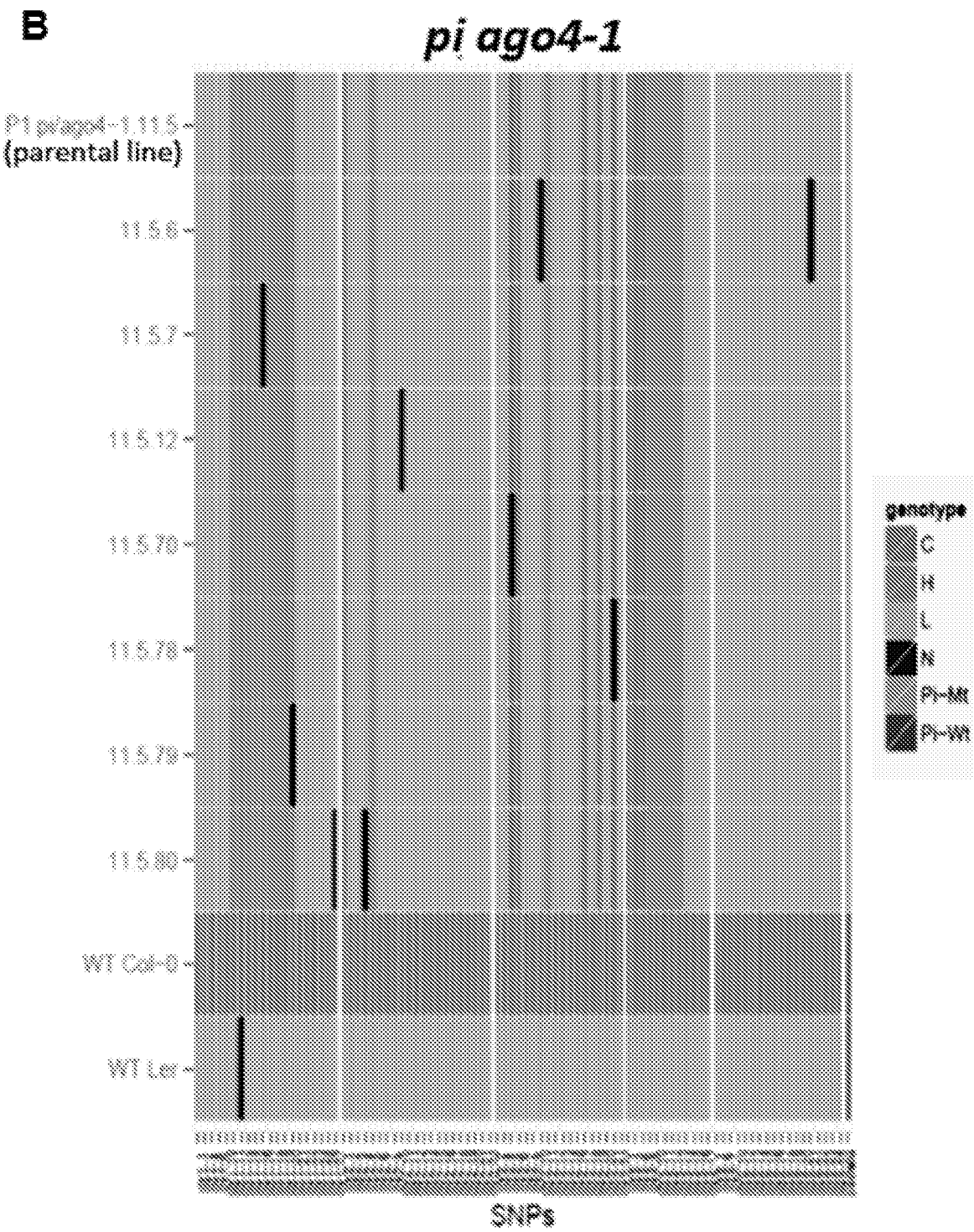
Figure 15A:
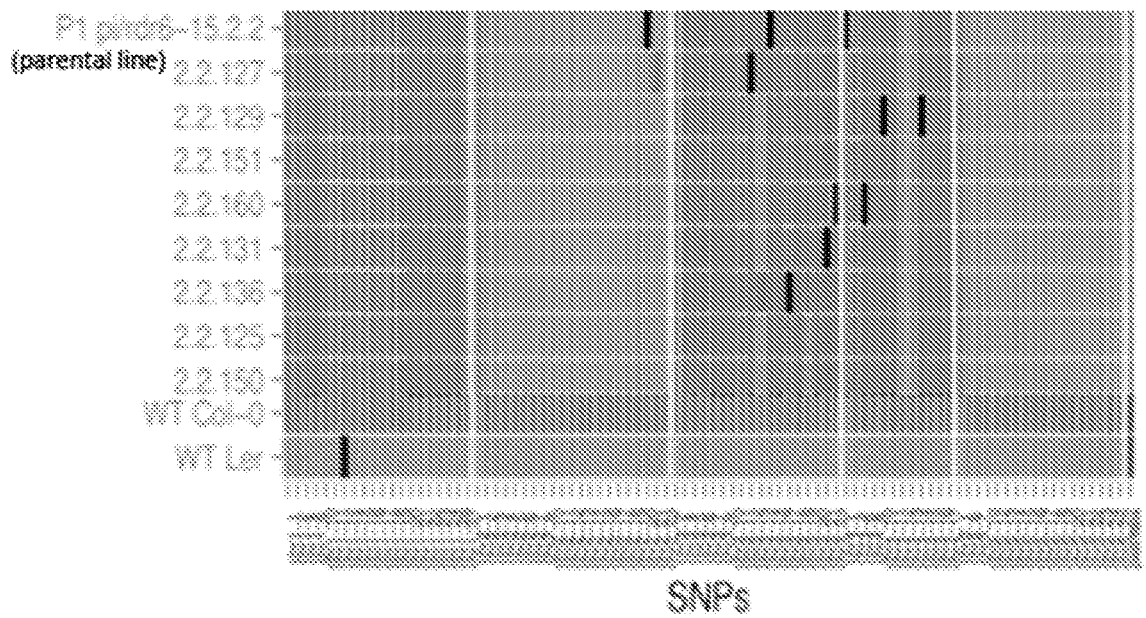
FIGS. 15A and 15B show data demonstrating that individuals showed variation in one or two out of the 89 SNPs with respect to its parental line. The parental lines and progeny were confirmed to be 2n by flow cytometry.
Figure 15B:
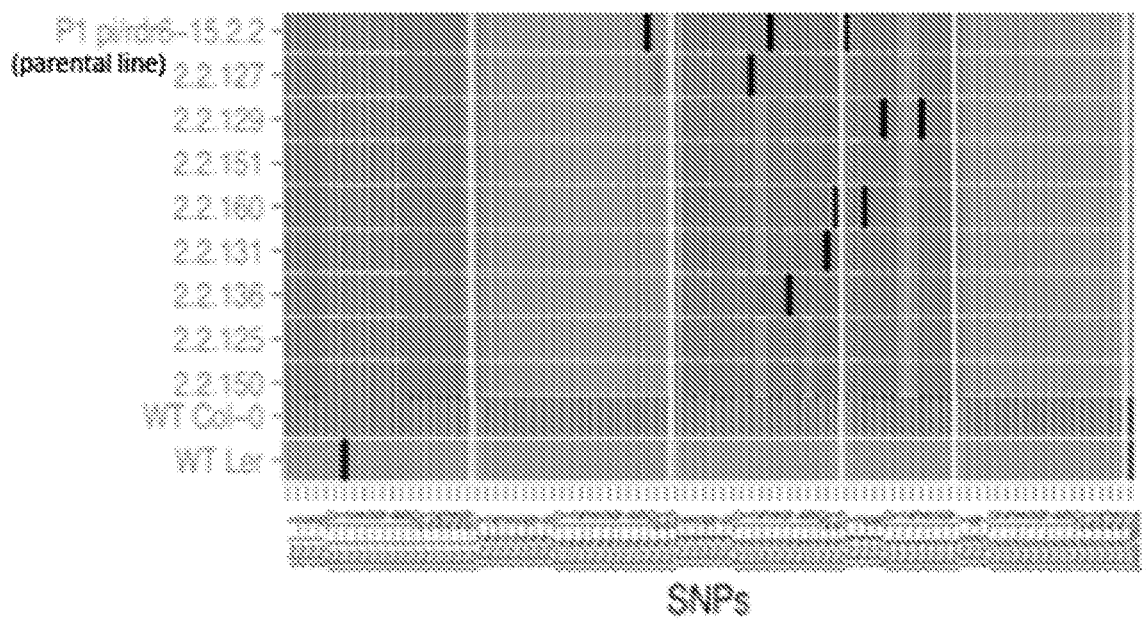
Figure 16A:
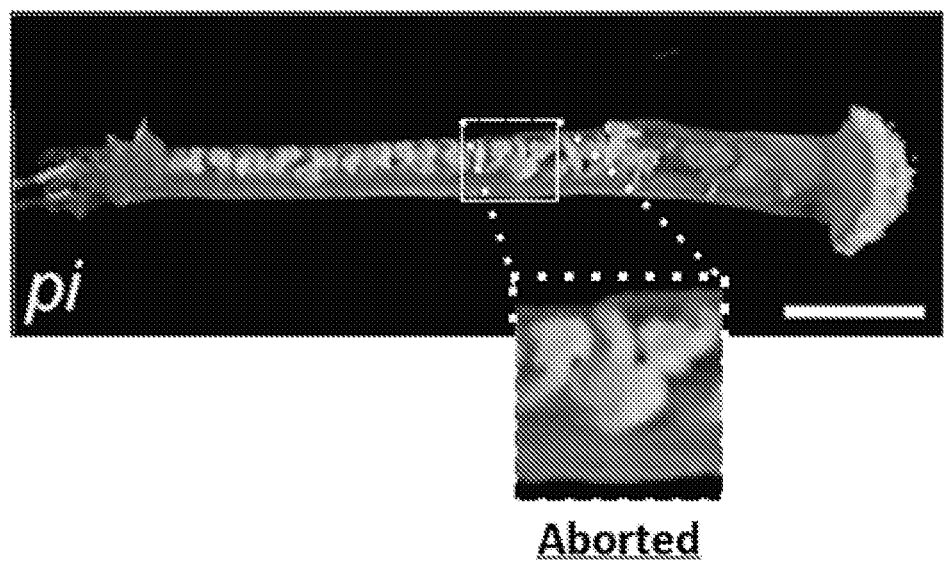
FIGS. 16A-16C show ovules in double mutants (pi rdr-15) were long-lived compared to pistillata controls and exhibited seed-like features.
Figure 16B:
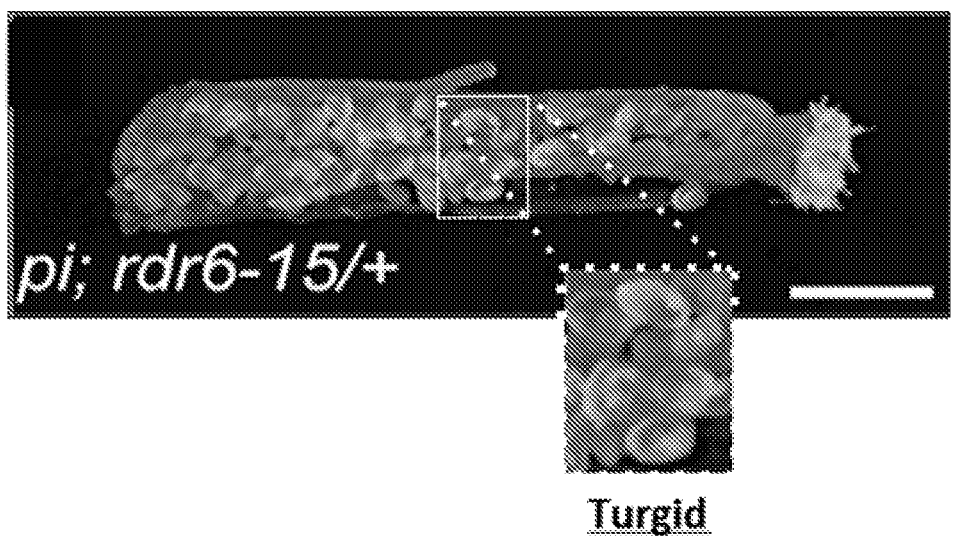
Figure 16C:
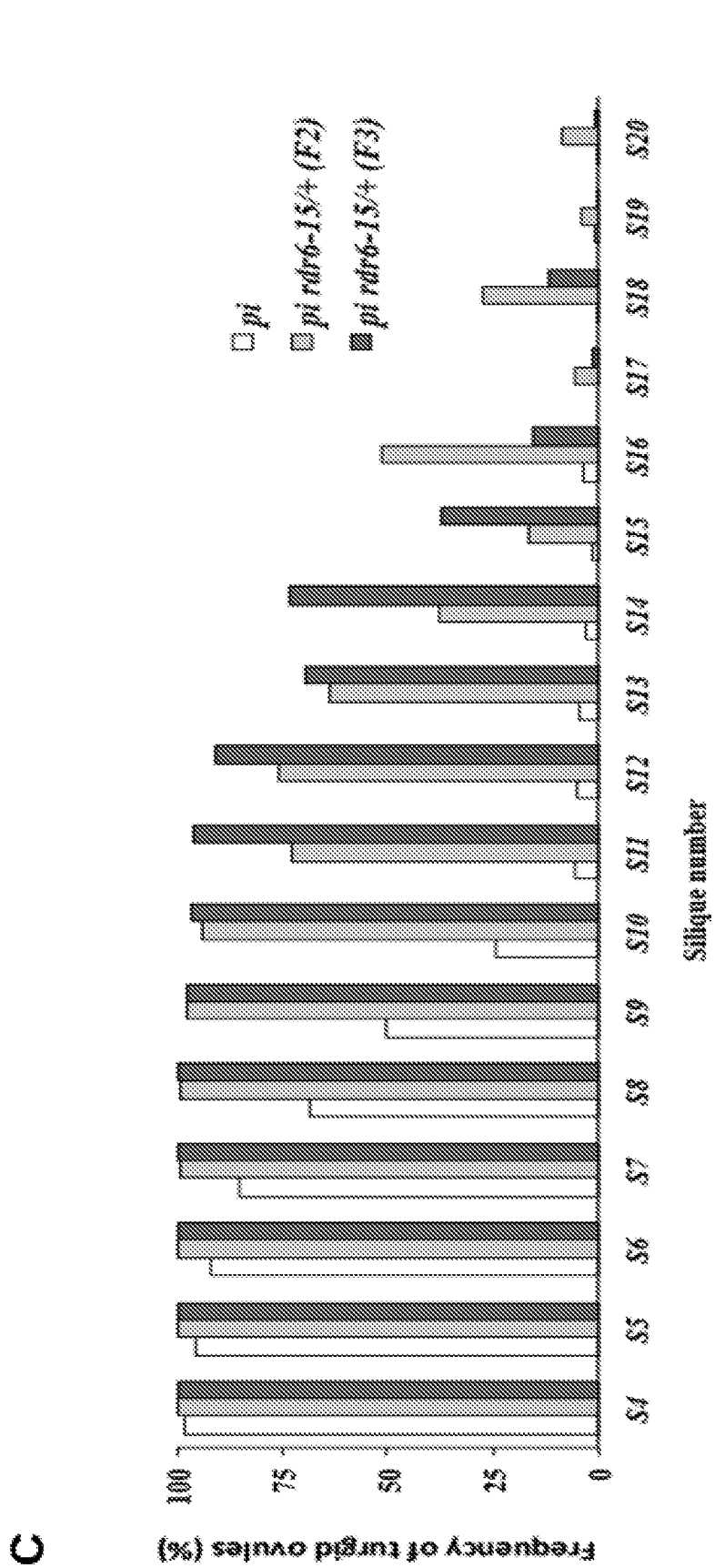
Figure 17A:
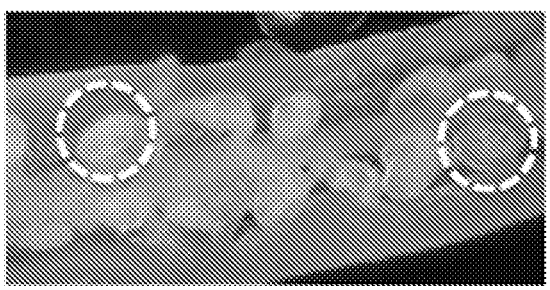
FIGS. 17A-17C show that ago9-2, ago9-3, ago4-6, and rdr6-15/+ exhibited a higher frequency of long-lived ovules after 7, 10 and 14 days after emasculation (DAE) compared to wild-type plants. Without wishing to be bound by a particular theory, the delay of ovule degeneration in the mutant backgrounds could be indicative of the activation of an autonomous seed formation program.
Figure 17B:
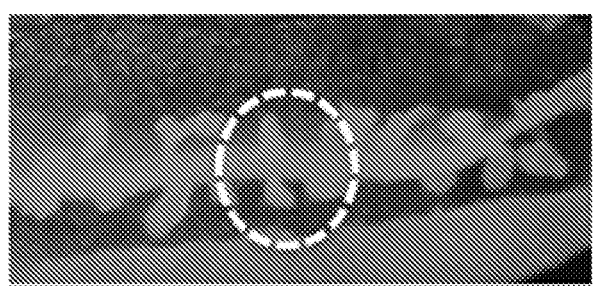
Figure 17C:
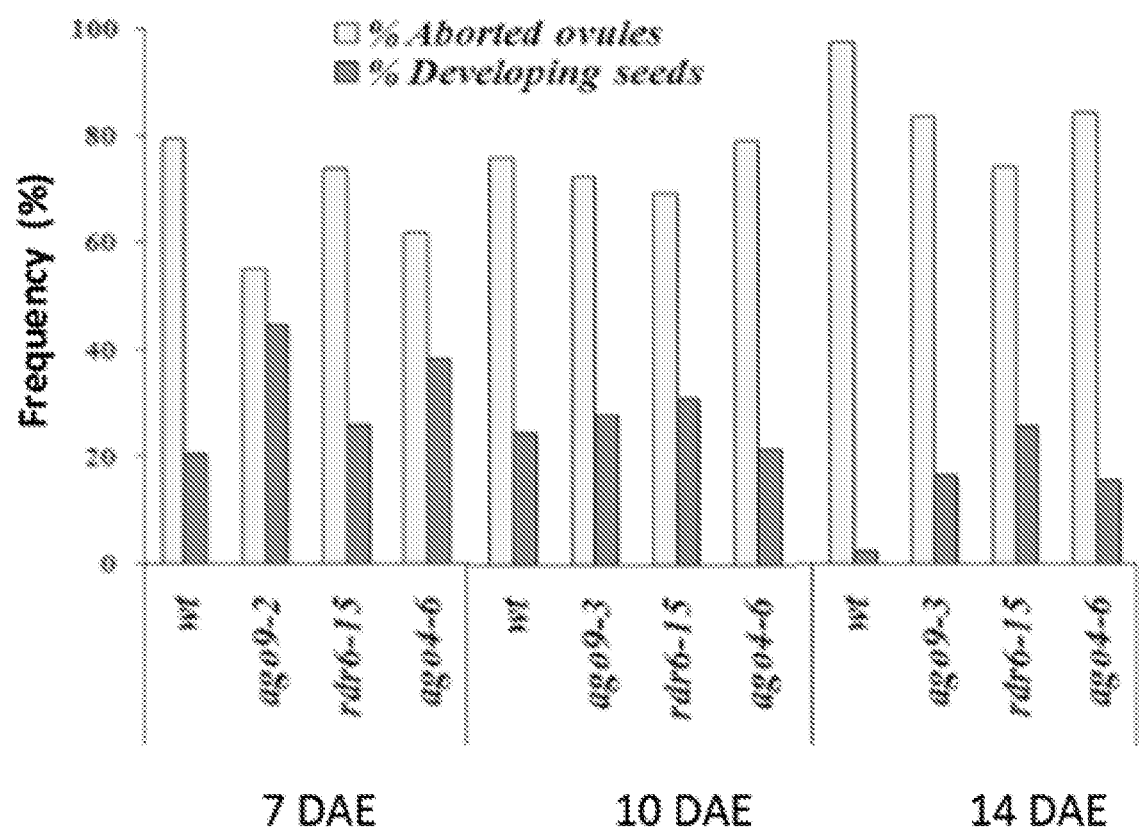
Figures 18A, 18B, 18C, 18D:
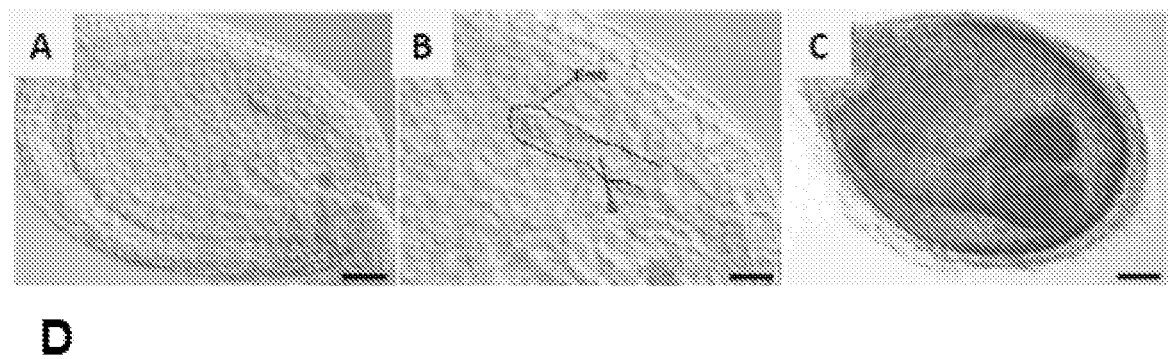
FIGS. 18A-18D show data pertaining to the percentage of seeds recovered from ago4-6, ago9-2, rdr6-15/+, and wild type plants at 7 DAE.
Figures 19A, 19B, 19C, 19D:
FIGS. 19A-19D show data pertaining to the seeds recovered from fully-dried emasculated carpels of more than 30 DAE.

When germinated, seeds recovered from unpollinated pi rdr6-15/+, pi ago4-1/+, and pi ago4-1/ago4-1 individuals gave rise to diploid plants showing the pi phenotype. In the case of pi rdr6-15/+, the genetic background of the parental genotypes differed (pi is in a Landsberg erecta ecotype, whereas rdr6-15 is in Columbia-0), the chromosomal constitution of F3 individuals could be compared to the chromosomal constitution of their diploid progeny generated in the absence of pollination. In the case of ago4/+, a cross to Columbia-0 individuals allowed the establishment of ecotype heterozygosity to precede the subsequent generation of the pi ago4 individuals that were used for genotyping. To this aim, a collection of 89 molecular markers (SSLPs and CAPS) that recognize previously characterized allelic polymorphisms that distinguish both ecotypes across all five *Arabidopsis* chromosomes were used (Bell and Ecker, 1994; Cho et al., 1999; Lukowitz et al., 2000). Among 17 diploid F3 rdr6-15/+ individuals tested, 9 retained the heterozygosity and genotype of their mother at all tested loci and in all five chromosomes, and 8 were nearly clonal as they showed a single-locus polymorphism at different genomic locations (FIGS. 14 and 15). In the case of 13 diploid F3 ago4/+ individuals genotyped, 7 retained the heterozygosity and genotype of their mother at all tested loci and in all five chromosomes, and 5 were nearly clonal as they showed a single-locus polymorphism at different genomic locations (FIGS. 14 and 15).

These results demonstrate that these two independent mutants may consistently produce clonal seeds.

The results show that self-propagated asexual reproduction through seeds may be induced in *Arabidopsis* by single mutations affecting genes involved in RNA-dependent DNA methylation, a discovery indicating that transcriptional repression of repetitive genomic regions, most often associated with heterochromatin, is essential for avoiding both ectopic gamete formation and the autonomous parthenogenetic activation of gametic cells (the egg and central cell). The mechanism uncovered is highly reminiscent of autonomous apomixis of the aposporous type, a phenomenon naturally occurring in flowering species of the genus *Lamprothyrsus*, and *Hieracium* (Bicknell et al., 2000). The frequency of autonomous initiation of seed development is superior to the frequency at which viable asexual seeds are recovered in the absence of pollination for both rdr6-15 and ago4-1. Non-pollinated siliques often contain seeds showing a multicellular embryo in the absence of free nuclear proliferation of the endosperm that eventually collapse, indicating that fertilization of the central cell might be necessary for the formation of viable asexual seeds by a mechanism reminiscent of pseudogamy in natural apomicts (Nogler, 1984). The results indicate the induction of self-propagated asexual reproduction through seeds by altering the activity of a single gene in cultivated crops.

Example 3: *Arabidopsis* Plant Material Analysis

*Arabidopsis thaliana* seeds of rdr6-15 (SAIL_34_G10), ago4-1 (CS6364), ago4-6 (SALK_071772), ago9-2 (SALK_11205), and ago9-3 (SAIL 34_G10) were germinated in Murashige and Skoog (MS) medium supplied with either kanamycin (50 ug/ul) or ppt (10 u/ul) and germinated in a growth chamber under short day conditions (16 hr light/8 hr dark) at 25° C. Seedlings were then transplanted to soil and grown in a greenhouse at 21° C.

Example 4: Genetic Analysis and Flow Cytometry i. Plant Growth

Adult double and single mutant individuals (pi rdr6, rdr6, pi ago4, ago4, and ago9) were classified according to developmental stage, and siliques were numbered according to their sequential position in primary stems. The first flower that had fully lost additional floral organs was tagged as Silique #1, and subsequent older siliques were given a consecutive number. Individual siliques were dissected under a Leica stereomicroscope and scored for ovule abortion and developing seed formation. In the case of individuals showing a pistillata phenotype, all fully mature siliques were individually and systematically analyzed at maturity but before dehiscence with the help of magnifying glasses, keeping a register of the position of siliques containing at least one seed, and the number of seeds per silique. In the case of emasculated single mutant individuals, 3 to 4 immature flowers were emasculated before maturity, eliminating all stamens and floral organs except the gynoecium. Seven days after emasculation, each silique was dissected under a stereo-microscope and scored for aborted ovules and developings seeds.

For flow cytometry, developing cauline leaves were used for all plants and processed as described in Dolezel et al 2007. DNA content was estimated with a PARTEC CUBE flow cytometer. Results of these methods are provided in FIGS. 2D, 5, 8, 9, 10, 11, 12, 13, 17C, 18D, and 19D.

ii. Whole-Mount Preparations and Histological Analysis

Developing siliques from wild-type, mutant or transformant lines were dissected longitudinally with hypodermic needles (1-mL insulin syringes; Becton Dickinson) and either fixed with FAA buffer (50% ethanol, 5% acetic acid, and 10% formaldehyde), dehydrated in increasing ethanol concentration, and cleared in Herr's solution (phenol:chloral hydrate:85% lactic acid:xylene:oil of clove [1:1:1:0.5:1]); or directly cleared in a drop of Hoyer's solution as previously described (Vielle-Calzada et al., 2000). For advanced stages of seed formation, seeds were punctuated to release the embryo; cleared seeds were observed in a Leica microscope (Wetzlar, Germany) under Nomarski optics. For vanillin staining, ovules and seeds were dissected from pistils and siliques, respectively, and incubated in an acidic solution (6 N HCl) of 1% (w/v) vanillin (Sigma-Aldrich) at room temperature (Aastrup et al., 1984), and mounted in a drop of glycerol. Vanillin reacts in the presence of proanthocyanidins that specifically accumulate in the endothelium layer of the seed coat, generating a red product (Debeaujon et al., 2003). Results of these methods are provided in FIGS. 2D to 2G, 3A to 3I, 6A and 6B, 18A to 18C, 20A to 20C, 21A to 21E, 22A to 22C, and 24A to 24D)

iii. Molecular Genetic Analysis

DNA extractions were performed as described in Vielle-Calzada et al., 1999; 1 µl of DNA was used for PCR amplification with 2 mM MgCl2, 0.2 mM of each dNTP, 1 U of Taq DNA polymerase (Invitrogen), 13 µL PCR buffer, and 20 pmol of each primer for 30 cycles at a variable annealing temperature depending on the marker as described for microsatellite markers and primer sequences obtained from TAIR (arabidopsis.org). Results of these methods are included in FIGS. 4, 14, and 15.

iv. Genotyping

Seeds from all F3 individuals for both pi rdr6/+ and pi ago4/+ genotypes were germinated under growth chamber under short day conditions (16 hr light/8 hr dark) at 25° C. and total DNA extractions were conducted at rosette stage. Single nucleotide polymorphism (SNP) was obtained using a uniplex SNP genotyping platform for Kompetitive Allele Specific PCR (KASP), a global benchmark technology commercially provided by LGC Genomics (Beverly Mass. USA). Results of this method are provided in FIGS. 14 and 15.

Example 5: Exemplary Embryo Markers and Exemplary Gametocides

Corn-Maize: An Embryo Marker for Detecting Monoploids Of Maize (Zea Mays L.)D. K. Nanda and S. S. Chase The use of an embryo marker of commercial value for detecting monoploids of maize is described. This system utilizes a male parent called the Purple Embryo Marker (b pl A C Rnj:Cudu or Pwf) which produces a deep purple pigment in the embryo and red or purple aleurone color in the endosperm. Kernels of a marked progeny which do nol exhibit purple color in the embryo but do have red or purple aleurone pigment are saved for the putative monoploid embryos contained. In this study, nine single crosses of commercial value were pollinated with the Purple Embryo Marker slock. Of the 194, 157 kernels classified, it was possible to discard more than 98% before germination, from 1-rom the kernels with putative monoploids 201 actual monoploids were realized. Purple Embryo Marker: produces a deep purple pigment in the embryo. Nanda D K and Chase S S. 1966. An embryo marker for detecting monoploids of maize. Crop Science Vol. 6 (2): 213-215.

Rice: Rocl—marks the epidermal layer of the embryo. Kamiya N Nishimura A Sentoku N Takabe Nagato H Matsuoka M. 203. Rice globular embryo4 (gle4) mutant is defective in radial pattern formation during embvryogenesis. Plant Cell Physiology 44(9): 875-83

REE5 and REE8—only expressed in the whole embryo
Reference:Kikuchi K, Chung C S Yoshida K. 1998. Isolation and Analysis of New Molecular Embryogenesis in Rice (Oryza sativa L.). Plant Biotechnology 15(2):77-81.

goliath—embryo size marker, the mutation makes the embryos larger

Reference:
Kawakatsu T Taramino G Itoh J allen J Sato Y Hong S K Yule R Nagasawa N goliath—embryo size marker, the mutation makes the embryos larger Reference:Kawakatsu T Taramino G Itoh J allen J Sato Y Hong S K Yule R Nagasawa N Kojima M Kusaba M Sakakibara H Sakai H Nagato Y. 2009.

PLASTROCHRON3/GOLIATH encodes a glutamate carboxypeptidase required for proper development in rice. *Plant Journal* 58(6):1028-1040

Wheat:
Anthocyanin purple pigment

Reference: K. M. Doshi, F. Eudes, A. Laroche, and D. Gaudet. 2007. Anthocyanin expression in marker free transgenic wheat and triticale embryos. Vitro Cellular and Developmental Biology—Plant, 43(5):429-435

Sorghum:
Promoter pPZP201 fused to GFP as a reporter gene

Reference: Gurel S Gurel E Miller t Lemaux P G. 2012. *Agrobacterium*-Mediated Transformation of *Sorghum bicolor* Using Immature Embryos. In Transgenic Plants; Methdos and Protocols Series No. 847: 109-122

Sunflower:
p35CaMV::uida fusion

Reference: Burrus M Molinier J Himber C Hunold R Bronner R Rousselin P Hahne G. 1996. Agrobacterium-mediated transformation of sunflower (*Helianthus annuus* L.) shoot apices: transformation patterns. Molecular Breeding 2; 329-338.

Coffee:
p35CaMV::GFP fusion

Reference: Mishra M Devi S McCormac Scott N Chen D Elliott M Slater A. 2010.

Green fluorescent protein as a visual slection marker for coffee transformation. Biologia 65:639-646.

Faba bean:
Natural mutation il-1—Green cotyledons.

Reference: G. Ducl, F. Moussyl, X. Zong2, G. Ding. 1999. Single gene mutation for green cotyledons as a marker for the embryonic genotype in faba bean, *Vicia faba*. Plant Breeding 118 (6):577-578.

*Arabidopsis:*
ET1275—Encodes a COP1-interacting protein named CIP8.

ET1278—Encodes a isoflavone reductase homolog.

Reference: Vielle-Calzada Jp, Baskar R, and Grossniklaus U. 2000. Delayed activation of the paternal genome during seed development. *Nature* 404: 91-94.

Plant Gametocides
maleic hydrazide (MH)

WITTWER, S. H., and HILLYER, I. G., 1954. Chemical induction of male sterility in Cucurbits. Science, 120, 893-894.

2,4-dichloropheno-xyacetic acid (2,4-D)

REHM, S., 1952. Male sterile plants by chemical treatment. *Nature* 170, 38-39.

a-naphthalene acetic acid (NAA)

LAIBACH, F., and KRIBBBN, F. J., 1950. Der Einfluss von Wuchsstoff auf die Blutenbildung der Gurke. Naturwuienschaften 37, 114.

ri-iodoben2oic acid (TIBA)

ATON, F. M., 1957. Selective gametocide opens way to hybrid cotton. *Science*, 1174-1175

Additional references to gametocides are found herein below.

Example 6: Creation of Hybrid Male-Sterile Progeny with Seeds Comprising Parthenogenically-Derived Clonal Embryos In this example, a male-sterile inbred is heterozygous for a dominant sterility gene, homozygous for an unlinked gene conferring defective RdDM activity, and hemizygous for a construct that comprises (1) a suppression element, for example an inverted repeat (IR) engineered to the promoter controlling expression of the dominant male-sterile gene or the coding region encoding the dominant male-sterile gene; and (2) a pollen ablation gene which results in disruption of the formation, function, or dispersal of pollen; and optionally (3) a marker gene, which may be a seed color gene. The suppression element disrupts expression of the dominant male-sterile gene, such that the otherwise male-sterile plant is male-fertile and can be selfed. Because the ablation gene prevents linked transgene transmission through pollen, any resulting sexually derived progeny will segregate 50:50 with respect to the hemizygous construct and 25% of the sexually derived progeny will be homozygous for the dominant male-sterility gene and 100% of all progeny will be homozygous for the gene conferring defective RdDM activity. Seeds comprising the parthenogenically-derived clonal embryos can be determined as described elsewhere herein. Seeds containing the construct can be identified by presence of the marker. Progeny plants from the seed can be genotyped to identify homozygous dominant male-sterile progeny with the construct and homozygous for the gene conferring defective RdDM activity; these plants are collectively referred to as the maintainer line (or "transgenic maintainer" line). Progeny homozygous for the dominant male-sterile gene, and homozygous for the gene conferring defective RdDM activity without the construct are collectively referred to as the male sterile female inbred (or "male-sterile inbred" line).

The male-sterile inbred comprising seed with parthenogenically-derived clonal embryos can be increased by crossing the maintainer line onto male sterile inbred lines. The resulting clonal and sexually derived progeny are homozygous dominant male-sterile female inbreds, homozygous for the genes defective for RdDM activity, because the maintainer construct is not passed through pollen to progeny. In this way the transgenic maintainer line is used to maintain, propagate, or increase male sterile plants comprising seed with parthenogenically-derived clonal embryos.

In a hybrid production cross, the male inbred crosses normally onto this male-sterile inbred line, and no emasculation is required. However, because the dominant sterility gene is a dominant male-sterile gene and is homozygous in the female inbred, 100% of the hybrid seed will contain one dominant male-sterile allele and one gene defective for RdDM activity, and plants produced from those seed will be male-sterile.

In some embodiments, rather than being homozygous for a gene conferring defective RdDM activity, the inbred is homozygous for a second construct, wherein the second construct comprises an inducible promoter operably linked to a second suppression element that disrupts expression of a gene conferring RdDM activity. The second suppression element may be an inverted repeat (IR) engineered to the promoter controlling expression of the gene conferring RdDM activity or to the coding region of the gene conferring RdDM activity. The second suppression element may be an artificial microRNA. The second element may confer genetic, epigenetic, post-transcriptional or post-translational modifications. At the appropriate stage, the inbred or its hybrid progeny can be treated with an inducer to suppress RdDM activity, in order to facilitate clonal seed production. In other embodiments, RdDM activity and/or male fertility is controlled using CAS9/CRISPR technology. In other embodiments, suppression is activated by crossing two parent plants containing complimentary components for suppression induction (see, for example, patent application publication # US20120266324).

Example 7: Dominant Male Sterility in Hybrids

A dominant male sterility gene is introgressed into an inbred maize line. Since this gene acts dominantly, selfing of these lines is not possible and the mutation will segregate 50:50 in resulting outcrossed progeny. Linked genetic markers may be employed to identify those seeds or plants containing the dominant male sterility gene so they can be selected for pollination by a maize male inbred line to create F1 hybrid seed. Again this hybrid seed will segregate 50% for male sterility. An alternative approach is to use a transgenic dominant male sterility gene for dominant sterility. This gene would be linked to a seed marker gene and transformed into an inbred line. Seed from this line could then be sorted based on the presence of the seed marker gene to ensure a pure population of dominant male-sterile progeny. These progeny would then be crossed with a male inbred in a hybrid production field to yield 50% male sterility in the resultant hybrid progeny.

Example 8: Cytological Abnormalities in Ago4 are Reminiscent of Apospory

Previous results showed that dominant mutations in ARGONAUTE9 (AGO9) and RNA-DEPENDENT RNA POLYMERASE6 (RDR6) lead to ovules showing multiple MMC-like cells that are able to initiate gametogenesis without undergoing meiosis by a mechanism reminiscent of apospory, a specific type of apomeiosis that often leads to asexual reproduction through seeds or apomixis. This phenotype was also found in other mutants of the RNA-directed DNA methylation (RdDM) pathway such as RNA-DEPENDENT RNA POLYMERASE2 (RDR2) and DICER-LIKE3 (DCL3).

i. Cytological Method

Plants were grown under growth chamber conditions at 24 degrees Celsius, and under 16 hours light/8 hours dark photoperiod regime. Developing flower buds of heterozygous and homozygous ago4-1 or ago4-6 individuals were dissected to isolate the immature gynoecium. Samples were fixed in FPA (1:0.5:7 formalin:propionic acid:ethanol) at 4 degrees Celsius for 12 hours. Samples were treated with 50 µl of a RNAse solution containing 30 µl of 5M NaCl, IM Tris/HCl (pH=8), and 9 ml of distilled water and subsequently stained for 2 hours in a solution containing 17.4 mg L-arginine and 10 mg of propidium iodide (pH=12.4 adjusted with 5M NaOH) in distilled water. Images were captured on a laser scanning confocal microscope (Leica).

ii. Immunolocalization Method

Developing gynoecia were fixed in paraformaldehyde (1×PBS, 4% paraformaldehyde, 2% Triton), under continuous agitation for 2 h on ice, washed three times in 1×PBS, and embedded in 15% acrylamide:bisacrylamide (29:1) over pre-charged slides (Fisher Probe-On) treated with poly-L-Lys as described (Bass et al., 1997). Gynoecia were gently opened to expose ovules by pressing a coverslip on top of the acrylamide. Samples were digested in an enzymatic solution composed of 1% driselase, 0.5% cellulase, 1% pectolyase (all from Sigma) in 1×PBS for 60 min at 37° C., subsequently rinsed three times in 1×PBS, and permeabilized for 2 h in 1×PBS:2% Triton. Blocking was 1% BSA (Roche) for 1 hour at 37° C. Slides were then incubated overnight at 4° C. with an ASY1 Arabidopsis primary antibody used at a dilution of 1:100. Slides were washed for 8 h in 1×PBS:0.2% Triton, with refreshing of the solution every two hours. The samples were then coated overnight at 4° C. with secondary antibody Alexa Fluor 488 (Molecular Probes) at a concentration of 1:300. After washing in 1×PBS:0.2% Triton for at least 8 h, the slides were incubated with PI (500 µg mL$^{-1}$) in 1×PBS for 20 min, washed for 40 min in 1×PBS, mounted in PROLONG medium (Molecular Probes) overnight at 4° C. Serial sections on Stage 1 ovules were captured on a laser scanning confocal microscope (Zeiss LSM 510 META), with multi-track configuration for detecting PI (excitation with DPSS laser at 568 nm, emission collected using BP: 575-615 nm) and Alexa 488 (excitation with Argon laser at 488, emission collected using BP: 500-550). Laser intensity and gain was set at similar levels for all experiments. Projections of selected optical sections were generated using ImageJ (Schneider et al., 2012)

iii. Results

The results in this example demonstrate that mutations in the 24-nucleotide small RNA (sRNA) binding protein ARGONAUTE4 (AGO4) show an equivalent phenotype. Contrary to wild-type individuals (FIG. 26A), plants heterozygous for ago4-1 or ago4-6 were fertile but showed pre-meiotic ovules with several enlarged sub-epidermal cells containing a conspicuous nucleus (FIGS. 26B and 26C). Results were equivalent for both mutant alleles. A the end of megasporogenesis, most ovules exhibited a variable number of enlarged ectopic cells adjacent to a single tetrad composed of three degenerated and one functional megaspore (FIG. 26D), suggesting that a single pre-meiotic precursor underwent meiosis while differentiated ectopic cells persisted without dividing.

Contrary to wild-type that invariably showed a single functional megaspore (FIG. 26E), in rare occasions mutant ovules exhibited two functional megaspores, suggesting that twin meiotic division occurred from two distinct meiotic precursors within a single ovule (FIG. 26F). After meiosis, ovules showed two female gametophytes ectopically growing in the ovule at variable frequencies ranging from 5 to 11% (FIG. 26G), suggesting that that enlarged ectopic cells can initiate gametogenesis without undergoing a prior meiotic division.

To further determine if developmental defects found in ago4 during early ovule development are at the molecular level equivalent to natural mechanisms prevailing in species reproducing by asexual reproduction through seeds (apomixis), we compared the expression of meiotic markers such as ASYNAPSISI (ASY1) in developing ovules of ago4 to the expression of this same marker in genotypes of *Boechera stricta* that reproduce either sexually or by apomixis. ASY1 is a protein that contributes to forming the central element of the synaptonemal complex, the structure that holds homologous chromosomes together during meiosis. In the wild-type ovule of *Arabidopsis*, ASY1 is only expressed in the megaspore mother cell (MMC) during prophase I. Using a whole mount immunolocalization protocol developed in our group (Escobar Guzman et al, in press), we have shown that contrary to the sexual genotype of *B. stricta* in which a single MMC enters meiosis, numerous cells in the ovule of apomict of *Boechera stricta* show ASY1 localization (FIGS. 27A and 27B). This occurs irrespective of their differentiation state, suggesting that apomict development is characterized by an ectopic deregulation of meiosis in the nucellus. In ago4, ASY1 is also localized in several cells of the nucellus (FIG. 27C-FIG. 27F), suggesting a deregulation of meiosis equivalent to the one occurring in the apomictic but not the sexual genotype of *Boechera stricta*. These results confirms that in ago4, ovules undergo developmental abnormalities that are reminiscent of natural mechanisms of apomixis.

Example 9: Low Frequencies of Clonal Seeds are Recovered in pi rdr6 and pi ago9 (Plants Grown Under Complete Absence of Pollination)

Genotypes were grown under growth chamber conditions at 24 or 28 degrees Celsius, and under 16 hours light/8 hours dark photoperiod regime, or under greenhouse conditions at an average temperature of 26 to 28 degrees Celsius, and 13.5 hours daylight/10.5 night photoperiod regime, in an empty and clear greenhouse where no male fertile germplasm was growing. A total of 50 individuals per genotype were manually harvested by carefully opening the main stem from Silique #4 to Silique #20, Silique #4 being the youngest silique that has separated from the apical inflorescence in the primary stem, and consecutive siliques are numbered top to bottom. Each silique was manually dissected under a stereomicroscope and each ovule was analyzed to determine it accumulated anthocyanins as a marker of seed initiation.

Several generations of pistillata rdr6 double mutant individuals were grown in complete absence of pollination under both greenhouse and growth chamber conditions. A total of 15 individuals were manually harvested per genotype. Although individuals for all the genotypes were sterile due to the lack of pollination, developing siliques (fruits) of all plants analyzed exhibited a variable number of aborted seeds that accumulated anthocyanin pigmentation in the seed coat. To quantify this phenotype, we arbitrarily numbered each consecutive silique, initiating the analysis with Silique #4, which is the top silique that appears separated from the apical inflorescence in each stem; the next older siliques were consecutively numbered Silique #5, Silique #6 etc. . . . until reaching Silique #20. Each silique was manually opened and carefully scored by counting the number of ovules or "seed-like" structures that accumulated anthocyanin. Results are illustrated in FIG. 28. All developing siliques showed aborted seeds at frequencies significantly higher than controls, indicating that in the absence of pollination, double mutant pistillata rdr6 can give rise to seed-like structures that show cytological features normally occurring in a wild-type developing seeds following double fertilization. However, at full plant senescence these seeds aborted and did not germinate, suggesting that rdr6 plants are not able to complete viable seed development in the complete absence of pollination.

Example 10: Low Frequencies of Clonal Seeds are Recovered in pi rdr6 and pi ago9 (Plants Grown Under Open Pollination Conditions)

Many flowering plant species that naturally undergo asexual reproduction through seeds require pollination and fertilization of the central cell for viable endosperm formation (pseudogamy). Thus, pollination could be necessary for enabling seeds to reach maturity in the case of the mutants described herein. To test this possibility, a population of 70

F3 pi rdr6-15, pi ago9-3, and pi ago4-1 individuals were grown under greenhouse conditions, in the absence of any full-sib individual that did not show the pistillata (pi) mutant phenotype, but in the presence of additional wild-type adult *Arabidopsis* plants as an external source of cross-pollination.

Both double mutant genotypes were grown under greenhouse conditions at an average temperature of 26 to 28 degrees Celsius, and 13.5 hours daylight/10.5 night photoperiod regime. Two trays of 35 homozygous pistillata male sterile individuals and heterozygous for either ago9-3 or rdr6-15 were placed in a greenhouse table and left to cross-pollinate with wild-type Columbia individuals placed within their vicinity at no less than 2 meters from the double mutant trays. Seeds were harvested from full senescent individuals and a sample of 200 seeds was scored for each genotype to classify the seeds in the five classes that are described in the text. For genotyping comparison between maternal plants and their progeny, DNA was extracted from individual seeds, rosette stage plantlets, or adult plants and 92 well-characterized SNPs distributed across all five chromosomes and allowing distinction between Landsberg and Columbia ecotypic backgrounds, were genotyped using kompetitive allele specific PCR assays (KASP). A full list of the SNP list and their genomic location can be provided if necessary.

After plant senescence, 35 F3 individuals showing the pi phenotype and carrying mutations in either rdr6-15, ago4-1 or ago9-3 were systematically harvested, and phenotypic evidence of seed formation was assessed by manually dissecting each independent silique. Whereas progeny were scarce in pi controls, individuals carrying rdr6-15, ago4-1 or ago9-3 mutations produced a variable number of mature seeds of variable size and morphology. For all three double mutant genotypes, the number of seeds per plant ranged between 15 and 250. Under normal self-pollinated conditions, mutants give rise to seeds that on average have 0.5-0.6 mm in length. Double mutant individuals gave rise to five different classes of seeds based on length and morphology. These five classes are: (a) morphologically normal seeds with a length larger than 0.3 mm but smaller than 0.7 mm; (b) morphologically normal small seeds with a length of 0.3 mm or less; (c) morphologically normal large seeds with a length of at least 0.7 mm; (d) collapsed seeds not containing embryo or endosperm; and (e) seeds of normal size showing an abnormal morphology, frequently partially collapsed and containing an abnormal or not fully differentiated embryo. Using a random sample of 200 seeds per genotype, we scored the number of seeds for each class. The results are presented in Table 1, which provides data pertaining to quantitation of abnormal seeds in double mutant backgrounds grown under open pollination in greenhouse conditions. Whereas collapsed seeds do not contain an embryo, we speculate that the small seed class has a tendency to contain embryos with reduced DNA content as compared to wild-type, whereas large seeds have an embryo with higher DNA content as compared to wild-type; we plan to conduct flow cytometry measurements to test this hypothesis.

TABLE 1

| Genotype | Class (a) % normal | Class (b) % small seed | Class (c) % large seed | Class (d) % collapsed seed | Class (e) % abnormal seed |
|---|---|---|---|---|---|
| pi (n = 200) | 96 (192) | 1.5 (3) | 0 | 1 (2) | 1.5 (3) |
| pi ago4-1 (n = 200) | 84 (168) | 4 (8) | 1.5 (3) | 4 (8) | 6.5 (13) |

TABLE 1-continued

| Genotype | Class (a) % normal | Class (b) % small seed | Class (c) % large seed | Class (d) % collapsed seed | Class (e) % abnormal seed |
|---|---|---|---|---|---|
| pi ago9-3 (n = 200) | 71 (142) | 4 (8) | 0 | 16.5 (33) | 8.5 (17) |
| pi rdr6-15 (n = 200) | 81.5 (163) | 4.5 (9) | 1 (2) | 2 (4) | 11 (22) |

Whereas a few of class (e) seeds germinated and gave rise to diploid adult plants, most of them did not germinate either in soil or MS media; in sporadic cases we were able to rescue an embryo by extracting it from the seed coat. These rescued embryos produced plantlets that did not flower. In double mutant individuals pi rdr6-15 and pi ago9-3 the genetic background of the parental genotypes differed (pi was either in a Landsberg erecta or Columbia-O background), and therefore we could compare the genotype of F3 maternal individuals to the genotype of their F4 progeny in 6 independent families represented by the maternal parent and all class (e) individuals on the basis of DNA extracted from recovered plants or non-germinated individual seeds. To determine the genetic constitution of these families, we used a collection of 92 molecular markers (SSLPs and CAPS) that recognize previously characterized allelic polymorphisms that distinguish both ecotypes across all five *Arabidopsis* chromosomes (Bell and Ecker, 1994; Cho et al., 1999; Lukowitz et al., 2000). The results of this genotype comparison for a pi ago9 family is provided in Table 2 (data pertaining to a family of 10 pi ago9 individuals originating from class (e) seeds with comparison to the genotype of their maternal plant), and for a pi rdr6 family is presented in Table 3 (data pertaining to a family of 5 pi rdr6 individuals originating from class (e) seeds; comparison to the genotype of their maternal plant). In the case of the pi ago9 family, 4 out of 10 individuals retained the full genotype and heterozygosity of the corresponding maternal parent at all tested loci and in all five chromosomes. In the case of the pi rdr6 family, 5 out of 5 individuals retained the full genotype and heterozygosity of the corresponding maternal parent at all tested loci and in all five chromosomes. Results from some families were more variable; however, these results and others confirm that pi rdr6 and pi ago9 individuals can produce clonal seeds at a low frequency, under open cross-pollinated conditions.

TABLE 2

| Inidvidual | Nature of DNA | Number of SNPs identical to maternal genotype | Number of heterozygous markers |
|---|---|---|---|
| pi ago9A | ungerminated seed | 79/79 | 11 |
| pi ago9B | ungerminated seed | 79/79 | 11 |
| pi ago9C | ungerminated seed | 79/79 | 11 |
| pi ago9D | plantlet | 79/79 | 11 |
| pi ago9E | adult plant | 43/79 | 45 |
| pi ago9F | adult plant | 52/79 | 46 |
| pi ago9G | ungerminated seed | 67/79 | 15 |
| pi ago9H | ungerminated seed | 62/79 | 23 |
| pi ago9I | ungerminated seed | 66/79 | 19 |
| pi ago9J | plantlet | 31/79 | 42 |

TABLE 3

| Individual | Nature of DNA | Number of SNPs identical to maternal genotype | Number of heterozygous markers |
|---|---|---|---|
| pi rdr6A | ungerminated seed | 85/85 | 36 |
| pi rdr6B | ungerminated seed | 85/85 | 36 |
| pi rdr6C | ungerminated seed | 85/85 | 36 |
| pi rdr6D | ungerminated seed | 85/85 | 36 |
| pi rdr6E | ungerminated seed | 85/85 | 36 |

The results provided herein demonstrate that self-propagated asexual reproduction through seeds can be induced in *Arabidopsis* by single mutations affecting genes involved in RdDM, a discovery suggesting that transcriptional repression of repetitive genomic regions, most often associated with heterochromatin, is important for avoiding both unreduced gamete formation and the division of the egg and central cell in the absence of double fertilization. For rdr6, the frequency of initiation of autonomous seed development in the absence of pollination is higher than the frequency at which clonal seeds are recovered under open pollinated conditions, suggesting that pollination is necessary to trigger viable asexual seed formation by a mechanism yet to be elucidated. Non-pollinated siliques of pi rdr6 often contain collapsed non germinating seeds showing a multicellular abnormal embryo in the absence of endosperm, suggesting that fertilization of the central cell might be necessary for viable seed formation by a mechanisms reminiscent of pseudogamy in natural apomicts (Nogler, 1984).

Example 11: Low Frequencies of Clonal Seeds are Recovered in pi rdr6 and pi ago9 (Plants Grown Under Open Pollination Conditions)

An experiment was performed in *Glycine max* using guideRNA targeted CAS9 mutations in putative RdDM pathway genes. Three orthologs of Ago4 (Glyma02g44260.1, Glyma14g04510.1 and Glyma20g12070.3) and two orthologs of RDR6 (Glyma04g07151.2 and Glyma06g07251.2) were targeted in this experiment. Due to the use of multiple guide RNAs, two variations of the mutagenesis experiment were performed. In one experiment, only RDR6 orthologs were targeted, and in a second experiment, all five genes listed above were targeted. In total, 330 independent events were regenerated into plants and genotyped. From these, just over 100 plants were selected for having one or more of the ten total alleles being frame-shifted and therefore putatively knocked out. Ovules from 98 regenerated events (TO plants) were observed at the megaspore mother cell stage through mature embryo sac stage through fixation, clearing and DIC microscopy. In total, ca. 1580 ovules were observed. No observations of apospory-like development were observed in this preliminary experiment. A number of issues may account for this lack of observed apospory including: 1) poorly characterized RdDM pathway genes in *Glycine max;* 2) unknown somaclonal variation effects in regenerated soybean plants; 3) difficult to characterize genetics in the primary generation of regenerated CAS9 events due to potential for chimeras; 4) difficulty in obtaining large numbers of appropriately prepared soy ovules at the correct stages for observation.

Other preliminary experiments have shown that among seeds that have been produced by *Arabidopsis thaliana* plants of the present disclosure, some have genomes evidencing sexual reproduction (genetic material from both a male and a female parent; as specified in the original disclosure), some seeds have clonal genomes (genetic material from only the female parent, as specified in the original disclosure) and some seeds are aneuploids evidencing an abnormal number of chromosomes, as evidenced by these new preliminary results.

ADDITIONAL REFERENCES ON GAMETOCIDES

Albertson, M. C. and Palmer, R. G., 1979, A comparative light and electron microscopic study on macrosporogenesis in male sterile (MS) and male fertile soybeans (*Glycine max* L. Var.). American J. Bot., 66: 253-265.

Ali, A. J., Devakumar, C., Zaman, F. U. and Siddiq, E. A., 1999, Gametocidal potency of ethyl 4 fluorooxanilate in rice. Indian J. Genet. Pl. Bred., 59: 267-279.

Alpuerto, V. V., 1987, Inducted male sterility using gametocides in the production of hybrid tomato seed. Philippine J. of Crop Sci., 12: 20.

Anaschenko, A. V., 1972b, A study of male sterility in sunflower. Tr. Prikl Bot. Genet Sel., 46: 120-13.

Anonymous, 1999, International Rules for Seed Testing, Seed Science and Technology, 32: 1-334.

Anonymous, 2007, Agricultural output. Centre for Monitoring. Indian Economy, pp. 267-268. Ashwathanarayana, S. C., 1986, Effect of gametocides on pollen sterility and other morphological characters in rice (*Oryza sativa* L.). M.Sc.(Agri.) Thesis, Univ. Agric. Sci., Bangalore.

Awasthi, N. N. C. and Dubey, D. K., 1985, Effects of some phytogametocides on growth, fertility and yield of Lentil (*Lens culinaris*). LENS News. (ICARDA), 12: 16-22.

Banga, S. S. and Labana, K. S., 1984, Ethrel induced male sterility in Indian mustard (*Brassica juncea* (L.) Coss). Zpflanzenzucht, 92: 229-233.

Bartkawiak, B. I., Rousselle, P. and Renard, M., 1979, Investigations of two lines of cytoplasmic male sterility in rape seed (*Brassica napus* L.). Genetica polanica, 20: 47-49.

Basavaraja, N., 1981, Studies on hybrid seed production in brinjal (*Solanum melongena* L.). M.Sc.(Agri.) Thesis, Univ. Agric. Sci., Bangalore.

Baydar, H. and Gokman, O. H., 2003, Hybrid seed production in safflower following the induction of male sterility by gibbberellic acid. Pl. Bred., 122: 459-461.

Beaumont, V. and Courtois, B., 1990, Anther culturability of rice plants treated with male gametocide chemicals. Internl. Rice Res. News., 15:9.

Bennekom, J. L. and Van, 1973, Application of gibberellic acid as a gametocide in onions. Zaadbelangen, 27(16): 324-325.

Berry, S. K., Kalra, C. L., Sehgal, R. C., Kulkarni, S. G., Arora, S. K. and Sharma, B. R., 1988, Quality characteristics of seed of five okra cultivars. J. Food Sci. Tec., 25: 303-305.

Berzy, T., Szundy, T., Barnabas, B., Baver, K. and Matolesy, G., 1990, The biological effect of gametocidies on sexual processes and individual plant development in maize. Novenytermeles, 39: 97-110.

Bhardwaj, D. N. and Dubey, D. K., 1977, Chemical induction of male sterility in mungean (*Phaseolus aureus* Roxb.). Sci. Cul., 43(2): 89-92.

Bose, S. and Sharma, P. D., 1972 Preliminary studies on the effect of combined treatment of colchicine and giberelic acid on rice. Agric. Agro-Indus. J., 5(2): 31-32.

Campos, F. A., 1974, The use of ethrel in the induction of male sterility in sunflower. In Proceedings of the 6th Internl. Sunflower Conf., vraneanu A. V. (Ed.) Bucharest, pp. 349-351.

Chailakeryan, M. K. H. and Khryanin, V. N., 1980, Hormonal regulation of sox expression in culture of isolated hemp germs. Naturwissens Chaften, 67: 94-96.

Chan, Y. W. and Cheah, C. H., 1981, Evaluation of ethrel as a selective gametocide in the breeding of rice (*Oriza sativa* L.). In Proceedings of 4th International SABRAO Cong., Malaysia, p.24.

Chauhan, S. V. S. and Kinoshita, T., 1980a, Morphological and histochemical studies on pollen degeneration in cytoplasmic male sterile sugarbeet (*Beta vulgaris* L. Var *Saccharifera*). J. of Fac. Agric. Hokkaido Univ. Japan, 60: 42-46.

Chauhan, S. V. S. and Kinoshita, T., 1980c, Cytohistological and biochemical studies on pollen abortion in *Datura alba* L. plants treated with gametocidal compounds. In Proceedings of Japanese Acad. of Sci., 56: 344-349.

Chauhan, S. V. S. and Singh, S. P., 1966, Pollen abortion in male sterile hexaploid wheat (Norin) having Aegilaps ovota L. cytoplasm. Crop Sci., 6: 532-535.

Chauhan, S. V. S. and Singh, S. P., 1972, Effect of maleic hydrazide, FW 450 and dalapon on growth, flowering and pollen viability of *Capsicum annuum* L. and *Datura alba* L. Indian J. Pl. Phy., 15: 138-147.

Chauhan, S. V. S. and Vandana Singh, 2002, Detergent induced male sterility and bud pollination in *Brassica juncea* (L.). Czem and Coss. Curr. Sci., 82(8): 918-920.

Chauhan, S. V. S., 1976, Morphological and histochemical studies in natural and chemically induced male sterile plants. Curr. Sci., 45; 274-275.

Chauhan, S. V. S., 1980, Effect of maleic hydrazide, FW-450 and dalapon on anther development in *Capsicum annuum*. J. Indian Bot. Sci., 59: 133-136.

Chauhan, S. V. S., Agnihotri, D. K. and Gupta, H. K., 2005, Efficacy of benzotrizole as a chemical hybridizing agent in chilli cotton radish. Indian J. Genet., 65(3): 223-224.

Cheng, Y. K. and Huang, C. S., 1980, Studies on cytoplasmic genetic male sterility of cultivated rice (*Oryza sativa*). II. Morphological histological investigation of functional male sterility. J. of Agri. Res., China, 29(29): 7-8.

Chopra, V. L., Jain, S. K. and Swaminathan, M. S., 1960, Studies on the chemical induction of pollen sterility in some crop plants. Indian J. Genet. Pl. Breed., 20: 188-199.

Choudhury, B. and George, P. V., 1962, Preliminary trails on the induction of male sterility in brinjal (*Solanum melongena* L.). Indian J. Hort., Sci., 19: 140-142.

Chowdhury, J. B. and Das, K., 1966, Male sterility in *Brassica campestris* var. yellow sarson. Indian J. Genet and Pl. Bred., 26: 374-380.

Chowdhury, J. B. and Das, K., 1968, Cytomorphological studies on male sterility in *Brassica campestris* L. Cytologia, 38: 195-199.

Chowdhury, J. B., Ghai, B. S. and Varghese, T. M., 1968, Cytohistological studies on male sterility in wheat with a discussion on causes of pollen fertility in other crops. Indian J. Genet Pl. Bred., 20: 188-199.

Ciha, A. J. and Ruminski P. G., 1991, Specificity of pyridine monocarboxylates and benzoic acid analogues as chemical hybridizing agents in wheat. J. Agri. Food Chem., 39: 2072-2076.

Colhoun, L. W., Steer, M. V., 1983, The cytological effects of the gametocides ethrel and RH 531 on microsprogenesis in barley (*Hardeum vulgare* L.). Pl. Cen Environ., 196(1): 21-29.

Das, K. and Pandey, B. D., 1961, Male sterility in brown sarson. Indian J. Genet Pl. Bred., 21: 195-190.

Deotale, R. D., Bhiwapukar, R. M., Sorte, N. V., Waghmare, H. U., Nimje, B. H. and Alluwar, M. W., 1994, Growth and yield components of safflower (*Carthamum tinctiorius* L.) as influenced by 2, 3,5-triiodobenzoic acid. J. Soils and Crops, 4: 125-127.

Dharmarayan, D. K., 1990, Chemical induction of male sterility and standardizing techniques for hybrid seed production rice (*Oryza sativa* L.). Ph.D. Thesis, Univ. Agric. Sci., Bangalore. Dicks, J. W., 1976, Chemical restriction of stem growth in ornamentals. Outlook on Agri., 9: 69-75.

Dubey, R. S. and Singh, S. P., 1967, Chemical induction of male sterility in *Abelmoschus esculentus* (L.) Moench. *Indian J. Agric. Sci.*, 38(1): 108-114.

Dutta, O. P., 1980, Male sterility in okra (*Abelmoschus esculentus* L. Moench) and bottle gourd and its utilization in hybrid seed production. Ph.D. Thesis, Univ. Agri. Sci., Bangalore.

Echlin, P., 1971, The role of tapetum during microsporogenesis of angiosperms, in Pollen Development and Physiology. Heslop-Harrison (ed.), *Butterowrths, London*, pp. 41-61.

Eenink, A. H. and Vereijken, A. L. J., 1978, Anatomical changes in flower buds of lettuce (*Lactuca sativa* L.) treated with a GA3 solution for induction of male sterility. Acta Bot Neerl., 27: 199-224.

Erickson, J. R., 1967, Biochemical investigations of cytoplasmic male sterility in spring wheat (*Triticum* aestiuvm L.). Agron. Abst., pp. 8-9.

Fairey, D. T., Shoskopf, N.C., 1975, Effect of granevar ethephon on male sterility in wheat. Crop Sci., 15(1): 29-32.

Fan Ping, Cui Dangqun and Fan Hong Wei, 1998, Studies on the male sterility induced by CHA-SC 2053 in common wheat. Acta Agriculturae Universitatis Henanensis, 32(2): 149-153.

Frank, J. and Koves, F. S., 1977, Chemical induction of male sterility in sunflower. Acta Agrono. Acad. Scienti. Hungarical, 26(3/4): 318-324.

Frank, J., Koves, F. S., 1977, Chemical induction of male sterility in sunflower. Acta Agron. Acad., Scien. Hung., 26(/4): 318-324.

Gao, Q. R., Sun, L. and Liu, B., 1996, Induced male sterility and its effects on growth and development of winter wheat. J. of Shandong Agri. Univ., 27: 241-248.

Garcia, T. L., Dominguez, J. and Fernandez Martinez, J., 1979, Male sterility and female steility induced in sunflower with GA3. Anales del Institute Nacional de investigeones Agraries Prod Vegel., 9: 147-169.

Ghosh, M. S. and Bose, T. K., 1970, Sex modification in cucurbitaceous plants by using CCC. Phyton. (Hom), 27: 131-135.

Gomez, A. K and Gomez, A., 1984, Statistical Procedure for Agricultural Research, 2nd Edition, A Wiley—Interscience Publication, New York, pp. 187-241.

Graybosch, R. A. and Palmer, R. G., 1987, Analysis of male sterile character in soybean. J. Here., 78: 66-70.

Guan, C. Y., Li, X., Wang, G. H. and Chen, S. Y., 1998, Studies on the mechanisms of male sterility induced by chemical hybridizing agents in rape. II. Effects of KMS-1 on fertility in rape (*Bassica napus*). Chinese Journal of Oil and Crop Science, 20: 1-5.

Guilford, W. J., Patterson, T. G., Vega, R. O., Fang, L., Liang, Y., Lewis, H. A. and Labovitz, J. N., 1992, Synthesis and pollen suppressant activity of phenylcinoline-3-carboxylic acids. J. Agri. Food Chem., 40: 2026-2032.

Halevy, A. H. and Rudich, J., 1967, Modification of sex expression in muskmelon by treatment with the growth retardant B 995. Physiologia Plantarum, 20: 1052-1058.

Hansen, D. J., Bellman, S. K. and Sacher, R. M., 1976, Gibberellic acid controlled sex expression of corn tassels. Crop Sci., 16: 371-374.

Hecker, R. J. and Smith, G. A. 1975, Tests of granular ethephon as a male gametocide on sugarbeet. Canadian J. Pl. Sci., 55: 655-656.

Hecker, R. J., Bilgen, T., Bhatnagar, P. S., Smith, G. A., 1972, Tests for chemical induction of male sterility in sugarbeet. Canadian J. Pl. Sci., 52(8): 937-944.

Hillyer, I. G., 1956, Effects of growth substances in flowering of cucurbitaceous plants. Ph.D. Thesis, Michigan State University.

Huang, Q. C. and Wang, L. Z., 1990, Use of male gametocide to induce complete sterility in a partially male sterile rice. Internl. Rice Res. News., 15(5): 6-7.

Huang, X. Q., Yang, A. N., Zhou, Y. L. and Zhang, Y. J., 1999, Effect of chemical hybridizing agent III (Pyrone type derivative) on male sterility in rice. Jiangsu J. Agri. Sci., 15(1): 17-20.

Hughes, W. G., Bodden, J. J. and Golanoponlu, S., 1978, The effect of sowing density and application of GA on male sterility and ear emergence in Ethephon treated field grown wheat. Ann. Rev. Ap. Bio., 88: 313-319.

Iang, M. L. L., Wang, D. Q., Zhang, A. and Huang, C., 1998, Male sterile effect of a new pyridazine compound 9403 on wheat. J. China Agri. Univ., 3: 39-44.

Illusulu, K., 1967, Cytological investigation on the male sterility in sunflower. Genetica Polanica, 30: 65-69.

Iwahori, S., Lyons, J. M. and Smith, O. E., 1970, Sex expression in cucumber plants as affected by 2-chloroethylphosphonic acid, ethylene and growth regulators. Plant Physiology (Bethesda), 46: 412-415.

Jackson, M. L., 1967, Soil Chemical Analysis. Prentice Hall of India Private Limited, New Delhi, pp. 183-192.

Jain, S. K., 1956, Natural incidence of male sterility and its chemical induction in crop plants. Assoc. Disst., IARI, New Delhi, p. 267.

Jain, V. K. and Mukherjee, D., 1980, Effect of chlorflurenol methylester 74050 on sex expression and parthenocarpic fruit development in tomato. Phyton. (Hom.), 38: 89-93.

Jensen, W. A., 1962, Bot. Histochem. Prin. Prac., W.H., Freeman and Co., San Francisco.

Jensen, W. A., 1984, The effect of chemical hybridizing agent on the development of wheat pollen. In Proceedings of 8th Internl. Sym. Sexual Reprod. In Seed Pl., Ferns and Mosses, p.34.

Jiang, M. L., Wang, D. Q., Zhang, A. and Huang, C., 1998, Male sterile effect of a new pyridazine compound 9403 on wheat. J. of China Agri. Univ., 3(5): 39-44.

Johnson, R. R. and Brown, C. M., 1976, Chemical control of pollination in wheat and oats. Crop Sci., 16: 584-587.

Jos, J. S. and Singh, S. P., 1967a, Chemical induction of male sterility in tobacco. Indian J. Agri. Sci., 37: 504-510.

Jos, J. S. and Singh, S. P., 1967b, Induction of male sterility in *Nicotiana rustica* by means of chemicals. Indian J. Pl Phy., 10: 130-138.

Joshi, A. D. and Hardas, M. W., 1974, Okra In: Hutchnson, J. B. Evolutionary Studies in World Crops. Diversity and Change in the Indian Sub-Continent. Cambridge Univ., Press, London, p. 105.

Kajjidoni, S. J., 1997, Histological basis of genetic male sterility and its utilization in hybrid development in diploid cotton. Ph.D. thesis, Univ. Agri. Sci., Dharwad.

Kasambe, J. N. R., 1967, Phenotypic restoration of fertility in a male sterile mutant by treatment with gibberellic acid. Nature, 215: 668.

Kaul, C. L. and Singh, S. P., 1967a, Effects of some growth regulators with gametocidal properties on Cajanus cajan L. Indian J. of Agri. Sci., 37: 69-75.

Kaul, C. L. and Singh, S. P., 1967b, On induced male sterility in wheat, Sunnhemp and onion. Indian J. of Pl. Phy., 10: 112-118.

Kaul, C. L. and Singh, S. P., 1967c, Staminal and functional male sterility induced by chemical treatment in papilionaceous plants. Indian J. Agri. Sci., 37: 264-269.

Khulbe, R. K., Roy, N. and Yadav, V. K., 2003, Induction of male sterility in wild and related species of sunflower (*Helianthus annus* L.). Crop Sci., 131: 29-32.

Kiermayer, O., 1959, Induktion mannlich-steriler Bluten bei *Helianthus annuus* durch, 2, 3, 5-tri-jodbenzoesaure (TIBA). Nature Wissen., 46: 457.

Kini, A. V., Seetharam, A. and Joshi, S. S. 1994, Mechanism of pollen abortion in cytoplasmi male sterile line of sunflower. Cytologic, 54: 121-124.

Kinoshita, T., 1971, Genetical studies on the male sterility of sugarbeets (*Beta vulgaris* L.) and its related species. J. of Fac. Agri., Hokkaido Univ., 56: 432-541.

Klimov, M. N., 1973, Induction of male sterility in sunflower by a chemical method. Referat Zhu. Abst., 5: 55-57.

Knowles, G., 1953, Selective control of wild oats in cereal crops by Maleic hydrazide. Canadian J. Agri. Sci., 33: 402.

Konstantinova, L. N., 1980, Cytological disturbances in anther development following gametocide induced male sterility in sunflower (*Helianthus annus* L.). Genetika a Lechenl, 67(3): 134-140.

Konstantinova, L. N., 1980, Cytological disturbances on anther development following gametocide induced male sterility in sunflower (*Helianthus annus* L.). Genetika a Slechenl, 67(3): 134-140.

Koriesh, E. M., Abou, Dahab, A. M. and Ali, E. W. M., 1989, Physiological studies on *Chrysanthemum morifolium*. Effect of cycocel, GA and nucleic acid on flowering and inflorescence characters. Assiut J. Agric. Sci., 20(1): 43-58.

Kovacik, A. and Kryzanek, R., 1969, Biological and biochemical analysis of sterile and fertile pollen of sunflower. Genet. Slecht., USSR, 5: 79-184.

Kumar, J., Verma, M. M., Singh, K. and Gagneja, M. R., 1976, Effectiveness of ehrel as an androcide in barley. Crop Improv., 3: 39-42.

Laibach, F. and Kribben, F. J., 1951, Der Einfluss von wuchstoff auf das Geschiecht der Bluten be einer monoezischen pflanze (*Cucumis sativus* L.). beitr Biol. Pflanz., 28: 64-67.

Lal, S. K., Devkumar, C., Sapra, R. L., Singh, K. P., 2004, Use of gametocide for emasculation in soybean (*Glycine max* (L.) Merr.). Soybean Gene. Newsl.: 31: 1-4.

Laveau, J. H., Schneider, C. and Berville, A., 1989, Microsporogenesis and abortion in cytoplasmic male sterile plants from H. petiolans or *H. petiolaris* fallan crossed by sunflower (*H. annuus* L.). Ann. Bot., 64: 137-148.

Lippert, L. F. and Hall, M. C., 1961, Gametocidal action of F W-450 on cantaloupe. In Proceedings of American Soc., Hort., Sci., 78: 319-329.

Liu, Q. L. Pen, L. S., Lu, X. Y., Luo, Z. M., Lin, F. S., Zhoo, T. B. and Wu, S. Q., 1998, Studies on utilizing a chemical hybridizing agent to guarantee the purity of two line hybrid rice. II. Baochuling's effect on TPGMSR's physiochemical characters. J. Hunan Agri. Univ., 24: 345-350.

Mangal, J. L., 1972, Induced male sterility in brinjal following foliar application. Punjab Hort J., 12: 179-182.

Manjula, M. and Ibrahim, K. K., 1999, The effect of gametocides on plant growth characters in rice. Oryza, 36(3): 215-218.

Martin, F. W., 1982, A second edible okra species and its hybrid with common okra. Ann. Bot., 50: 277-283.

Mathur, D. S. and Lal, S. K., 1999, Chemical induction of male sterility in chickpea. Indian J. Genet Pl. Breed., 59(3): 379-380.

Mcllrath, W. J., 1957, The use of maleic hydrazide for the production of male sterility in grain sorghum. In: A. Literature Summary on Maleic hydrazide, Naugatuck Chemical Division, US Ruber Conn., p.106.

McRae, D. H., 1983, Advances in chemical hybridization. Pl. Bred. Rev., 3: 169-191.

Meer, O. P. and Bennekam, J. L., 1973, Gibberellic acid as a gametocide for the common onion (*Allium cepa* L.). Euphy., 22(2): 239-243.

Mehetre, S. S., 1988, Male sterility in cotton. Agril. Rev., 9(1): 7-17.

Meyer, JR., Roux, J. B. and Thomas, R. O., 1958, A preliminary report on the induction of male sterility in cotton by maleic hybrzaide. Missouri Agril. Exper. Sta. Inf. Sheet, p.589.

Mian, H. R., Kuspira, J. and Walker, G. W. R., 1974, Histological and cytochemical studies on five genetic male sterile lines of barley (*Hardeum vulgare*). Canadian J. Genet Cyt., 16: 355-379.

Miller, D. A., 1961, A study of various chemicals as gametocidal agents in sorghum. Sorghu News., 4: 22-24.

Mohan Ram, H. Y. and Jaiswal, V. S., 1970, Induction of female flowers on male plants of *Cannabolis sativa* L. by 2 chloroethanephosphonic acid. Experimentia (Basel), 26: 214-216.

Moore, J. F., 1959, Male sterility induced in tomato by sodium 2,3-dichloroisobutyrate. *Science,* 129: 1738-1740.

Moore, R. H., 1950, Several effects of maleic hydrazide on crop plants. *Crop Sci.,* 112: 52-53.

Nachalas, M. M., Crawford, D. T., Goldstein, T. P. and Seligman, A. M., 1958 The histochemical demonstration of cytochrome oxidase with new reagent for the Nadi reaction. J. Histochem. Cytochem., 6: 445-456.

Nagarjuna, B., Reddy, V. P., Rao, M. R. and Reddy, E. N., 1988, Effect of growth regulators and potassium nitrate on growth, flowering and yield of chrysanthemum (*Chrysanthemum indicum*). South Indian Hort., 36(3): 136-140.

Nakashima and Hosokawa, S., 1974b, Studies on histological features of male sterility in sunflower (*Helianthus annus* L.). *Proc. Crop Sci.* Soc. Japan, 43: 475-481.

Narayana Gowda, J. V., 1990, Influence of pinching and cycocel on growth and flowering of china aster (*Callistephus chinensis*). Mysore J. Agric. Sci., 24: 278-245.

Nasrallah, M. E. and Hopp, R. J., 1963, Effect of a selective gametocide on egg plant (*Solanum melongena* L.). In Proceed. of American Soc. Horti. Sci., 83: 575-578.

Nelson, P. M. and Rossman, E. C., 1958, Chemical induction of male sterility in inbred maize by use of gibberellins. Science, 127: 1560-1501.

Nishi, S., Kuriyan and Tode, M., 1970, Studies on first generation hybrids and vegetables II. Experiments on the applications of gametocides, FW 450 to tomato. Bull. Hort. Res. Stat., Hirat., 9: 129-139.

Olvey, J. M., Fisher, W. D. and Patterson, L. L., 1981, TD 1123: a selective male gametocide. In Proc. Beltwide Cot. Prod. Res. Conf., Ed. J. M. Brown, Memphis, Tenn.: National Cotton Council of America, p.84.

Panse, V. G. and Sukhatme, P. V., 1978, Statistical Methods for Agricultural Workers, ICAR, New Delhi.

Parmar, K. S. Siddiq E. A. and Swaminathan, M. S., 1979 Chemical induction of male sterility in rice. Indian J. Genet Pl. Breed., 39: 529-541.

Paun, L., 1974, The cytologic mechanism of male sterility in sunflower. In Proc. 6th Intern. Sunf. Conf., Buchares, pp.17-25.

Pederson, M. W., 1959, Effect of sodium 2,3-dichloroisobutyrate on alfalfa gametes. Agron. J, 51: 573-574.

Peiretti, D. A., Ceballos, H., Macchiavelli, R. E. and Fernandez, M., 1987, Effects of inducing male sterility by applying GA3 and F1 seed production in sunflower. Revista de Ciencias Agropecuarias, 5: 25-33.

Perez, A. T., Chang, T. T., Beachell, H. M., Vergara, B. S. and Marciano, A. P., 1973, Induction of male sterility in rice with ethrel and RH-531. SABRAO Newsletter, 5: 133-139.

Piquemal, G., 1970, How to produce hybrid sunflower seeds by inducing male sterility with gibberellic acid. In Proc. 4th Internl. Sunf. Conf., Memphis tennesses, pp. 127-135.

Porter, K. B. and Weise, A. F., 1961, Evaluation of certain chemicals as selective gametocides for wheat. Crop Sci., 1: 381-182.

Prayaga, P., Lakshamma and Anjani, K., 2002, Enhancement of male sterility in safflower by growth regulators and chemicals. Sesame and Safflower Newsletter, 16: 92-95.

Pundir, N. S. and Singh, S. P., 1965, Induction of male sterility in muskmelon by the use of FW-450. Agra Univ. J. Res. Sci., 14: 177-184.

Radley, M., 1980, Effect of abscicic acid and gibberellic acid on grain set in wheat. Ann. Rev. App. Bio., 95(3): 409-414.

Raj, A. Y., 1968, Histological studies in male sterile and male fertile sorghum. Indian J. Genet. Pl. Bred., 28: 335-341.

Rastogi, R. and Sawhney, V. K., 1988, Suppression of stamen development of CCC and ABA in tomato floral buds cultured in vitro. J. Pl Phy., 133: 620-624.

Rehm, S., 1952, Male sterile plants by chemical treatments. Nature, 170: 38-39.

Reinecke, D. M. and Bandurski, 1987, Auxin biosynthesis and metabolism. Plant Hormones and their role of plant growth and development. Ed. Devies, P. J., Boston, Martinus, Nijhoff, pp. 24-42.

Robinson, R. W., Whitaker, T. W. and Bohn, G. W., 1970, Promotion of pistillate flowering in cucurbiat by 2-chloroethyl phosphonic acid. Euphytica, 19: 180-183.

Rodriquez, B. P. and Lambeth, V. N., 1972, Synergism and antagonism of GA and growth inhibitors on growth and sex expression in cucumber. J. American Soc. Hort. Sci., 97: 90-92.

Rudich, J., Halevy, A. H. and Kedar, N., 1969, Increase in femaleness of three cucurbits by treatment with ethrel, an ethylene releasing compounds. Planta (Berl.), 86: 69-76.

Rudich, J., Halevy, A. H. and Kedar, N., 1970, Interaction of gibberellin and SADH on growth and sex expression of muskmelon. J. American Soc. Hort. Sci., 97: 369-372.

Ruebenbaur, T. and Schultis, L., 1960, Zastosovanie selektywnego gemetocydu FW-450 dla chemicznego kastrowania kwaito buraka. Hodwla Roslin Aklimat Nasiennicto, USSR, 4: 199-204.

Saini, S. S. and Davis, G. N., 1969, Male sterility in *Allium cepa* and some species hybrids. Economic Botany, 23: 37-44.

Salgare, S. A., 1995, Gametocidal effect of acrolein on ornamental chillies. Flora and Fauna, Jhansi, 1: 95-98.

Salmon, N., 1963, Behandlung von *Beta vulgaris* Tel Aviv., Israel. Ref. Chem. Zentralbl., 134: 152-162.

Satyanarayana, K. V. V., Rao, N. V. P. R. G, Rao, G. M. and Murthy, B. K., 1996, Effect of gametocides on pollen sterility and plant morphology in partial sterile CMS lines of rice. New Botanist, 23: 1-4.

Sawheney, V. K., 1981, Abnormalities in pepper (*Capsicum annuum* L.) flowers induced by gibberellic acid. Canadian J. Bot., 59: 8-16.

Sayeres, E. R., 1959, The effect of FW-450 as a gametocide on *Sorhgum vulgare*. Undergrad Spec. Probl. Rep. Univ. Illinois Ubrana, p.19.

Sccles, G. S. and Evans, L. E., 1979, Pollen development in male sterile and cytoplasmic male sterile rye. Canadian J. Bot., 57: 2782-2790.

Schulz, P. J., Cross, J. W. and Almeida, E., 1993, Chemical agents that inhibit pollen development: effects of the phenylcinnoline carboxylates SC-105 and SC-1271 on the ultrastructure of developing wheat anthers (*Triticum aestivum* L.). Sexual Pl. Reprod., 6: 108-121.

Schuster, W., 1961, Untersuchungen uber kunstlich induzierte pollen sterillitiat bie sonnenblumen (*Helianthus annuus* L.). Z. pflanzenzucht., 46: 389-404.

Seetharam, A. and Kumari, P. K., 1975, Induction of male sterility by gibberellic acid in sunflower. Indian J. Genet. and Pl. Breed., 35: 136-138.

Seetharam, A. and Kusumakumari, P., 1974, Giberellic acid induced male sterility in sunflower. Sci. Cul., 40(9): 398-399.

Seetharam, A. and Kusumakumari, P., 1976, Histological studies on cytoplasmic and GA3 induced male sterility levels of sunflower. *Indian J. Genet.*, 36: 342-344.

Shivaprasad Shetty, 1995, Effect of GA3 and cycocel on maturity, seed yield and quality in china aster. M.Sc. (Agri.) Thesis, Univ. Agric. Sci., Bangalore.

Shivaramaiah, 1985, Induction of male sterility using gametocides in common millet (*Pannicum miliaceum* L.) and little millet (*Panicum miliure* L.). M.Sc.(Agri.) Thesis, Univ. Agri Sci., Dharwad.

Simanenko, V. K., 1982, Anther and microspore development offertile and cytoplasmical male sterility (CMS) line of sunflower. *Tristol. Geneta*, 16(5): 34-41.

Simonenko, V. K. and Karpavich, E. V., 1979, The cytological expression of different types of male sterility in sunflower.r Referatrun VI Zhurnal, 5: 65-69.

Singh, A. K., 1999, Male gametocidal effect of synthetic detergent in rice. Indian J. Genet Pl. Bred., 59(3): 371-373.

Singh, S. P. and Hadley, H. H., 1961, Pollen abortion in cytoplasmic male sterile sorghum. Crop Sci., 1: 430-432.

Sink, K. C. and Gunesch, M. L., 1966, Gametocidal effects of sodium alpha, beta-dichloroisobutyrate (DCIB) on petunias. In Proc. American Soc. Hort. Sci., 88: 657-661.

Sprova, M., 1975, New data on male sterility in sunflower induced by gibberellic acid. Resteniev dni Nanki, 12(1): 10-17.

Sreedhar, R. V., 2003, Assessment of genetic variability in niger (*Guizotia abyssinica* Cass.) germplasm. M.Sc. (Agri.) Thesis, Univ. Agric. Sci., Dharwad.

Starnes, W. J. and Hadley, H. H., 1962, Some effects of the gametocide alpha, beta-dichloroisobutyrate on soybean. Crop Sci., 2: 305-310.

Stoskopf, N.C. and Law J., 1972, Some observations on ethrel as a tool for developing hybrid cereals. Canadian J. Pl. Sci., 52: 680-683.

Sundararajan, N., Nagaraju, S., Venkataraman, S. and Jayanah, M. H., 1972, Design and analysis offield experiments. Univ. Agri. Sci., Hebbal, Bangalore.

Suryanarayan Reddy, B. G., Pushpa, G., Satyam, B. A. and Prakash, K. S., 1983, Preliminary studies on gibberellic acid inducted male sterility in finger millet. Proceedings of National Seminar, Jan. 12-13, 1983, Univ. Agri. Sci., Bangalore, Ed. By Seehtaram and Shanlare Gowda.

Swarnalatha, V., 2004, Induction of male sterility and histological studies on induced male sterility in niger (*Guizotia abyssinica* Cass). M.Sc. (Agri.) Thesis, Univ. Agric. Sci., Dharwad.

Tschabold, E. E., Heim, D. R., Beck, J. R., Wright, F. L., Rainey, D. P., Terando, N. H. and Schwer, J. F., 1988, LY 195259, new chemical hybridizing agent for wheat. Crop Science, 28: 583-588.

Vear, F., 1981, Determination of sunflower lines useable as a combining ability testers according to their aptitude to be male sterilized with giberellin. Sunflower News., 5: 5-8.

Veer Kumar, G. V., 2002, Studies on genetic variability, floral biology, autogamy and histology of GA3 induced male sterility in niger. M.Sc.(Agri.) Thesis, Univ. Agric. Sci., Bangalore.

Verma, M. M. and Kumar, J., 1978, Ethrel a male gametocide that can replace the male sterility genes in barley. Euphytica, 27: 865-968.

Verma, R. B., Singh, G. N., 1978, Stuides on chemical induction of male sterility in bhendi (*Abelmoschus esculentus* Moench). Indian J. Agri. Res., 12(1): 22-24.

Verober, A. I. and Blankarskaya, T. E., 1978, Cytoembryological changes of male sterility in sunflower. I. Genet I Selektoiya rast. Tez. Dokl. Lemngred, VSSR (1977) 103-104, Udersa Univ. Ukranian SSR from Refertivnvi Zhurnal, 5: 51-65.

Vittalaya Kini A., 1981, histological and histochemical studies in cytoplasmic gibberellic acid induced male sterile genes of sunflower. M.Sc.(Agri.) Thesis, Univ. Agri. Sci., Bangalore.

Walkof, C., 1959, In Prog. Rep. on FW-450 Chem. Gametocide. Rohm and Haas, Philadelphia, p.9.

Wang, X. and Que, R. F., 1981, Induction of pollen sterility by ethylene and gametocides in rice. Acta Phytophysiol. Sin., 7: 381-383.

Wang, X., QUr, R. F., 1981, Induction o pollen sterility by ethylene and gametocide in rice. ActaPhyto. Sini, 7(4): 381-383.

Wang, X. I., Meiyu, Y. U. and Yao, F. D., 1995, Effect of CRMS on male sterility of rice plants. Chinese Rice Res. News., 3: 2-4.

Warmke, H. E. and Overman, M. A., 1972a, Cytoplasmic male sterility in sorghum I callose behaviour in the fertile and sterile anthers. J. Here., 63: 103-108.

Warmke, H. E. and Overman, M. A., 1972b, Cytoplasmic male sterility in sorghum-II, Tapetal behaviour in fertile and sterile anthers. J Here., 63: 228-233.

Wit, F., 1960, Chemically induced male sterility, a new tool in plant breeding. Euphytica, 9: 1-9.

Yaduraju, N. T., 2000, Recent Adv. Herb. Use Res., IARI, New Delhi, pp. 42-48.

Yogendra Sharma, Sharma, 2005, Chemical hybridizing agents (CHA)—a tool for hybrid seed production—review. Agril. Rev., 26(2): 114-123.

Yu, C., Hu, S., He, P., Sun, G., Zhang, C. Yu, Y., 2006, Inducing male sterility in *Brassica napus* L. by a sulphonylurea herbicide, itribenuronmethyl. Pl. Bred., 125(1): 61-64.

Yu, GuiRong, XU, Liyuan, Du, Wenping, Wang, Y. P., 2005, studies on the selection of wheat CHA and the cultivation of hybrid wheat. South West China J. Agri. Sci., 18(1): 29-32.

Zdrilko, A. F., 1967, Producing plants with male sterility by chemical means. Referat Zhurnal Abstacts, 10: 55-75.

SEQUENCE LISTING (1009 sequences)

SEQ ID NO: 1 - DNA, 3170 bp, Arabidopsis thaliana
tctcaggtcggagctaaattttgagagtaaaataaaaaagcaaaagagagaaattgaaaaaaaaagaaagaaaaataatcctctcttgtttcggctagggtttcgtttttgtttcatcgataaactcaaaggagatggattcaacaaatggtaacggagctgatcttgaatcagcaaatggggcaaacgggagtggggttactgaggcattaccacctcctccaccagttatacctccaaatgtggaaccagttcgtgttaaaactgaacttgctgagaagaaggggccagttcgagttcctatggctcgaaaaggatttggaacaaggggccaaaagatccccttgttaacaaatcatttcaaagtcgatgtggctaatcttcagggtcatttcttccactacagtgtggctctattctatgatgatggtcgtcctgttgaacaaaagggtgttggaagaaaaatccttgacaaggtgcatcagacttaccattctgatctggatggtaaagagtttgcttatgacggtgagaagacgttgtttacatatggagctttgcctagtaacaagatggatttttctgtggtgcttgaggaagtatctgctacaagggctaatggaaacggaagccccaatgggaatgaaagtccaagtgatggtgataggaaaagactgcgtaggcctaaccggtccaaaaactttagagtggagatcagctatgcggccaaaattcctcttcaagctcttgctaatgcaatgcggggacaagaatcagagaattcccaggaggcaatacgggttcttgatatcatattgaggcaacatgctgctagacaaggttgcttgcttgttcgacagtcttttttccacaatgatccaaccaactgtgaaccagttggtggtaacatcttaggatgtaggggatttcactccagtttcagaacaacgcagggtggcatgtcacttaatatggatgttacaaccaccatgatcatcaagcctggtccagtggttgatttcctaattgctaaccaaaatgctagggacccttattcgattgactggtctaaggctaaacgaacccttaagaacctaagggtaaaggtcagcccctcaggccaagaattcaagataaccggattgagtgacaagccttgcagggaacaaacgtttgaattgaagaaaaggaacccaaatgaaaatggagagttcgaaactactgaagttacagttgctgactacttccgcgatacaaggcatattgatttgcaatattctgcggatttgccttgcatcaatgttgggaagccaaagcgacccacttacattcctctcgagctctgcgcgttggttccacttcagaggtacacaaaagcacttaccacgttccaaagatctgcccttgttgagaaatccagacagaaaccccaagagaggatgactgttctgtccaaagctctgaaagttagcaactatgatgcggaaccactcctgcgatcctgtggcatttcgatcagctccaactttactcaggtggagggtcgtgttctaccagctcccaagctgaaaatgggatgtggatctgaaacctttcccagaaatggtcgctggaacttcaacaacaaggaatttgttgagcccaccaaaattcaacgatgggttgttgtcaatttctctgctcgctgtaatgtacgtcaagttgttgatgatctgataaaaattggaggatcaaaaggaattgaaattgcttctccctttcaagtgtttgaggagggtaatcaattccgccgtgctcctcctatgattcgtgttgagaacatgtttaaggacatccaatcgaaactccctggtgtcccacaattcatactatgtgtgctccctgacaaaaagaacagtgatctctatggtccatggaagaaaaaaaacttaactgaatttggcattgttactcaatgcatggctccaacgcggcaacctaatgatcagtatcttactaacttacttctgaagattaatgcaaagcttggaggcctgaactcaatgttaagtgtagagcgtacacctgcgttcactgtgatttctaaggttccaaccattatccttgggatggatgtttcacatggatctcctggacagtctgatgtcccgtccatcgctgctgtggtgagttctagggagtggccactgatatccaaatatagagcatctgttcggacacagccttctaaggctgagatgattgagtcccttgtcaagaaaaatggaactgaagacgatggcattatcaaggagttgctggtagatttctacaccagctcgaataagagaaaaccagagcatatcataattttcagggatggtgtgagtgaatctcaattcaatcaggttctgaatattgaacttgatcagatcatcgaggcttgcaagctcttagacgcaaattggaacccaaagttccttttgttggtggctcaaaagaatcatcataccaagttcttccagccaacgtctcctgaaaatgttcctccagggacaatcattgacaacaaaatatgtcacccaaagaacaatgatttctacctctgtgctcacgctggaatgattggaactacccgcccaactcactaccacgtcctgtatgatgagattggtttttcagctgacgaacttcaggaacttgtccactcgctctcctatgtgtaccaaagaagcaccagtgccatttctgttgttgcgccgatctgctatgctcacttggcagctgctcagcttgggacgttcatgaagtttgaagatcagtctgagacatcatcaagccatggtggtatcacagctccaggaccaatctctgttgcacagctcccaagactcaaagacaacgtcgccaactccatgttcttctgttaaatgagcagccctacttggctcagtaagtaagtagtagttcaataggctatctgactttcagcttaggatctctctcggccttgaagccaggcatcgacactaaggcttggaatgttttttgtgactattatcgccagccttgtttgcctgttggggtttgaatatgcttttgtcccccttaacaattcggttgtttaattaaagacttattgtagtgaatatctaagttcaggaagttacccttttgtctaaatcgttctt

SEQ ID NO: 2 - DNA, 3189 bp, Arabidopsis thaliana
tctcaggtcggagctaaattttgagagtaaaataaaaaagcaaaagagagaaattgaaaaaaaaagaaagaaaaataatcctctcttgtttcggctagggtttcgtttttgtttcatcgataaactcaaaggtgatgattttagggtcttgagatggattcaacaaatggtaacggagctgatcttgaatcagcaaatggggcaaacgggagtggggttactgaggcattaccacctcctccaccagttatacctccaaatgtggaaccagttcgtgttaaaactgaacttgctgagaagaaggggccagttcgagttcctatggctcgaaaaggatttggaacaaggggccaaaagatccccttgttaacaaatcatttcaaagtcgatgtggctaatcttcagggtcatttcttccactacagtgtggctctattctatgatgatggtcgtcctgttgaacaaaagggtgttggaagaaaaatccttgacaaggtgcatcagacttaccattctgatctggatggtaaagagtttgcttatgacggtgagaagacgttgtttacatatggagctttgcctagtaacaagatggatttttctgtggtgcttgaggaagtatctgctacaagggctaatggaaacggaagccccaatgggaatgaaagtccaagtgatggtgataggaaaagactgcgtaggcctaaccggtccaaaaactttagagtggagatcagctatgcggccaaaattcctcttcaagctcttgctaatgcaatgcggggacaagaatcagagaattcccaggaggcaatacgggttcttgatatcatattgaggcaacatgctgctagacaaggttgcttgcttgttcgacagtcttttttccacaatgatccaaccaactgtgaaccagttggtggtaacatcttaggatgtaggggatttcactccagtttcagaacaacgcagggtggcatgtcacttaatatggatgttacaaccaccatgatcatcaagcctggtccagtggttgatttcctaattgctaaccaaaatgctagggacccttattcgattgactggtctaaggctaaacgaacccttaagaacctaagggtaaaggtcagcccctcaggccaagaattcaagataaccggattgagtgacaagccttgcagggaacaaacgtttgaattgaagaaaaggaacccaaatgaaaatggagagttcgaaactactgaagttacagttgctgactacttccgcgatacaaggcatattgatttgcaatattctgcggatttgccttgcatcaatgttgggaagccaaagcgacccacttacattcctctcgagctctgcgcgttggttccacttcagaggtacacaaaagcacttaccacgttccaaagatctgcccttgttgagaaatccagacagaaaccccaagagaggatgactgttctgtccaaagctctgaaagttagcaactatgatgcggaaccactcctgcgatcctgtggcatttcgatcagctccaactttactcaggtggagggtcgtgttctaccagctcccaagctgaaaatgggatgtggatctgaaacctttcccagaaatggtcgctggaacttcaacaacaaggaatttgttgagcccaccaaaattcaacgatgggttgttgtcaatttctctgctcgctgtaatgtacgtcaagttgttgatgatctgataaaaattggaggatcaaaaggaattgaaattgcttctccctttcaagtgtttgaggagggtaatcaattccgccgtgctcctcctatgattcgtgttgagaacatgtttaaggacatccaatcgaaactccctggtgtcccacaattcatactatgtgtgctccctgacaaaaagaacagtgatctctatggtccatggaagaaaaaaaacttaactgaatttggcattgttactcaatgcatggctccaacgcggcaacctaatgatcagtatcttactaacttacttctgaagattaatgcaaagcttggaggcctgaactcaatgttaagtgtagagcgtacacctgcgttcactgtgatttctaaggttccaaccattatccttgggatggatgtttcacatggatctcctggacagtctgatgtcccgtccatcgctgctgtggtgagttctagggagtggccactgatatccaaatatagagcatctgttcggacacagccttctaaggctgagatgattgagtcccttgtcaagaaaaatggaactgaagacgatggcattatcaaggagttgctggtagatttctacaccagctcgaataagagaaaaccagagcatatcataattttcagggatggtgtgagtgaatctcaattcaatcaggttctgaatattgaacttgatcagatcatcgaggcttgcaagctcttagacgcaaattggaacccaaagttccttttgttggtggctcaaaagaatcatcataccaagttcttccagccaacgtctcctgaaaatgttcctccagggacaatcattgacaacaaaatatgtcacccaaagaacaatgatttctacctctgtgctcacgctggaatgattggaactacccgcccaactcactaccacgtcctgtatgatgagattggtttttcagctgacgaacttcaggaacttgtccactcgctctcctatgtgtaccaaagaagcaccagtgccatttctgttgttgcgccgatctgctatgctcacttggcagctgctcagcttgggacgttcatgaagtttgaagatcagtctgagacatcatcaagccatggtggtatcacagctccaggaccaatctctgttgcacagctcccaagactcaaagacaacgtcgccaactccatgttcttctgttaaatgagcagccctacttggctcagtaagtaagtagtagttcaataggctatctgactttcagcttaggatctctctcggccttgaagccaggcatcgacactaaggcttggaatgttttttgtgactattatcgccagccttgtttgcctgttggggtttgaatatgcttttgtcccccttaacaattcggttgtttaattaaagacttattgtagtgaatatctaagttcaggaagttacccttttgtctaaatcgttctt

SEQ ID NO: 3 - DNA, 2340 bp, Arabidopsis thaliana
ttgagacaacctcgaagtaatgcaaacactttaaggccggatccgattcgtgacccgaatagtttccggattcggagcccaggtgttgtttctgtcttcggttcattgggaaggatgagtacattgttaccatttcctgacctcaacctcatgccggattctcaatcctccaccgccggaaccacagccggcgacactgtagtcaccggaaagttagaagtgaaatcggaaccaattgaggaatggcaaactccaccatcgtctacctccgatcaatcagccaataccgatctcatcgccgagtttattcgtatctcagagctcttccgctcggcattcaagccactgcaggtcaaaggattagacggagtctccgtatacggattggattctggtgccatcgttgctgtaccggagaaagaaaaccgggaattgattgaaccgcctccaggatttaaggataatcgagtctccaccgtcgttgtctcgccgaaattcgagagaccgagagagctagcgagaattgcaattctaggtcatgaacaacggaaggaactccgacaagtcatgaaacgaactaggatgacttatgagtctcttcggattcatctaatggcggagagtatgaagaatcatgtacttggtcaagggcgtagacggaggagcgatatggcggctgcgtatataatgagggatcggggactgtggttgaactatgataagcacatagttggtccagtcacaggggttgaagtaggggatatattcttctaccgtatggaattgtgtgtgctgggcttacacggccagacacaagccgggattgattgtttaacggctgaacggagcgccactggagagcctatagctaccagcattgttgtctcaggtggttatgaggatgatgaagatacaggagatgttttggtttatactggtcacggtggtcaggatcatcaacacaagcagtgtgataaccagaggctagtaggtgggaatctgggaatggagagaagtatgcactacggtatcgaggtacgtgtgattagaggtattaagtatgagaacagtataagctcgaaggtgtatgtatatgatggtttgtataagatagtagattggtggtttgctgtggggaagtctggttttggggtttttaaatttaggttagtaagaattgaagggcaaccgatgatgggcagtgcggtaatgaggtttgcacaaactcttagaaataagccatcgatggttaggcctactggttatgttagctttgacctttctaacaagaaggagaatgtacccgtgtttctatataatgatgtagatggtgatcaagaaccgagacattatgagtacattgcaaaagctgtctttcctcctggaatttttggtcagggggggatcagcaggactggctgcgagtgtaagctctcttgtactgatgattgtctctgtgcaaggaagaacggtggtgagtttgcatatgatgataacgggcatctattgaaaggaaagcatgtggtatttgaatgtggggaattctgcacttgtggtccgagctgtaagagccgtgtgacacagaagggattgaggaacaggctagaggttttcagatcgaaggaaaccggttggggtgtcaggacacttgatctaattgaagctggtgctttcatatgcgaatatgcaggtgtagttgtcacgagacttcaagccgagattctgtcaatgaatggggatgttatggtctatcctggtcggttcacagaccaatggcgtaactggggtgatttatctcaagtatacccagattttgttaggccgaattatccatctctccctccactggatttctcaatggatgtgtcaaggatgaggaacgtggcttgctacattagtcacagcaaagaaccaaatgtgatggtgcaatttgttttgcatgaccacaatcacctgatgttcccccgtgtgatgctttttgcgctggagaatatctcaccgttggccgagctaagcctggattacggcttggcagatgaagtgaacggcaagctcgccatctgcaactagtttttacaaagtttgtttttgtgctatagcttgagccttgagatggagaaaattttgatcaaagcctttctctgctcgtttgttgttatgtcttccaacctttctgtgaagcaagaatgggaggcatggtcggtgagtgttctgcatccattttttgggggtaaaaacttctctttgtcaaatgtgtttgtacttttgttctgttattaatgtactgaaatttttgtatgtttctctctcccccttatgttagagcttaagctgatatat

SEQ ID NO: 4 - DNA, 2534 bp, Arabidopsis thaliana
atacaccaaatcaaacacaccaccatttttacccagaaatttgagtaccaagagagctctttttcatcctaaagagatcttcaaatttagatttcaacacataaaagattctgtaggaaaatatttgtgtaagagcttcttctccgccatggatttagcttgaaaggtgttctccaaacaaaacccatttcttcgatttctctgataaactcgtcaaacccatttcgcttctcgttgcaaaaaatgggttcttctcacattcctcttgatccgtctctaaatccgtcaccttcactgatcccaaagcttgaaccagtcactgaatcaacccaaaacttggcctttcaacttccaaacacaaacccacaagccctaatttcatcagccgtctccgatttcaacgaagccacagacttttcctcagattacaacaccgtcgccgagtcagcccggtctgctttcgctcaacggcttcaacgtcacgatgatgttgcggttcttgattccttaaccggagcaatcgtaccggttgaggagaatccggaaccggaaccgaatccttactcaaccagtgactcttcaccgtcggttgctactcaacgacctagaccgcagccacgttcgtcggagctagtgaggatcactgatgttggacctgaaagtgagagacagtttcgtgaacatgtgaggaagacgagaatgatttatgattctcttaggatgtttttgatgatggaagaagctaaacgtaatggggttggtggaagaagagctagagctgatggtaaagctggtaaagctggttcaatgatgagagattgtatgttgtggatgaatcgtgataaacgaatcgtcggttcgattcccggtgttcaagttggggatatcttcttctttaggtttgagttatgtgtcatgggcttacatggacaccctcaatctgggatcgattttcttacagggagtcttagttctaatggggagccaatagctactagtgtgattgtttctggtgggtatgaggatgatgatgatcaaggagatgtgattatgtatacaggtcagggtggacaagataggcttggaaggcaagctgaacatcagaggctggaaggtggaaaccttgcgatggaacggagtatgtattatgggattgaagtgagagttattagagggttgaagtatgagaatgaggtttctagtagagtttatgtttatgatgggttgtttaggattgttgattcttggtttgatgttgggaagtctggtttcggtgtgtttaaatatcggttggagaggattgaaggacaggctgagatgggtagttcggtgttgaagtttgctaggactcttaagactaatccattgtctgtgagaccgagaggttacatcaatttcgatatctcgaatgggaaggagaatgttcctgtctatttgtttaacgacattgacagcgatcaagaacctttgtattatgagtatcttgcgcaaacttcgtttcctcctggcttatttgttcagcaaagtggtaatgcaagtggatgtgactgtgtcaatggttgtggcagtggctgcctttgtgaagccaagaattcaggtgagattgcttatgattataatgggacgctaataagacagaaaccgttgatacatgaatgtggatcagcgtgtcagtgccctccaagctgtcgaaaccgtgtgactcaaaagggtttgaggaataggctagaagtgtttaggtcactggaaacgggttggggagttcggtctttggatgtattacatgctggtgcttttatttgtgagtatgctggggttgctttgacaagggaacaagccaacattctgaccatgaacggtgatacattggtatatcctgctcgtttctcttctgcgagatgggaagattggggagatctgtctcaggtccttgctgatttcgagcggccttcttatcctgatattcctccggttgatttcgcaatggatgtgtccaagatgaggaatgttgcttgttacataagccacagtactgatccgaatgtcattgtccagtttgtactccatgatcacaacagtctcatgttccctagagtcatgcttttcgctgctgaaaacatccctcccatgactgagctcagccttgattacggagtagttgatgattggaacgccaagcttgccatttgtaattaaaattcaaccgttaaaatcgtggttcttggccatattttccagttggtgacatgaagaatgaaggaaaggaagtgtgcagaagctaaggtttaagagaccccactcctcccatttcgagtttttgggtatctttgaacatttgggagtgtgtgtttttgggggtaataggatacaaaacttaaaagctgtttgttttgtttgtactgttttgttcttgggtttgtctcgtactaatcaagtaaaacaaatgtctcgtactctatgactctctctttctaaattggtattagatgaaattacaccatatattttgatgaaaaacatttgcgttcaatcgt

SEQ ID NO: 5 - DNA, 3786 bp, Arabidopsis thaliana
ctctttcgtttactcgccgaagtcaaataaaaacgagagatggtttcagctatggcgggttctccctttttcgcatactcactaatcctctctccagtctccgcattgcttctatttctacctcgtatccagtattagattgaaaaagatctcactgtgagaaatggggtcagagggaaatatgaagaagtcggttgtgacacaagtaagcattggtggatttggggaatccactactgcaaaacaactcacagattaccttgaagatgaagtaggaattgtttggcgttgcagattaaaaacttcgtggactcctcctgggtcttatcctaattttgaaatcgcagacacttcaaatatccccagtattgatgaatataagaaagtggagcctcatgcctttgtccatttcgcagtttttgaatcagctggtcgtgccatggatgctgcagggcaatgcaacctcatcttggatggccagccgttaaaagtcagtttgggtcctaagaatccatattcccttaatcaaagaagaagaacgactgtaccttataagttggctggtattacacttgagattgggacattggtttctcgggatgatttttttgtttcttggagagctgaaggggttgatttcctggtggatccttttgacaacacgtgcaagttttgtttcagaaagagcactgccttctctttcaaggatgcagtgatgcatgctgtgatcaattgtgattataagttggagttattggtgagagatatacaaacagtcaggcagtataaaaccttgcatggctttgtgcttattttgcagctggcttcttcaccccgtgtctggtacagaactgctgatgatgatatttacgatactgtccctggcgatctcttggatgatgatgatccttggatccgtaccactgattttactcaagttggggcaattggtcgatgtcattcatatcgagtgctcatatctccgcggtatgaaaataaactgagaacagccttagattattttaggatgcggagggtgcaagaggaacgtgtgaggtggcctccccgtatccgtaatgagccttgttttggggagcctgtgtcagatcatttcttctgcattcatcacaaggaaggaatctcttttgagatcatgtttctagtaaattcggtattgcacaggggtgtctttaaccagtttcagttgactgagcgattctttgatcttctaagaaaccaacccaaggacgtcaatatagcttctctcaagcatctctgtacctataaacgaccagtttttgatgcgtacaagaggttgaagcttgttcaggaatggattcagaaaaatccaaagcttttagggagtcatgaacaatctgaggatatctctgagatcagaagactagtaattaccccaaccagagcctattgcctacccccagaagttgagctctccaacagggtactcaggagatacaaagctgttgctgaaagatttttgcgggtaactttcatggatgaaagtatgcagaccataaattcgaatgttctctcttactttgttgctcctattgtgaaggatttgacatcaagttctttctcccagaagacctacgtttttaaaagagtgaagagcatattaaccgatgggtttaaactatgtggtagaaaatacagttttctagcattctcagccaatcaactgagagaccgctctgcatggttctttgctgaagacgggaaaacacgtgtgtcagatataaaaacatggatggggaagttcaaagacaagaatgtggcaaaatgtgctgctaggatgggcctgtgcttctcctccacatatgccactgtagatgtcatgcctcacgaggttgacactgaggttccagatattgagagaaatgggtatgttttctctgacggaattggtacaatcacacctgacctcgctgacgaagtaatggagaaacttaagttggatgtgcactacagcccttgtgcttatcagatacgttacgcaggtttcaaaggggttgttgctcgttggccatcaaaaagtgatggaatcaggctagcccttcgagacagtatgaagaagttcttttccaaacatacgatcttggagatctgttcctggacgaggtttcaacctgggttcttaaatcggcagataattacccttctatccgtactaggtgttccggatgaaatattctgggatatgcaggaatccatgctctataaactgaaccgcatccttgatgatacagatgtggcatttgaagttctcacggcatcatgtgctgaacagggaaacactgcagctatcatgcttagtgcaggtttcaaaccaaaaaccgagccgcatctacgcgggatgttgtcttcagtcagaattgcacaactctggggtctcagagaaaaatctcgtatttttgttacttcaggaaggtggctaatgggttgcctagacgaagcagggatacttgaacatggccaatgctttattcaagtctctaaaccgtctatagaaaattgtttctccaaacatgggtctcgttttaaggagacaaagacagatctggaagtagttaaaggctatgtagccattgctaagaatccttgtcttcacccaggggatgtaaggattttagaagctgttgatgtaccccagctgcatcacatgtatgactgccttattttccctcagaaaggtgataggccgcatacaaacgaagcttctggcagtgaccttgacggggacctgtactttgtggcttgggatcagaaactcatccctcccaacaggaaaagctatccggccatgcattatgatgcagctgaagagaagagtttaggccgtgctgtcaaccaccaggacataatcgatttctttgcaagaaacttggcgaatgagcagttgggcacaatttgcaatgcacacgtcgttcatgctgatagaagtgagtatggagccatggacgaagaatgtttgctactggcagaactagctgccactgcagttgatttcccaaagacagggaaaattgtgtcaatgcccttccacctaaaaccaaaactctacccagatttcatgggaaaagaagactaccaaacttacaagtcgaacaaaatcttgggtcggctttacagacgggtaaaagaggtttatgatgaagatgcagaagcttcctcagaagaaagcacagacccaagtgccatcccttatgacgctgttcttgaaataccgggatttgaagatttgatccctgaggcatggggtcacaaatgtttgtacgacgggcaactcattggtcttcttgggcaatacaaggtgcagaaagaggaagagattgtgacgggtcacatctggtccatgcccaaatacacaagcaagaaacaaggcgaactgaaagaaagactgaagcattcttataattcccttaaaaaggagttcaggaaagtatttgaggaaacaatccctgaccatgaaaatctcagcgaggaggaaaaaaacatcttgtatgagaagaaggcttcagcttggtatcatgtaacttaccatcccgagtgggtgaagaagtctttagagctgcaagatccagatgagtccagtcatgcggcgatgctgagttttgcttggattgcagctgattatcttgcaagaatcaaaatccggtcacgggaaatgggaagtatcgactcagccaagcctgttgattctttggctaagtttcttgctcagcgtctctaaaaggttatgtttaatgccgtaaggccactctg

SEQ ID NO: 6 - DNA, 3452 bp, Arabidopsis thaliana
atggtgtcagagacgacgacgaaccgatcaacggttaaaatctcaaacgttcctcaaaccatagtcgccgacgaactcctccggttcttagaactccacctcggcgaagatactgtattcgcactcgaaatcccaacaactcgtgacaattggaagccaagagacttcgctcgagtacaattcactaccctcgaagtcaaatctcgagcccagcttctctcttctcaaagcaagctccttttcaaaacccataacctaagactctctgaagcttatgatgatatcatccctcgtcctgtagatccaaggaaaaggctagacgacatcgttttgactgttgggtttcctgagtctgatgaaaaaaggttttgtgccctagaaaaatgggatggtgtgaggtgttggattttgactgagaagagaagagttgagttttgggtttgggaaagtggtgattgttataagattgaagttaggtttgaggatattattgaaactcttagttgttgtgttaatggtgacgcttctgagattgatgcatttcttctcaagctgaaatatggaccgaaggtatttaaaagagtaacagttcacatagccacaaagtttaagtctgatcggtacagattctgcaaggaggattttgatttcatgtggattcggacaactgatttctctggttcgaaatcaattggtacatcaacttgcttttgtttggaagtccacaatggctcaacgatgttagacattttctcgggcttaccttactaccgagaagacactttgagtctaacttatgtggatgggaagacctttgcttctgcagctcaaattgttcccctcttgaatgccgccattttggggttagagtttccatatgagatccttttccaactcaatgcgcttgttcatgcgcagaaaatcagtctttttgctgcgtcagatatggaactgatcaaaatccttcgtggtatgagtttggaaaccgcattggtgatcctcaagaaacttcaccagcaaagttctatatgttatgatcctgtcttctttgtcaagactcagatgcaatctgtggttaagaagatgaagcattcccctgcatcagcttataaaagattgaccgagcagaacatcatgagttgtcagagagcttacgttacaccctcaaagatctatctgttgggtccagagcttgagactgcaaattatgttgtgaagaactttgcagagcatgtctcggatttcatgagagttacttttgtggaagaagattggagcaagcttcccgcaaatgctctctctgtgaactccaaggaaggctattttgtgaagccctctagaaccaacatttataacagggtgttgtcaatccttggagaagggattaccgttgggcctaagaggtttgagttcttggctttttcagcgagccaactgcgaggaaattcggtctggatgtttgcttctaacgagaaagtaaaagcggaagatataagagaatggatgggttgtttccgtaaaatccgaagcatttccaaatgtgctgctaggatgggtcagttgttcagtgcttcgcggcaaacacttattgtccgtgcacaagatgtggagcagattcccgacatcgaagtgacaactgatggtgctgattactgcttctcggatggcattgggaaaatttcacttgcatttgccaagcaagttgcacagaagtgtggattgagtcatgtcccttctgcctttcaaattcgatacggtggctacaaaggtgtgattgctgttgaccgcagttccttccgaaagttgtctctgcgtgatagtatgcttaaatttgactcgaacaacaggatgctgaacgttaccaggtggacagagtcgatgccttgcttcttaaaccgggagatcatttgccttttgtcgacccttggaatagaagatgcaatgtttgaggcgatgcaagcggtgcatttatctatgcttgggaatatgcttgaagaccgcgatgcagcacttaatgttctgcagaaattgagcggagaaaattccaagaatttgctagttaagatgctgcttcaaggatatgcaccgagttcagaaccttacctctcaatgatgcttcgtgtgcaccacgagagccagctttctgaactaaagagcagatgcaggatacttgtaccgaaaggacggatcttgatcggttgcatggatgaaatgggtatcctggagtatggccaagtgtatgttcgtgtaaccctgactaaagcggaactgaaatctcgcgatcagagctactttcgcaagattgatgaggaaacatctgtggttattgggaaagtggtcgtgacgaaaaacccatgtcttcaccctggagatattagagttcttgatgctatatatgaggtccatttcgaagaaaagggatatctcgactgcatcatctttcctcagaagggagaaagaccacatccaaatgaatgttctggtggcgatctcgacggagaccagttttttgttagctgggatgagaagattatacctagcgaaatggaccctccaatggactatgctggaagcaggcctcgtctaatggatcatgacgtcacgttagaggaaatccacaaattttttgtggattatatgataagcgacacgcttggggtgatctcaactgcacatttggttcacgcagaccgtgaccctgaaaaagcccggagccagaagtgtctagagttagcaaatcttcactctagggctgttgattttgcaaaaactggagctccagctgagatgccttatgccttaaagcccagagagttccctgattttctggaacggtttgagaaaccaacatacatctctgagtctgtgtttgggaaactataccgtgctgtgaagagctctctagcacagagaaagccagaagctgagagcgaggacacggtagcttatgatgtgacacttgaagaagctggctttgagagctttatagagacagcgaaagcccatagagacatgtatggtgagaaactgacctcgttgatgatatactatggagctgctaacgaagaggagattctcacaggcattttgaaaaccaaggagatgtatctggcgagagataaccggaggtatggtgatatgaaggatagaattacgctttccgtgaaagatttgcataaagaggccatgggatggttcgagaaaagctgcgaggacgaacaacagaagaagaagctagcatcggcgtggtactatgtaacatacaatccaaaccatcgcgatgagaagttgacattcttgagtttcccatggatcgtaggtgacgttttgcttgatataaaggctgaaaatgcacagagacagagcgttgaagagaaaacaagtggacttgtatccatttgattgccctatataacacttggtgtagtagaattgctagttaaaggactata

SEQ ID NO: 7 - DNA, 3955 bp, Arabidopsis thaliana
aatttcttcacttctctttgactgcttcgcttaaccactgaaaaagtgtgccaagggttttctacgtcgaatctctccgcattctcagcgattttccggcgacgtttactctgcactcctccgacaccgccgttttactccatcgtgccagctttaagcaatcaagggtttttgttcgtacagtgtgttttgaggtatgccagatatggacattgatgtgaaggatcttgaagagttcgaggctactactggggagatcaatctatctgagctaggagaaggttttctgcagagtttctgcaaaaaagctgcaacttctttctttgataagtatggacttataagtcatcagctcaactcctacaactacttcattgaacacgggcttcagaatgtgtttcaatcctttggtgagatgcttgtggaaccgtcttttgatgttgtaaagaagaaggataatgattggagatacgcaacggtgaagttcggagaagtcactgtggagaagcctactttcttttcggatgacaaggagcttgagtttctcccatggcatgctaggcttcagaacatgacatactctgcaaggatcaaagtcaatgtccaagttgaggtgttcaagaatactgttgttaaaagcgacaaattcaagacaggacaagacaactatgtcgagaagaagatactggatgtcaaaaagcaggacattctaattggtagcattcctgtcatggtgaaatctatcctttgcaaaacaagcgagaaagggaaagaaaactgcaaaaagggggattgtgcctttgatcagggtggatatttcgtgataaagggggctgagaaggtgtttatagctcaagaacagatgtgcacaaagagactgtggatttctaattcaccatggacagtctccttcaggtccgaaaataaaagaaatagattcattgtgcgcctctcggagaatgagaaagcagaagactataagagaagggagaaagtactgacagtgtacttcttgtcgactgagattccagtctggctcctcttctttgcgctaggtgtttcgtcagacaaagaagccatggatctaattgcttttgatggtgatgatgcaagcattaccaacagtctcatagcttctatccatgtagctgatgcagtttgtgaagcttttcgctgtgggaacaatgctttaacatatgttgaacagcagatcaaaagcaccaaattccctcctgctgaaagtgtggatgagtgcctccatctgtatttgtttccaggcctccaaagtttgaagaagaaagctcgattcctgggctatatggtgaagtgccttctgaactcgtatgcgggaaaaagaaaatgcgaaaacagggacagtttccggaataagcgaattgagctcgctggagaactattggagagggagataagggtgcatctggcacatgctagaagaaagatgaccagggccatgcagaaacacctctcaggcgatggtgatttgaagcctattgagcattatttggatgcttctgttatcacaaatgggcttagtagagccttctctactggagcatggtctcatcctttcaggaagatggaaagggtttcaggtgttgtggctaatttgggtcgtgcaaatccattgcagactctgattgatctgaggagaacgcgacagcaagtcttatataccggcaaggttggagatgctagatatccgcacccctctcactggggcagagtatgctttttgtcaactccagacggtgaaaattgtggtcttgtgaagaacatgtctcttctgggacttgtgagcacccaaagtttggagtctgtggtggaaaagctcttcgcttgtggaatggaagagctgatggatgatacatgcacaccattgtttggcaaacataaagttcttctcaatggagactgggttggattatgtgcagattctgaatcctttgtcgcggagttaaaaagcaggcggcgccaaagtgaattacctcgtgagatggaaatcaagcgagataaagatgacaatgaggtaagaattttcactgatgctggtagactactccgacctctcttggttgtggaaaatctccaaaagttgaagcaagaaaaaccttcacagtatccttttgaccatcttcttgaccatgggattctcgagctgatcgggattgaggaagaagaagactgtaatacagcatggggaatcaaacagcttctgaaggaaccaaagatatacacacattgcgaattggacctgtcattcttgttgggtgtgagctgtgcagttgtcccatttgcaaatcacgaccatgggagaagagttctctaccagtcccagaagcactgccaacaagccattggattctcatcaacgaaccctaacatccgctgcgatacgctgtcccagcagctgttctatcctcagaagccactgttcaagacattggcgtcggagtgtcttaaaaaagaagtgctgttcaatggccagaacgcaattgttgctgtgaatgttcatctcgggtacaaccaagaggattccattgtgatgaacaaggcttcattggaacgtggtatgttccgttcagagcagattagaagctacaaagcagaggttgatgctaaagactcagagaagaggaagaagatggatgagcttgttcagtttggaaagacacacagcaaaatcggcaaagtagacagccttgaagatgacgggtttcctttcattggtgctaacatgagtactggcgatattgtcattggcagatgcaccgagtctggggctgatcacagtataaagctcaagcacactgagagaggaattgtgcaaaaagtggtattatcatctaatgatgaagggaagaattttgctgcggtttctctgagacaggttcgttctccatgccttggagataagttttccagtatgcatggccagaagggtgttttaggctacctagaggaacagcagaattttcctttcacgatccaaggcatagttcctgatattgtgataaacccgcacgctttcccttctaggcaaacaccaggtcaactcttggaggctgctctctccaaaggaatcgcttgtcctatacaaaaggagggtagctctgctgcatacaccaaattgacacgtcatgccactcctttctccactccgggtgtcactgaaatcaccgagcagcttcacagggccggcttttcaagatggggaaacgaaagggtctacaacggtagatcaggtgagatgatgcgttctatgatattcatgggcccaactttctaccagcgacttgtccacatgtcagaggacaaagtcaagttcaggaacactggaccagtccacccgctcacacgccagccagttgcagacaggaagagatttggcgggataaaatttggagaaatggagcgagactgcctaatagctcacggtgcatcagctaatctgcatgagcgtctcttcactctaagtgactcttctcagatgcacatctgcagaaaatgtaagacctatgcgaatgtgatcgagaggactccaagcagtggaagaaagattagagggccatattgtagagtctgcgtatcctcagaccatgtggttagggtctatgttccgtatggagctaagcttctgtgtcaggagctgttcagcatgggcatcactctcaacttcgacaccaagctatgctgattccccctctttattatgtaaatggcttattgccttaagaccatgttatgtgtagtttgcttcagtcccggttctggttagtagtataggttttggtttggttgattcggtaagggttatccgaaccgaagaaatcgtaaaaccgagccactgatgactgaactaacccgtaagtgttgcttttgtgagatttgactctttaaccgttaataattctcggatctaaagtaaagttttagg

SEQ ID NO: 8 - DNA, 3993 bp, Arabidopsis thaliana
tactagtactagtgacgtcaatttcttcacttctctttgactgcttcgcttaaccactgaaaaagtgtgccaagggttttctacgtcgaatctctccgcattctcagcgattttccggcgacgtttactctgcactcctccgacaccgccgttttactccatcgtgccagctttaagcaatcaaggtacctattttagggtttttgttcgtacagtgtgttttgaggtatgccagatatggacattgatgtgaaggatcttgaagagttcgaggctactactggggagatcaatctatctgagctaggagaaggttttctgcagagtttctgcaaaaaagctgcaacttctttctttgataagtatggacttataagtcatcagctcaactcctacaactacttcattgaacacgggcttcagaatgtgtttcaatcctttggtgagatgcttgtggaaccgtcttttgatgttgtaaagaagaaggataatgattggagatacgcaacggtgaagttcggagaagtcactgtggagaagcctactttcttttcggatgacaaggagcttgagtttctcccatggcatgctaggcttcagaacatgacatactctgcaaggatcaaagtcaatgtccaagttgaggtgttcaagaatactgttgttaaaagcgacaaattcaagacaggacaagacaactatgtcgagaagaagatactggatgtcaaaaagcaggacattctaattggtagcattcctgtcatggtgaaatctatcctttgcaaaacaagcgagaaagggaaagaaaactgcaaaaagggggattgtgcctttgatcagggtggatatttcgtgataaagggggctgagaaggtgtttatagctcaagaacagatgtgcacaaagagactgtggatttctaattcaccatggacagtctccttcaggtccgaaaataaaagaaatagattcattgtgcgcctctcggagaatgagaaagcagaagactataagagaagggagaaagtactgacagtgtacttcttgtcgactgagattccagtctggctcctcttctttgcgctaggtgtttcgtcagacaaagaagccatggatctaattgcttttgatggtgatgatgcaagcattaccaacagtctcatagcttctatccatgtagctgatgcagtttgtgaagcttttcgctgtgggaacaatgctttaacatatgttgaacagcagatcaaaagcaccaaattccctcctgctgaaagtgtggatgagtgcctccatctgtatttgtttccaggcctccaaagtttgaagaagaaagctcgattcctgggctatatggtgaagtgccttctgaactcgtatgcgggaaaaagaaaatgcgaaaacagggacagtttccggaataagcgaattgagctcgctggagaactattggagagggagataagggtgcatctggcacatgctagaagaaagatgaccagggccatgcagaaacacctctcaggcgatggtgatttgaagcctattgagcattatttggatgcttctgttatcacaaatgggcttagtagagccttctctactggagcatggtctcatcctttcaggaagatggaaagggtttcaggtgttgtggctaatttgggtcgtgcaaatccattgcagactctgattgatctgaggagaacgcgacagcaagtcttatataccggcaaggttggagatgctagatatccgcacccctctcactggggcagagtatgctttttgtcaactccagacggtgaaaattgtggtcttgtgaagaacatgtctcttctgggacttgtgagcacccaaagtttggagtctgtggtggaaaagctcttcgcttgtggaatggaagagctgatggatgatacatgcacaccattgtttggcaaacataaagttcttctcaatggagactgggttggattatgtgcagattctgaatcctttgtcgcggagttaaaaagcaggcggcgccaaagtgaattacctcgtgagatggaaatcaagcgagataaagatgacaatgaggtaagaattttcactgatgctggtagactactccgacctctcttggttgtggaaaatctccaaaagttgaagcaagaaaaaccttcacagtatccttttgaccatcttcttgaccatgggattctcgagctgatcgggattgaggaagaagaagactgtaatacagcatggggaatcaaacagcttctgaaggaaccaaagatatacacacattgcgaattggacctgtcattcttgttgggtgtgagctgtgcagttgtcccatttgcaaatcacgaccatgggagaagagttctctaccagtcccagaagcactgccaacaagccattggattctcatcaacgaaccctaacatccgctgcgatacgctgtcccagcagctgttctatcctcagaagccactgttcaagacattggcgtcggagtgtcttaaaaaagaagtgctgttcaatggccagaacgcaattgttgctgtgaatgttcatctcgggtacaaccaagaggattccattgtgatgaacaaggcttcattggaacgtggtatgttccgttcagagcagattagaagctacaaagcagaggttgatgctaaagactcagagaagaggaagaagatggatgagcttgttcagtttggaaagacacacagcaaaatcggcaaagtagacagccttgaagatgacgggtttcctttcattggtgctaacatgagtactggcgatattgtcattggcagatgcaccgagtctggggctgatcacagtataaagctcaagcacactgagagaggaattgtgcaaaaagtggtattatcatctaatgatgaagggaagaattttgctgcggtttctctgagacaggttcgttctccatgccttggagataagttttccagtatgcatggccagaagggtgttttaggctacctagaggaacagcagaattttcctttcacgatccaaggcatagttcctgatattgtgataaacccgcacgctttcccttctaggcaaacaccaggtcaactcttggaggctgctctctccaaaggaatcgcttgtcctatacaaaaggagggtagctctgctgcatacaccaaattgacacgtcatgccactcctttctccactccgggtgtcactgaaatcaccgagcagcttcacagggccggcttttcaagatggggaaacgaaagggtctacaacggtagatcaggtgagatgatgcgttctatgatattcatgggcccaactttctaccagcgacttgtccacatgtcagaggacaaagtcaagttcaggaacactggaccagtccacccgctcacacgccagccagttgcagacaggaagagatttggcgggataaaatttggagaaatggagcgagactgcctaatagctcacggtgcatcagctaatctgcatgagcgtctcttcactctaagtgactcttctcagatgcacatctgcagaaaatgtaagacctatgcgaatgtgatcgagaggactccaagcagtggaagaaagattagagggccatattgtagagtctgcgtatcctcagaccatgtggttagggtctatgttccgtatggagctaagcttctgtgtcaggagctgttcagcatgggcatcactctcaacttcgacaccaagctatgctgattccccctctttattatgtaaatggcttattgccttaagaccatgttatgtgtagtttgcttcagtcccggttctggttagtagtataggttttggtttggttgattcggtaagggttatccgaaccgaagaaatcgtaaaaccgagccactgatgactgaactaacccgtaagtgttgcttttgtgagatttgactctttaaccgttaataattctcggatctaaagtaaagttttaggaaaact

SEQ ID NO: 9 - DNA, 3715 bp, Arabidopsis thaliana
ctcgtcgactgctcgcttaaccattgaaaaagtgagccaagggttttgattattttcgacgtctacggcgaatctctccgcatcttcatcgatttcccggcgacgtttactaccgccgttttactcaatcgtgccagcttaagcaatcgagtgtgtattgaggtataccagagatagacataaatgagatggatgttgacgagatcgagtctgctgggcagatcaatatttctgagctaggagaaagttttctccagactttctgcaaaaaagctgcgacatctttctttgaagagtttggacttataagtcatcagcttaactcctacaacttcttcattgaacacgggcttcagaatgtgtttgagtcctttggtgacattcttgtggaaccgtcttttgatgtaataaagaagaaggatggcgattggagatacgcaacggtgaaatttggaaaagtcactttggagaagcctacattcttttcggatgacaaggagcttgagtttctcccatggcatgcaggcttcagaacatgacatactcagcaaggatcaaagtcaatgcccaagttgaggtgttcaaaaaaattgttattaaacacgacaaattcaagactggacaagatgaatatgtcgagaaggagatactggatgtcaaaaaacaggacattctaattggtagcatacctgtcatggtgaaatctgtcctttgcaaaactagcgagaaaggaaaagaaaactgcaaaaaggggaattgtgcctttgatcagggtggatattttgtgataaagggggctgagaaggtgtttatagctcaagaacagatgtgcacaaagagattgtggatttctaattcaccatggacagtctccttcaggtccgaaactaaaagaaataggttcattgtgcgcctctcggagaatgagaaagcagaagactataagataatggagaaagtactgacagtgtacttcttgtcgactgagattccagtctggctcctgttctttgcgttgggtgtttcatcagacaaagaagccatggatctaattgctttcgatggtgatgatgcaagcattaccaacagtctcatagcttctatccatgaagctgatgcagtgtgtgaagcttttcgctgtgggaacaatgccctaacatatgttgaacatcagatcaaaagcaccaaattccctcctgctgaaagtgtggatgattgcctccgtctgtatttgtttccatgcctccaaggtttgaagaagaaagcccgattcctgggctatatggtgaagtgccttttgagcgcgtatgcgggaaaacgaaaatgtgaaaacagggacagtttccggaataaacgaattgagctcgctggagaactgttggagagggagataagggtgcatcttgcacatgctagaagaaagatgaccagggccatgcagaaacaactctcaggcgatggcgatttgaagcctatagagcattatttggatgcttccgttatcaccaatgggcttaatagagccttctccactggagcatggtctcatcctttcaggaagatggaaagggtctcaggtgttgtagctaatttgggtcgtgcaaatccattgcagactctgattgatctgaggagaacgcgacagcaagtcctttataccggcaaggttggagatgctagacatccgcatccttctcactggggcagagtatgctttttgtcaactccagatggtgaaaattgtggtcttgtgaagaacatgtctcttcttggacttgttagcactcaaggtttggagtctgtggtggaaatgctctttacttgcggaatggaagagctgatgaatgataccagcacaccattgtgtggcaaacacaaagttcttctcaatggagactgggttggattatgtgcagattctgaatcctttgtcggggagttaaaaagcaggcggcgccaaagtgaattacctctcgagatggaaatcaagcgagataaagatgacaatgaggtgagaattttcactgacgctggtagactactccgacctctcttggttgtggaaaatctccacaagttgaagcaagacaaacctacacagtatccttttaagcatcttcttgaccaagggattctcgagctgatcgggattgaggaagaagaagactgtactacagcatggggaatcaaacagcttctgaaggaaccaaagaattacacgcattgcgaattggacctatcattcctgttgggtgtgagctgtgcaattgtcccatttgcaaatcacgatcatgggaaaagagttctttaccagtctcagaagcattgccaacaagccatcggattctcatcaacgaaccctaacatccgctgcgatacgctgtcccagcagctgttctatccccaaaagccacttttcaagacattggcgtcagagtgtcttgaaaaagaagttctatttaatggccagaacgcaattgttgctgtgaatgttcatctcgggtacaaccaagaggactccattgtgatgaacaaggcttcattggaacgtggtatgttccgttcagagcagattagaagctacaaagcagaggttgatactaaagactcggagaagaggaagaagatggatgagcttgttcagtttggaaagacatacagcaaaatcggcaaagtagacagccttgaagatgacgggtttcctttcattggtgctaacatgagtactggcgatattgtcattggcagatgcaccgagtctggggctgatcacagtataaagctcaagcacactgagagaggaattgtgcaaaaagtggtattatcttctaatgatgaagggaagaattttgcagcggtttctctgagacaggttcgttctccatgccttggagataagttttccagtatgcatggccagaagggtgttttaggctatctagaggaacagcagaattttcctttcacgatccaaggcatagttcctgatattgtgataaacccgcacgctttcccttctaggcagacaccaggtcaactcttggaggctgctctctccaaaggaatcgcttgtcctatacaaaagaaggagggtagctctgctgcatacaccaaattgacacgtcatgccactcctttctccactccgggtgtcactgaaatcaccgagcagcttcacagggccggcttttcaagatggggaaacgaaagggtctacaatggtagatcgggtgagatgatgcgctctctgatattcatgggcccaactttctaccagcgacttgtccacatgtcagagaacaaagtcaagttcaggaacaccggaccagtccacccgctcacacgccagccagtcgcagaccggaagaggtttggcgggataagatttggagaaatggagcgagactgcctaatagctcacggtgcatccgctaatctgcacgagcggctcttcactctaagtgactcttctcagatgcacatctgcagaaaatgcaagacctatgcgaatgtgatcgagaggactccaagcagtggaagaaagatcagagggccatattgcagagtgtgcgcatcctccgaccatgtggttagggtctatgttccttatggagctaagcttctttgtcaggagctgttcagcatgggcattactctcaacttcgacaccaagctctgctgattccccgtcattattatgtaaatagcttaatgc

SEQ ID NO: 10 - DNA, 4948 bp, Arabidopsis thaliana
ttggacttagagaagagtttttttttcgttttctctgctttctcactttttcccgtttcctttgggaatacaaacggcggcttctcaaaagcctccgatttcgatttttttttcctctctttttttttgttctttctttagagtctcttcttcaacttcttctccggcatcttccgtcggagctaaggatcagaagtttttgtctgtgcactgtttcaattggatcattacatagtgaggattctctgttcgacgaaacgagaaactcttcaacatggaagacgattgtgaggagcttcaggttcccgtgggaactctaacctcgataggttttagcatttcaaacaacaatgatcgagataaaatgtctgtgctagaggttgaagcaccgaatcaggtgactgattctcggctaggattaccgaatccggattctgtctgcagaacctgtggcagcaaagatcgaaaagtttgcgaagggcatttcggggttataaacttcgcgtactcgataataaacccgtatttcctcaaggaggtagctgcgttgttaaacaaaatctgtccggggtgtaaatacattcgaaaaaagcagtttcagattaccgaagaccagcctgagagatgtagatactgcactttgaataccggttatcctctaatgaagtttagggtaactactaaagaagtcttcaggcgatccggaatcgttgttgaagtaaacgaagagagtctgatgaaactcaagaaacggggagtgttaacattgcctcctgactattggagttttttgccgcaagactctaatatcgacgagagctgtttgaaaccaacaaggcgaataataacgcatgcacaggtttatgctctgttattagggattgatcagaggctcatcaagaaggatatccctatgttcaactctcttggtctgacatcttttcctgttacaccaaatggttaccgtgtaaccgaaatagttcatcagttcaacggagctcggctaatatttgatgaacggactcggatctacaagaaactagtcggctttgagggaaacacacttgaattgagttctcgtgtgatggaatgcatgcaatattccagactcttttcggaaactgtgtcttcgagtaaagattccgcaaatccgtaccagaagaagtctgatacaccaaaactttgcggtctaaggttcatgaaagacgtgctgctcggtaaaagaagtgatcatacattccggacagtagttgttggtgatccgtccttgaagctcaacgagattggcatacccgagagtatcgcaaaaaggcttcaagtatcagagcatctcaaccagtgcaataaagaaaggcttgtcacttcctttgtccccacactgttggacaataaagagatgcatgtgagaagaggagatagattggtggctattcaagtcaatgacctccaaaccggagacaaaatattccggagtttaatggatggagacactgtgctgatgaacagaccgccttcgattcatcagcattcgcttattgcaatgacagttagaatcctcccaacgacttctgttgtctccttgaacccgatctgctgtttgccgttccgtggtgattttgatggagattgtctccacggttacgttcctcagtccattcaagcaaaggtcgagcttgatgagcttgttgctttggataagcagcttatcaacagacagaatggtcggaacttgctttctttaggacaagatagcttgacggcggcttatctggtcaatgttgagaagaactgttatcttaatcgagctcagatgcagcagcttcaaatgtattgcccatttcagcttcctccgcctgcaattatcaaagcttctccttcgagcactgagcctcaatggacgggaatgcagctattcggaatgctgtttcctcccgggtttgactacacttatcctctgaataatgtagttgtgagtaacggcgagcttttgtctttctctgaaggatctgcttggctcagagatggagaagggaatttcatcgagagattgctcaaacacgacaaagggaaagttcttgatatcatctattccgctcaagaaatgctatctcagtggttgctgatgcgcggtttgagtgtgtccttggcggatttgtacctttcctctgatctgcagtctcgaaaaaacttgactgaagagatatcatacgggttgcgggaagctgagcaagtttgcaacaagcaacagctaatggttgaatcttggagagatttccttgcagttaatggggaggataaggaagaggattcagtatcggatttggcccgattctgctatgagagacaaaaatccgctacattaagcgaacttgcagtcagtgcttttaaggatgcttacagagatgttcaggcactagcatataggtatggtgatcaatccaactcttttttgatcatgtcgaaagccggcagcaaagggaatatcgggaagctggttcagcacagcatgtgtatcggtctgcagaattcagcagtttctttgtcctttgggtttccgcgtgaactgacttgcgctgcttggaatgacccgaacagtccacttcgtggcgcaaagggaaaagacagtaccactactgagtcatatgttccttatggagtcattgagaactcgtttctaacgggtctgaatccattggaatcttttgttcattcagttacaagtcgtgacagttcattcagtggtaatgctgatctcccggggacactgagcagaagattaatgttcttcatgcgggacatatacgctgcttatgatggcactgtgagaaattctttcggaaaccagttagtccagtttacttatgagactgatggtcccgttgaagatatcacaggtgaggcacttggctcactttctgcttgtgcattatctgaggcagcttacagcgcgctggaccagccaatcagccttcttgaaacttcgccgcttctgaatcttaagaatgtattggagtgtggatcaaagaaaggtcaacgagaacagacaatgtctttgtatttgtctgaatacctttcaaagaaaaagcacgggttcgaatacgggtcacttgagatcaagaaccacttggagaaacttagtttctcagagatcgtttcaacatctatgataatattctctccaagttctaacacgaaagtaccgttaagcccgtgggtttgccattttcatatctctgagaaagtactgaagcggaaacaactgagcgcagaatccgttgtttcatctttaaacgagcagtacaagagcaggaacagagaactgaagcttgatatagttgacttagatatacaaaacacaaaccactgctcttcagacgatcaggcaatgaaggatgataacgtttgcatcacggtgactgtagttgaagcctcaaagcactcggttttggaactggatgctattcgtctcgttttgatcccttttcttcttgactctcctgtcaaaggtgatcaagggatcaaaaaggtgaatattttgtggactgaccgaccaaaagcgccaaaaaggaatgggaatcatttggcgggtgagctgtacttgaaggttacaatgtatggagatcggggcaaaagaaactgttggaccgctcttttagaaacctgccttcccatcatggatatgattgactggggccgaagccatcctgataatatccgacaatgctgctcagtttatggaatagatgctggacgcagcattttcgtagcaaatttggagtccgcggtgtcagatactggtaaggagatactaagagagcatctgcttctcgtagctgatagtctctctgttacgggagagtttgtggcattaaacgccaaaggttggagtaaacaaagacaggtcgagtccacgcctgcaccttttactcaagcatgcttctcaagcccaagtcaatgctttctcaaagctgctaaggaaggtgtcagagacgatcttcaagggtctatcgacgctttagcttggggaaaagttcctggtttcggaactggagatcagttcgaaatcatcatttcgccaaaggttcacgggtttactacaccggtagatgtgtatgaccttttgagtagtacaaagacgatgcgtagaacaaactctgcgcctaaatcagacaaagccacggtccagccttttggcttgctacattccgcattcctgaaagatatcaaggtactcgatgggaaagggattcctatgtcactgcttagaacgatctttacatggaaaaacatcgagttgctttcccagtcattgaaacgcattctccacagttacgagatcaatgaactgttgaatgagagggacgaaggacttgtgaagatggttctgcagttgcaccccaacagtgttgagaaaattggaccaggcgtcaaaggaatccgggtcgctaaatcgaagcacggagattcttgttgcttcgaggttgtaagaatagacgggacattcgaagacttctcataccacaagtgtgtcttgggagcaacaaagataattgccccaaagaaaatgaacttctacaagtcaaagtatcttaaaaatggtacactcgagtccggtggtttctccgaaaacccgtgaacagccaagtaagagtaaaaaaaaagactggctcttctgcggtataatatcgaacaatgtatgaagttgtgtgtaattttgtttaaaaagtgattagatagatataggggaaaagccttttggctttgctctaagcttctttttgctcctttcactatgtaataccttttgccttccacctaaaggcttaaaggttaattacttagtggaagcagcaacgagaagctggcaaaggaggcttctgttctgtttctgtttctgtatgtaaaccatgcaaattccggtttgactatgaaatatccggttatgttt

SEQ ID NO: 11 - DNA, 5115 bp, Arabidopsis thaliana
cggcttctcaaaagcctccgatttcgatttttttttcctctctttttttttttctttttttttttgattgatcactgtgtctgattccttatcacggaaactcttcaacatggaagacgattgtgaggagcttcaggttcccgtgggaactctaacctcgataggttttagcatttcaaacaacaatgatcgagataaaatgtctgtgctagaggttgaagcaccgaatcaggtgactgattctcggctaggattaccgaatccggattctgtctgcagaacctgtggcagcaaagatcgaaaagtttgcgaagggcatttcggggttataaacttcgcgtactcgataataaacccgtatttcctcaaggaggtagctgcgttgttaaacaaaatctgtccggggtgtaaatacattcgaaaaaagcagtttcagattaccgaagaccagcctgagagatgtagatactgcactttgaataccggttatcctctaatgaagtttagggtaactactaaagaagtcttcaggcgatccggaatcgttgttgaagtaaacgaagagagtctgatgaaactcaagaaacggggagtgttaacattgcctcctgactattggagttttttgccgcaagactctaatatcgacgagagctgtttgaaaccaacaaggcgaataataacgcatgcacaggtttatgctctgttattagggattgatcagaggctcatcaagaaggatatccctatgttcaactctcttggtctgacatcttttcctgttacaccaaatggttaccgtgtaaccgaaatagttcatcagttcaacggagctcggctaatatttgatgaacggactcggatctacaagaaactagtcggctttgagggaaacacacttgaattgagttctcgtgtgatggaatgcatgcaatattccagactcttttcggaaactgtgtcttcgagtaaagattccgcaaatccgtaccagaagaagtctgatacaccaaaactttgcggtctaaggttcatgaaagacgtgctgctcggtaaaagaagtgatcatacattccggacagtagttgttggtgatccgtccttgaagctcaacgagattggcatacccgagagtatcgcaaaaaggcttcaagtatcagagcatctcaaccagtgcaataaagaaaggcttgtcacttcctttgtccccacactgttggacaataaagagatgcatgtgagaagaggagatagattggtggctattcaagtcaatgacctccaaaccggagacaaaatattccggagtttaatggatggagacactgtgctgatgaacagaccgccttcgattcatcagcattcgcttattgcaatgacagttagaatcctcccaacgacttctgttgtctccttgaacccgatctgctgtttgccgttccgtggtgattttgatggagattgtctccacggttacgttcctcagtccattcaagcaaaggtcgagcttgatgagcttgttgctttggataagcagcttatcaacagacagaatggtcggaacttgctttctttaggacaagatagcttgacggcggcttatctggtcaatgttgagaagaactgttatcttaatcgagctcagatgcagcagcttcaaatgtattgcccatttcagcttcctccgcctgcaattatcaaagcttctccttcgagcactgagcctcaatggacgggaatgcagctattcggaatgctgtttcctcccgggtttgactacacttatcctctgaataatgtagttgtgagtaacggcgagcttttgtctttctctgaaggatctgcttggctcagagatggagaagggaatttcatcgagagattgctcaaacacgacaaagggaaagttcttgatatcatctattccgctcaagaaatgctatctcagtggttgctgatgcgcggtttgagtgtgtccttggcggatttgtacctttcctctgatctgcagtctcgaaaaaacttgactgaagagatatcatacgggttgcgggaagctgagcaagtttgcaacaagcaacagctaatggttgaatcttggagagatttccttgcagttaatggggaggataaggaagaggattcagtatcggatttggcccgattctgctatgagagacaaaaatccgctacattaagcgaacttgcagtcagtgcttttaaggatgcttacagagatgttcaggcactagcatataggtatggtgatcaatccaactcttttttgatcatgtcgaaagccggcagcaaagggaatatcgggaagctggttcagcacagcatgtgtatcggtctgcagaattcagcagtttctttgtcctttgggtttccgcgtgaactgacttgcgctgcttggaatgacccgaacagtccacttcgtggcgcaaagggaaaagacagtaccactactgagtcatatgttccttatggagtcattgagaactcgtttctaacgggtctgaatccattggaatcttttgttcattcagttacaagtcgtgacagttcattcagtggtaatgctgatctcccggggacactgagcagaagattaatgttcttcatgcgggacatatacgctgcttatgatggcactgtgagaaattctttcggaaaccagttagtccagtttacttatgagactgatggtcccgttgaagatatcacaggtgaggcacttggctcactttctgcttgtgcattatctgaggcagcttacagcgcgctggaccagccaatcagccttcttgaaacttcgccgcttctgaatcttaagaatgtattggagtgtggatcaaagaaaggtcaacgagaacagacaatgtctttgtatttgtctgaatacctttcaaagaaaaagcacgggttcgaatacgggtcacttgagatcaagaaccacttggagaaacttagtttctcagagatcgtttcaacatctatgataatattctctccaagttctaacacgaaagtaccgttaagcccgtgggtttgccattttcatatctctgagaaagtactgaagcggaaacaactgagcgcagaatccgttgtttcatctttaaacgagcagtacaagagcaggaacagagaactgaagcttgatatagttgacttagatatacaaaacacaaaccactgctcttcagacgatcaggcaatgaaggatgataacgtttgcatcacggtgactgtagttgaagcctcaaagcactcggttttggaactggatgctattcgtctcgttttgatcccttttcttcttgactctcctgtcaaaggtgatcaagggatcaaaaaggtgaatattttgtggactgaccgaccaaaagcgccaaaaaggaatgggaatcatttggcgggtgagctgtacttgaaggttacaatgtatggagatcggggcaaaagaaactgttggaccgctcttttagaaacctgccttcccatcatggatatgattgactggggccgaagccatcctgataatatccgacaatgctgctcagtttatggaatagatgctggacgcagcattttcgtagcaaatttggagtccgcggtgtcagatactggtaaggagatactaagagagcatctgcttctcgtagctgatagtctctctgttacgggagagtttgtggcattaaacgccaaaggttggagtaaacaaagacaggtcgagtccacgcctgcaccttttactcaagcatgcttctcaagcccaagtcaatgctttctcaaagctgctaaggaaggtgtcagagacgatcttcaagggtctatcgacgctttagcttggggaaaagttcctggtttcggaactggagatcagttcgaaatcatcatttcgccaaaggttcacgggtttactacaccggtagatgtgtatgaccttttgagtagtacaaagacgatgcgtagaacaaactctgcgcctaaatcagacaaagccacggtccagccttttggcttgctacattccgcattcctgaaagatatcaaggtactcgatgggaaagggattcctatgtcactgcttagaacgatctttacatggaaaaacatcgagttgctttcccagtcattgaaacgcattctccacagttacgagatcaatgaactgttgaatgagagggacgaaggacttgtgaagatggttctgcagttgcaccccaacagtgttgagaaaattggaccaggcgtcaaaggaatccgggtcgctaaatcgaagcacggagattcttgttgcttcgaggttgtaagaatagacgggacattcgaagacttctcataccacaagtgtgtcttgggagcaacaaagataattgccccaaagaaaatgaacttctacaagtcaaagtatcttaaaaatggtacactcgagtccggtggtttctccgaaaacccgtgaacagccaagtaagagtaaaaaaaaagactggctcttctgcggtataatatcgaacaatgtatgaagttgtgtgtaattttgtttaaaaagtgattagatagatataggggaaaagccttttggctttgctctaagcttctttttgctcctttcactatgtaataccttttgccttccacctaaaggcttaaaggttaattacttagtggaagcagcaacgagaagctggcaaaggaggcttctgttctgtttctgtttctgtatgtaaaccatgcaaattccggtttgactatgaaatatccggttatgtttctgttctttaccttgtttatatccgtcttcatgcaattgcaaatgatccttattacatcttcggttttccttatgagaagtgaaacttagttctcttggttatgctctgttttttcctggtttagatcggttctcaatagcatacagtttgttctttctcttaaccggtttagattagttttcttgcaatttgcttatgattcttataagtaaccaaagcctttaagtaatactaatctaaatatctccacatattatcttcaaatgtattgatcagagaaaatccccaacactatcatcacccctcaagaaaatacaggaaacattttcga

SEQ ID NO: 12 - DNA, 6348 bp, Arabidopsis thaliana
gaagaagaacaaaagatttttgagagagaaaagtagagtcactccaaaattgttctctcgcaatcttctttctcggtttcctcttttaagaaaaagtccgccattttcactctcactcagatttcttccctcttctcacctgcaaaaacccttgtttcccgctgtttcgtttcttctccggttgaggaaccaaaacgggtcaaatacgcagctgaatcatcgaattcttagggttttttcatggaggaagaatctacatcagagattcttgacggagagattgttggaatcacatttgctcttgctagtcaccatgaaatatgtattcaatcgattagtgaatccgcaattaatcatcccagtcaactcactaacgcattcttggggttacctcttgaatttggtaaatgtgaatcttgcggtgcgacagaaccagataaatgtgaaggtcattttggttatattcagcttccagtgccaatataccatcctgctcatgttaatgagttgaaacaaatgctgagccttctgtgcttgaaatgtctgaagataaagaaggcaaagggcacaagtggtggtctggcggatcgcttgttgggtgtctgttgtgaggaagcttcgcaaatctcaatcaaagatagagcatcagatggtgcctcatatctagaactgaagctcccatctaggtcaagactgcagcctggttgctggaatttcctggaaagatatggttatcgctatggaagcgattacacgcgtcccctgctggcaagagaggttaaggaaattctaagacggatccccgaagaatcaagaaagaaactcacggcaaagggacatattcctcaagaaggatacatactagagtatcttcctgtcccgcctaactgtttgtcagtgccagaggcttctgatggtttcagcaccatgtcagtggatccttccagaattgagctaaaggacgttctgaagaaagtcatagccataaaaagctctaggtctggcgagacaaactttgagtcgcataaggctgaagccagtgagatgtttagagtggtggatacctatctccaggtgaggggtactgcaaaagcggcaagaaacattgatatgagatacggggtgtctaagatctcggatagttcatcttcaaaagcttggacagaaaaaatgagaacacttttcatccgtaagggttcaggtttctcttcccgtagcgtcatcactggagatgcttaccgacatgtgaatgaggtagggatcccaatagaaattgcgcagagaatcacatttgaggaaagggttagtgtccacaatagaggttatctacaaaagttggtagacgacaagttgtgtttgagttatactcaaggttctacgacctattctttaagggatggatccaaggggcacactgagcttaaacccgggcaggttgttcatcgcagggtcatggatggggatgttgtgtttatcaacagacccccgacaacacataaacattctcttcaagcgcttcgggtgtatgttcatgaagacaacaccgtgaagattaaccctctgatgtgtagccccctcagtgctgattttgatggtgattgtgtccatttgttctaccctcagtctcttagtgctaaggcagaggttatggagctcttctctgtggagaagcaactgcttagctcacatactggacagctgattttgcagatgggtagtgattctttactgtctttgagggtaatgctggagcgggtatttctggacaaggcaactgctcaacagttagctatgtatggctctctgtccctgccaccaccagcactaaggaagtccagtaaatctggcccagcttggacagttttccagattctacagcttgcctttccagaacgtctgagttgcaaaggagacagattcctggttgatggaagtgatttgctgaagtttgatttcggggttgacgcgatggggtccatcatcaatgaaattgtaacttcaatcttcctggagaagggtccaaaggagacacttggattctttgattcgctgcagcctctattgatggaaagtctgtttgctgagggatttagtctaagtttggaagacttatccatgtctagggcagacatggatgtaattcacaacctaataatccgagagatttcacctatggtgtctcgcttgagattatcatatagagatgaattgcagctagagaacagcatccacaaagtgaaggaagtggctgctaactttatgctgaagtcatattccattcggaacttgattgatatcaagagtaactcagcaatcaccaagctggtgcagcagacaggcttcttgggtcttcagctttctgacaagaagaagttttacacgaagactctggtagaggacatggctatcttttgtaagagaaagtatggcaggatttcttcatctggtgattttggaatagtgaagggctgcttctttcatgggctggatccgtatgaagagatggctcattcaattgcagctagggaggtaattgttcgctcttcaaggggattagctgagcctggaaccctctttaagaacctgatggctgttcttcgggatatcgtgattacaaacgatggaactgtaagaaacacctgtagtaactcagtcatccagttcaaatatggagttgattctgaacgtggacatcaaggtctgtttgaagctggagaacctgttggagtattggcagctactgccatgtcaaatcctgcatataaggcagtgcttgattcctctccaaatagtaattcatcatgggagctaatgaaggaagttctgctctgcaaagtcaatttccaaaacactactaatgatcggcgcgtaatcctttatttaaacgaatgccattgtggaaaaaggttttgccaggaaaatgctgcttgcacagtcaggaacaagctgaataaagttagtcttaaagatactgcagtggaattcctagtcgaatatagaaagcaaccaactatatcagaaatttttggaattgattcatgcctacatggccatattcatcttaataagacattgctgcaagattggaacatcagtatgcaggatatacatcaaaagtgtgaggatgtaattaactcactaggacaaaagaaaaagaagaaagctactgatgatttcaagagaacaagtttgtctgtcagtgagtgctgctctttccgagatccttgtgggagcaaaggttcggatatgccttgtttgacgttctcctacaatgccaccgatcccgatctagaacgaactcttgatgttctttgcaatacagtttacccagttctgctggaaatagtgatcaaaggtgattcacggatttgctcagcaaatataatctggaatagttcagacatgacaacgtggatccggaatcgtcatgcatcccgccgaggggaatgggttttggatgtcactgttgaaaaatctgctgtcaagcaaagtggtgatgcatggagggttgtgatagactcatgtctttcagtgcttcatctaatagacacaaaacggtcaatcccttattctgtaaaacaagtgcaagaattgcttgggttatcctgtgcttttgagcaagcagtacagcgtctatcagcttcagtgagaatggtctccaagggagttttgaaagaacacatcattctcctagcaaacaacatgacttgttcagggactatgttgggtttcaattctggaggttacaaagctttgacccgatccttaaacatcaaggctccattcacagaagcaactctgattgcaccaagaaaatgttttgagaaagcggctgagaaatgtcatacagattcactatcaacagtcgttgggtcttgttcttggggaaaacgcgtggatgttggtacaggctcacagtttgagctcctatggaaccaaaaagagactggtctagatgataaagaagaaacagatgtgtacagcttccttcaaatggtcatatccacgacaaacgcagatgcatttgtttcttcccctggttttgatgttacagaggaagaaatggctgaatgggctgaatcgcccgagcgagactctgctcttggagagcccaagtttgaggacagtgccgacttccaaaatttacatgacgaaggcaagccatcaggagccaactgggagaaaagctcttcgtgggacaatggttgcagtggtggttcagagtggggagtctcaaaaagtacaggtggtgaggcaaacccggagtctaattgggaaaagactacaaatgttgagaaggaagatgcttggtctagttggaacactagaaaagatgctcaagaatcttccaagtcagattcagggggtgcttggggtataaagacaaaggatgctgatgcagatacaacaccaaactgggaaacaagtccagctccgaaggattccattgtcccagaaaataatgagccgacttctgacgtttggggacacaaatctgtttcagacaaatcgtgggacaaaaagaactggggaactgaatcagctcctgctgcatggggttctacagatgctgctgtttggggttctagtgataaaaagaactcggaaacagaatcagatgctgctgcttggggttccagggacaaaaataattctgacgttgggtcaggtgctggtgttttaggtccctggaacaagaagagctcggaaactgagtcaaatggtgctacttggggttctagtgacaaaaccaaatcaggtgctgctgcatggaattcttgggacaaaaagaacatagaaactgactcagaacctgctgcttggggttctcagggaaaaaagaattctgaaactgagtcaggtcctgctgcttggggtgcttgggacaaaaagaaatcggaaactgaaccaggtcctgctggttggggtatgggggacaaaaagaattctgaaactgaattaggccctgctgctatgggtaattgggacaaaaagaaatcggatacgaaatcaggtccagctgcttggggatctacagatgctgctgcttggggttctagtgacaaaaacaactcggaaactgaatcagatgctgctgcttggggttctaggaacaaaaagacttctgaaattgaatcaggtgctggcgcttggggttcgtggggacagccaagtcccactgcagaagacaaggataccaatgaggatgatagaaatccgtgggtttccttgaaggagaccaaaagtagagagaaggatgataaagagagaagccagtggggaaatccagccaagaaatttccatctagtggtggctggtccaatggtggtggtgcagactggaaaggaaataggaaccatactcctaggccacctagatctgaggataatttggctcccatgtttacagcaacgagacagcgcttggactcattcacctctgaggagcaagagctgctctcagatgttgagccagtcatgaggactctcaggaaaattatgcatccgtctgcgtaccctgatggagacccaatttctgatgatgacaagacgtttgtcctggagaagattttgaacttccatccccaaaaagagacaaagcttggttctggcgttgacttcatcacggttgataagcacaccatcttctcagacagcaggtgcttctttgttgtctcaactgatggggccaaacaggacttttcataccgaaaatccctcaacaactatttgatgaagaaataccctgaccgtgctgaagaattcattgacaagtactttacgaaacctcggcctagcggaaacagagacaggaacaaccaagatgccacaccacctggggaagaacagtctcagcctccgaatcagtctataggtaatggaggtgacgactttcagacacagactcagtctcagtctccatctcagactcgggctcagtctccatctcaggctcaggctcagtctccatctcagacgcagtctcagtctcagtctcagtctcagtctcagtctcagtctcagtctcagtctcagtctcagtctcagtctcagtctcagtctcagtctcagtctcagtctccatcccagactcagactcagtctccgtctcagactcaggctcaggctcagtctccatcatctcagtctccgtcccagacgcagacataaactcttgagaaccaaagaagatttggttcgtttaggtaaaccattcagtctccactgttttgttttgatgtacataaagagtggagagaatggcggtttttatcattaaaagactctgatgtgaagtgcaaaacaatgtgtaaatgcagttctctagtttcagatcgtttgtcctaa

SEQ ID NO: 13 - DNA, 4845 bp, Arabidopsis thaliana
gaccaattagggtttcgcaatcttccagtagatttcgcttctcaacggattttgaaaatggtggaaaatggggctaaagctgcgaagcgaaagaagagaccacttccagagattcaagaggtagaagatgtacctaggacgaggagaccaaggcgtgctgcagcgtgtaccagtttcaaggagaaatctattcgagtctgtgagaaatctgctactattgaagtaaagaaacagcagattgtggaggaagagtttctcgcgttacggttaacggctctggaaactgatgttgaagatcgtccaaccaggagactgaatgattttgttttgtttgattcagatggagttccacaacctctggagatgttggagattcatgacatattcgtttcaggtgctatcttaccttcagatgtgtgtactgataaggagaaagagaagggtgtgaggtgtacatcgtttggacgggttgagcattggagtatctctggttatgaagatggttcccctgttatttggatctcaacggaattggcggattatgattgtcgtaaacctgctgctagctacaggaaggtttatgattacttctatgagaaagctcgtgcttcagtggctgtgtataagaaattgtccaagtcatctggtggggatcctgatataggtcttgaggagttacttgcggcggttgtcagatcaatgagcagtggaagcaagtacttttctagtggtgcggcaatcatcgattttgttatatcccagggagattttatatataaccaactcgctggtttggatgagacagccaagaaacatgaatcaagctatgttgagattcctgttcttgtagctctcagagagaagagtagtaagattgacaagcctctgcagagggaaagaaacccatctaatggtgtgaggattaaagaagtttctcaagttgcggagagcgaggccttgacatctgatcaactggttgatggtactgatgatgacagaagatatgctatactcttacaagacgaagagaataggaaatctatgcaacagcccagaaaaaacagcagctcaggttctgcttcaaatatgttctacattaagataaatgaagatgagattgccaatgattatcctctcccatcgtactataagacctccgaagaagaaacagatgaacttatactttatgatgcttcctatgaggttcaatctgaacacctgcctcacaggatgcttcacaactgggctctttataactctgatttacgattcatatcactggaacttctaccgatgaaacaatgtgatgatattgatgtcaacatttttgggtcaggtgtggtgactgatgataatggaagttggatttctttaaacgatcctgacagcggttctcagtcacacgatcctgatgggatgtgcatattcctcagtcaaattaaagaatggatgattgagtttgggagcgatgatattatctccatttctatacgaacagatgtggcctggtaccgtcttgggaaaccatcaaaactttatgccccttggtggaaacctgttctgaaaacagcaagggttgggataagcattcttacttttcttagggtggaaagtagggttgctaggctttcatttgcagatgtcacaaaaagactgtctgggttacaggcgaatgataaagcttacatttcttctgaccccttggctgttgagagatatttggtcgtccatgggcaaattattttacagctttttgcagtttatccggacgacaatgtcaaaaggtgtccatttgttgttggtcttgcaagcaaattggaggataggcaccacacaaaatggatcatcaagaagaagaaaatttcgctgaaggaactgaatctgaatccaagggcaggcatggcaccagtagcatcgaagaggaaagctatgcaagcaacaacaactcgcctggtcaacagaatttggggagagttttactccaattactctccagaggatccattgcaggcgactgctgcagaaaatggggaggatgaggtggaagaggaaggcggaaatggggaggaagaggttgaagaggaaggtgaaaatggtctcacagaggacactgtaccagaacctgttgaggttcagaagcctcatactcctaagaaaatccgaggcagttctggaaaaagggaaataaaatgggatggtgagagtctaggaaaaacttctgctggcgagcctctctatcaacaagcccttgttggaggggaaatggtggctgtaggtggcgctgtcaccttggaagttgatgatccagatgaaatgccggccatctattttgtggagtacatgttcgaaagtacagatcactgcaaaatgttacatggtagattcttacaaagaggatctatgactgttctggggaatgctgctaacgagagggaactattcctgactaatgaatgcatgactacacagctcaaggacattaaaggagtagccagttttgagattcgatcaaggccatgggggcatcagtataggaaaaagaacatcactgcggataagcttgactgggctagagcattagaaagaaaagtaaaagatttgccaacagagtattactgcaaaagcttgtactcacctgagagagggggattctttagtcttccactaagtgatattggtcgcagttctgggttctgcacttcatgtaagataagggaggatgaagagaagaggtctacaattaaactaaatgtttcaaagacaggctttttcatcaatgggattgagtattctgttgaggattttgtctatgtcaaccctgactctattggtgggttgaaggagggtagtaaaacttcttttaagtctgggcgaaacattgggttaagagcgtatgttgtttgccaattgctggaaattgttccaaaggaatctagaaaggctgatttgggttcctttgatgttaaagtgagaaggttttataggcctgaggatgtttctgcagagaaggcctatgcttcagacatccaagaattgtatttcagccaggacacagttgttctccctccaggtgctctagagggaaaatgtgaagtaagaaagaaaagtgatatgcccttatcccgtgaatatccaatatcagaccatattttcttctgtgatcttttctttgacacctccaaaggttctctcaagcagctgcccgccaatatgaagccaaagttctctactattaaggacgacacacttttaagaaagaaaaagggaaagggagtagagagtgaaattgagtctgagattgtcaagcctgttgagccacctaaagagattcgtctggctactctagatatttttgctggttgtggtggcctgtctcatggactgaaaaaggcgggtgtatctgatgcaaagtgggcgattgagtatgaagagccagctgggcaggcttttaaacaaaaccatcctgagtcaacagtttttgttgacaactgcaatgtgattcttagggctataatggagaaaggtggagatcaagatgattgtgtctctactacagaggcaaatgaattagcagctaaactaactgaggagcagaagagtactctgccactgcctggtcaagtggacttcatcaatggtggacctccatgtcagggattttctggtatgaacaggttcaaccaaagctcttggagtaaagttcagtgtgaaatgatattagcattcttgtcctttgctgactatttccggccaaggtattttcttctggagaacgtgaggacctttgtgtcattcaataaagggcagacatttcagcttactttggcttcccttctcgaaatgggttaccaggtgagatttggaatcctggaggccggtgcatatggagtatcccaatctcgtaaacgagctttcatttgggctgctgcaccagaagaagttctccctgaatggcctgagccgatgcatgtctttggtgttccaaagttgaaaatctcactatctcaaggtttacattatgctgctgttcgtagtactgcacttggtgcccctttccgtccaatcaccgtgagagacacaattggtgatcttccatcagtagaaaacggagactctaggacaaacaaagagtataaagaggttgcagtctcgtggttccaaaaggagataagaggaaacacgattgctctcactgatcatatctgcaaggctatgaatgagcttaacctcattcgatgcaaattaatcccaactaggcctggggctgattggcatgacttgccaaagagaaaggttacgttatctgatgggcgcgtagaagaaatgattcctttttgtctcccaaacacagctgagcgccacaacggttggaagggactatatgggagattagattggcaaggaaactttccgacttccgtcacggatcctcagcccatgggtaaggttggaatgtgctttcatcctgaacagcacagaatccttacagtccgtgaatgcgcccgatctcaggggtttccggatagctacgagtttgcagggaacataaatcacaagcacaggcagattgggaatgcagtccctccaccattggcatttgctctaggtcgtaagctcaaagaagccctacatctcaagaagtctcctcaacaccaaccctagataaccacccaaatttggcatttcctttttcaataatattagtcattatgatccttgtcttgaatgaaactcattggtgctgatacttttgataaagaaagcctacgaagagtttttgtatattccgtattcggattgaaaaatctcattatacaagcaagcaatgatgtctatagactatga

SEQ ID NO: 14 - DNA, 2447 bp, Arabidopsis thaliana
gtaaaaataaaaagtaattatttgttcaaccctaggtgaaataaaggacgacccaaaacaagtgacgagagagcagagagagcttcttcttccggacactgaacagtgagagcacccatctccaacctcttcctgaacaagatgggaagcactgtgattttaagctcagatgatgaagattcagatattagtgaatctgaaatggatgagtatggagacaaaatgtacctaaaccttaaaggtgggaagctgaaagtgagactctctcctcaagcttttatctgtccttattgtccaaacaagaagaaaactagttttcaatacaaagatcttcttcaacatgcttctggagttggtaatagcaattctgataaaagaagtgcaaaggagaaagcaagtcaccttgctcttgtcaaataccttcaacaagatcttgctgattcagcttcagaagcagagccttcatcaaagcgtcagaaaaacggaaaccctattcaagattgtgatcatgacgagaagcttgtgtatccttggaaaggtattgtggtgaatattccaactacaaaggcacaagatggtcgatctgcgggcgagagtggatcgaagctaagggatgagtatattctaagaggatttaacccgactagagttcgtcctttatggaactacttgggacattcaggaacagctattgtggagtttaacaaagattggaatggacttcacaatggtcttttgtttgacaaggcttatacagtagatggtcatgggaagaaggactggttgaagaaagacggtcccaagttaggtctttacggttggattgctcgtgctgatgattataacggtaataatattattggagaaaacttgaggaagacgggtgatctgaaaactatagctgagcttacggaagaagaggcgaggaaacaggaattgcttgtgcagaacctgagacaacttgtagaagagaagaaaaaagacatgaaggagattgaggagctttgttcagttaagtcagaggaacttaatcagttgatggaagagaaggagaagaatcagcaaaagcattaccgtgagctgaatgctatacaagaaagaacaatgagtcacattcaaaagatagttgatgatcatgagaaattgaagaggctgttggagtcagagaggaagaaactcgaaatcaaatgtaatgagttggcaaagcgcgaagtgcacaatggaaccgagagaatgaaattgtctgaagatcttgaacagaatgcatctaagaatagctctcttgaactagctgccatggaacaacaaaaggcagacgaggaagttaaaaaacttgctgaagaccaaaggaggcaaaaggaggagcttcatgagaaaatcataagactagaaagacagagagatcagaaacaagcgattgagctagaagttgagcagttgaaaggacagctcaatgtgatgaagcacatggcatcagatggcgatgctgaagttgtgaaagaggtggacatcatcttcaaagatttaggtgagaaggaagcacaactcgcagatctcgataaatttaaccaaactcttatccttagagagcgcaggaccaacgatgagcttcaagaagctcataaagaattggtaaacattatgaaagaatggaacacaaatatcggtgttaagagaatgggagagctcgtgacgaaaccattcgtggatgcaatgcagcagaagtattgtcagcaagatgtggaggaccgagcagttgaagttctccaactttgggaacactatctcaaagattcagattggcatccattcaagcgggtcaagctcgaaaatgaagatagagaagtggaagtgatagatgatagagacgaaaagctgagggagctaaaggcagatttgggagatggtccttacaatgcggtcacgaaagctttgttggagataaacgagtataacccgagtggaaggtatattacaacagagctatggaacttcaaagcagataagaaggctacacttgaagaaggtgtcacttgtttacttgatcaatgggaaaaggcgaaacgcaagcgtggaatggcttagagctgcaagatgatggacatgggactgaataaaaagccgatgcggtttttagttgcagagaaatgtgtttggtttgaccaaactttggtggattctgtttgtttttcttctcagaacttagtgaataattgacacaactttgatgtcttgcatcggttcttttcattgtaacatttgtaggagtttggccgctttggacaataagaaataaaaatatcattgtaatataattcacatgtaaaacaactagatttggcctctcttctgtctcatatcttaagcatgtcatttagaaccttttattgtaaaaacaaactttgtcatgagttactttttgtagtcaaatttgatattgacccctt

SEQ ID NO: 15 - DNA, 865 bp, Arabidopsis thaliana
tctcttaaaaaattcttaatggcatggagtcttcagttactaagagccggcgaatactgtggaagaagcacatggtgttgatttgaccaagcccgaccgccggagcaaggtggatcgtggatcaaccggcgccgttgtgtttcaacatctcttcatctcacgttagacatgtgtctgctacgtggcactttattttcttaaccttatctttaaatttgggtgggttaagctggaccttagatttaaatcaaagttgtaaatggtaagagatcggactttttcaccagcatatatcattaagcatgacatcagacagaaattggagatggagattcaagagctaaaaggcaaattccaagtgataaaacatttaggagatgatgatgataacattctgaaaatgaagctctggttaaagctaccatcctttgctttacatagaaggagaatctcaaggattcatcatggcatccattcaaacataaaggaaccaaggacaaatcaaatatgtgtctttcctgctgtctcatcccattttaagagtgatctggttaacgaagagtatgagcccctgaagaagcttaaagaaaaatggggagaagatgtgcataatactttaaaaataacaatcaaggatatggatgagtataatgcatgtggtaagtacccaactccagaactatggaactttaagaaaaaacttaaatcaacactgaaggaagtgattaaattccttttgaatgacatcaagagtctaaaacgccaacgaatctgtaggtgtgttatatcttttttggttgacataggtctccttatagatttaaaccaacataaaccccatatagttttagtgtataaggtttag

SEQ ID NO: 16 - DNA, 1665 bp, Arabidopsis thaliana
atgaagaagaaacaacaaaagcaggaatttgtagctgagacatcagagatgaacaacaacaacgagtgttctggacaagaccaacaaaaacgatatgtgtggccatgggttggtctagtagccaacgtaccaactgaggtggaaccatctggtcggagagtaggcaaaagcggttcaacgttacgtgatgagttcactctgaaagggtttaatccaacaagagtcaaacccatttggaataccaagggacatactggttttgctttggttgaattcgctaaagactttaaaggattcgaaagcgccatgcaattcgaaaagagttttgatttagaccgtcatgggaagagagattggaaaaaaggtcatcgcttgagagatgataagctttatggatggcttgcgagagaggatgattataatcgaagtgatactgttgggaagaatgtcaagaagaagagggatttgaaaagtatctctcagattgtagaggaagaccagaggaaactgtatcatctatttgagaatatgtgtcaaaccattgagaagaataagcaacgtaaacaacagcttgaacagaaagttgatgagactttggagagtttggaatttcataaccttatgttaaacaatagctaccaagaagagattcagaagatggagaagaatatgcaagagttttatcaacaggttcttggtggacatgaaaagtcttttgcagaactggaggcaaagagggagaagcttgacgagcgtgcaagattgattgagcaacgggctatcaaaaacgaagaagagatggaaaagaccaggcttgaaagagaaatgattcaaaaggctatgtgtgagcagaatgaagcgaatgaggaagctatgaaacttgcagaaaagcaccagaaagagaaggagaagcttcataaaaggataatggaaatggaagctaagctaaatgaaacgcaagagcttgagttggagatagagaagctgaaaggtactacaaatgtgatgaagcatatggtgggttgtgatggagataaagatattgtggagaagatagccaaaactcagatagagcttgacgctcgagaaacagctctccatgaaaaaatgatgactctcgcacgaaaagaacgtgcgaccaacgatgagtatcaagacgctcgtaaagagatgattaaggtatggaaggcgaatgaagagttgatgaagcaagagaagattagagtgaagataatgggggagttgaaccctgcacccttcttgcctgcagtgatgaacaaacataaggctatgatgctgtgttcagtgtgggcagcagagataggagatgtgcaatggactccatttagggtcgatgagtctgatggaacaccaaagcaaaaattacatatatctcaacattccaaatgtgaaatgcagagagtggtggatgaaaatgatgagaagcttcgtatgctgaagaaccagtacggtgaagaagtttatagtgaagtggtaagagcaaagctagagatggaggaacataacgctagtggcagctatgagactgaagagctttggaactatgaggagaaccgaaaggcgactatcgaggaaataacagatgtgatgttgaagataaggtccaaacttgctgctatgaagaacaaacgaaagaggccttga

SEQ ID NO: 17 - DNA, 2407 bp, Arabidopsis thaliana
atgtattccagaagagagctggaagatttggagtacagatactacagtgaaatgaaagatggtacaaggaaagtcaaaatctcagagtctctgttcaggtgtcccttttgttacatagatcgaaagcgtgattaccagtttgatgacttgcttcgacatgcttctggtattggcggtagttcccgcactaaggatgggagagataaagctagacatcttgctctggagagatatatgaggaagtatctccgccctcgagaaagaccacgtccttctccaacttcagatgtctcttctcttcctaaagaggagtttactggaaagtggaaatctactttgtcaactactgaagaaggagaattcataactactgaaaattctagttcacctcatattgtcaaagctgaaccaaagtttgtctccggagatgattctggacgtagtggtgaggaaagactaaagttttctgataaacccgaccccttttttagcaacgaagacaaatcataccctgccaaaagaccttgcctagtttctggtgcgaaagagggagatgaacctgttcaacggattggtctcagccatggtgctagctttgctccaacatatccccagaagctagtttctttgggtgctggtaatggggatcagatgtatgtgcatccctggaaaggtatcctggcgaatatgaaaagaacgtttaatgaaaaaacaaggaagtatgctggtgagagtggaagcaagataagagaagatttgatcaagaaagggtttaatccccataaagtcacgccactgtggaacggaagacttgggtttactggttttgctattgttgactttggtaaagagtgggaaggattcagaaacgcgaccatgtttgataaacactttgaagtgagtcagtgtgggaaaagagaccatgatctcacacgtgatccaggtgataagctttatggttgggtagcaaaacaagatgactactattcaagaactgctattggtgaccacctcagaaagcaaggggacttgaagagtgtttctggtaaagaggcagaagatcaaagaaagacattcacgcttgtctccaacttggaaaacacactggtaaccaaatctgataatcttcaacaaatggagagcatctacaaacaaaccagttcagtgcttgagaaaagaatgaaagagaaggatgaaatgatcaacacacataatgaaaaaatgagtattatgcagcaaactgcacgtgattatttggccagtatttatgaagaacatgaaaaggcctctcagcatctggaagctcaaaggaaagaatatgaagaccgggagaattatctagataagtgtcaagctaagaataagactgagcggagaaagcttcaatggcaaaagcataagaacttaatggcaacgcaagagcaaaacaaagctgatgaagacatgatgagattggcagaacagcaacagagggaaaaagatgaattacgtaagcaagttcgtgagctcgaggagaagatcgatgctgagcaggcattagagctagagatagagcgtatgagaggtgacttgcaggtcatgggacacatgcaagaaggtgaaggtgaagattcaaaaatcaaggagatgatagaaaagacaaaggaagaactgaaggagaaagaagaggattgggaatatcaagagtcgctctatcaaactcttgttgtaaaacatggctacactaacgatgagctacaggatgcgcgcaaggctttgattcgttcaatgcgagagttgaccacacgagcttacattggtgtgaagagaatgggagcattggatgagacaccattcaaaaaagtagctaaagagaaatatccagcagtagaagctgataaaaaagccgaagagctctgttccttgtgggaagagcacctgggagactcggcttggcatccgattaaggtcgtcgaaaaagatggaatcgcaaaggaagaactgaatgaagaagatgagaagctacaagagctgaggaaagagttgggtgaggaagtgtatgcagctgtgacacaagcgcttaaagaaaggaacgagtataatggcagtggaaggtacatagtgcctgagctttggaatttcaaacaaaacagaaaagcgagcatcaaggaaggagttgtttatctggtcaactcgtggaaacagaagaaaccaaagccgaagcgtagataaaaattaattctagaaacctctattgttgataattattaagactagatgagatttcatgattatccccactaagaatagttataaacttgagaaaaaaataaaaatagttatgaacttatgatgctgaaatcttggactgggttattcgttttgaaaagaggatttgggttttgttatttatgaatatgtttcattg

SEQ ID NO: 18 - DNA, 2353 bp, Arabidopsis thaliana
tcttccggacactgaacagtgagagcacccatctccaacctcttcctatgggaagcactgtgattttaagctcagatgatgaagattcagatattagtgaatctgaaatggatgagtatggagacaaaatgtacctaaaccttaaaggtgggaagctgaaagtgagactctctcctcaagcttttatctgtccttattgtccaaacaagaagaaaactagttttcaatacaaagatcttcttcaacatgcttctggagttggtaatagcaattctgataaaagaagtgcaaaggagaaagcaagtcaccttgctcttgtcaaataccttcaacaagatcttgctgattcagcttcagaagcagagccttcatcaaagcgtcagaaaaacggaaaccctattcaagattgtgatcatgacgagaagcttgtgtatccttggaaaggtattgtggtgaatattccaactacaaaggcacaagatggtcgatctgcgggcgagagtggatcgaagctaagggatgagtatattctaagaggatttaacccgactagagttcgtcctttatggaactacttgggacattcaggaacagctattgtggagtttaacaaagattggaatggacttcacaatggtcttttgtttgacaaggcttatacagtagatggtcatgggaagaaggactggttgaagaaagacggtcccaagttaggtctttacggttggattgctcgtgctgatgattataacggtaataatattattggagaaaacttgaggaagacgggtgatctgaaaactatagctgagcttacggaagaagaggcgaggaaacaggaattgcttgtgcagaacctgagacaacttgtagaagagaagaaaaaagacatgaaggagattgaggagctttgttcagttaagtcagaggaacttaatcagttgatggaagagaaggagaagaatcagcaaaagcattaccgtgagctgaatgctatacaagaaagaacaatgagtcacattcaaaagatagttgatgatcatgagaaattgaagaggctgttggagtcagagaggaagaaactcgaaatcaaatgtaatgagttggcaaagcgcgaagtgcacaatggaaccgagagaatgaaattgtctgaagatcttgaacagaatgcatctaagaatagctctcttgaactagctgccatggaacaacaaaaggcagacgaggaagttaaaaaacttgctgaagaccaaaggaggcaaaaggaggagcttcatgagaaaatcataagactagaaagacagagagatcagaaacaagcgattgagctagaagttgagcagttgaaaggacagctcaatgtgatgaagcacatggcatcagatggcgatgctgaagttgtgaaagaggtggacatcatcttcaaagatttaggtgagaaggaagcacaactcgcagatctcgataaatttaaccaaactcttatccttagagagcgcaggaccaacgatgagcttcaagaagctcataaagaattggtaaacattatgaaagaatggaacacaaatatcggtgttaagagaatgggagagctcgtgacgaaaccattcgtggatgcaatgcagcagaagtattgtcagcaagatgtggaggaccgagcagttgaagttctccaactttgggaacactatctcaaagattcagattggcatccattcaagcgggtcaagctcgaaaatgaagatagagaagtggaagtgatagatgatagagacgaaaagctgagggagctaaaggcagatttgggagatggtccttacaatgcggtcacgaaagctttgttggagataaacgagtataacccgagtggaaggtatattacaacagagctatggaacttcaaagcagataagaaggctacacttgaagaaggtgtcacttgtttacttgatcaatgggaaaaggcgaaacgcaagcgtggaatggcttagagctgcaagatgatggacatgggactgaataaaaagccgatgcggtttttagttgcagagaaatgtgtttggtttgaccaaactttggtggattctgtttgtttttcttctcagaacttagtgaataattgacacaactttgatgtcttgcatcggttcttttcattgtaacatttgtaggagtttggccgctttggacaataagaaataaaaatatcattgtaatataattcacatgtaaaacaactagatttggcctctcttctgtctcatatcttaagcatgtcatttagaaccttttattgtaaaaacaaactttgtcatgagttactttttgtagtcaaatttgatattgacccctt

SEQ ID NO: 19 - DNA, 2491 bp, Arabidopsis thaliana
acaattttttatctccggttaacaaattctttctcgcgacgacttcaacgcgcgacaatggcgcgtgtaagacaaacagaggtttcttggaatatctctccaagtacttttgctgcttctctatcaaaatgggaacaaacttagaaaaaaccaaaagaaatcgaaattacttggaaacaaaacatctgacgatctccagactcagctgaagtttcgagctgaatctcttcttctctacacgcgatttctctgctcgtagatgtaaaacaataacgcgaggcggtgatgaacaacaaattgagtgattttgagaaaaatctgtacaaaaaactcaagagtggaaagctcgaggtgaaagtctcataccggactttcctgtgtccttattgtcccgataataagaagaaggttggtttgtatgttgacattcttcagcatgcttctggagttggtaatagccaatccaagaaaagaagtttgactgagaaggctagtcaccgtgctcttgccaaataccttattaaagatcttgctcattacgctacttctactatatctaagcgcttaaaagccagaacatcattcattcctgctgaaaccggcgatgctcctataatttatgatgatgctcagttcgagaaacttgtgtggccttggaaaggagttttggttaatattcccacgacgagtacagaagatggtcggtcttgtactggagagagtggaccaaaacttaaggatgaattaatccgaagaggattcaacccaattagagttcgtactgtgtgggaccgtttcggtcattcgggaaccggaatagtggaatttaacagagactggaatggacttcaagatgctttggtgtttaagaaggcttatgaaggagatgggcatgggaaaaaggattggctttgtggtgctactgactcgagcctttatgcatggcttgccaatgctgatgattactacagggctaacattttaggagaaaacttgcggaagatgggtgacctcaaaagtatttataggtttgcagaagaagaggcaaggaaagaccaaaagcttttgcagcgtctgaactttatggttgagaacaaacaatatcggttgaagaaattacagataaaatattcacaggattcagttaaacttaagtatgagactgaagaaaaagaaaagattctccgtgcttacagtgaagatctgacaggaagacaacaaaaatcgactgatcatttcaataggatctttgctgatcatgaaaagcaaaaggtgcagctggagtctcagataaaggaacttgaaattagaaagttggagttggcaaaacgtgaggcagagaatgaaacgcagaggaaaatagtggcaaaagaacttgaacagaatgctgctataaatagttatgttcaactatctgccttggaacaacaaaagaccagagagaaagcgcaaagattggctgtagatcacaagatgcaaaaggaaaagcttcataagagaattgctgcactagaaaggcagcttgatcagaagcaggagcttgaactggaggtccagcaactgaaaagtcagctgagcgtgatgagactcgtggaattggacagtggttctgaaattgtgaacaaggtggagaccttcctcagagaccttagtgagacagaaggagagcttgcacacttaaatcaattcaatcaagatcttgttgttcaagagcggaagagcaatgatgaacttcaagaagctcgaagagcattgataagcaatttgagagacatgggattgcatattggtgttaagagaatgggggagcttgacaccaaaccgtttatgaaagcaatgagaataaagtactgtcaagaagatctagaggattgggcagttgaagttatccagctttgggaggaatatcttaaggacccagattggcatccttttaaacggataaagcttgagactgcagaaacaatagtggaagtaattgatgaggatgacgagaagttaagaaccctgaagaatgaactgggggatgatgcgtaccaagcagtggcaaatgcattgctggagataaacgagtataatccgagtggaaggtacatctcctcagagctatggaacttcagagaagacaggaaggctacgcttgaggaaggtgttaattctctactggagcaatggaatcaagcgaagcatctcaagtcataaaggtttatatttgcatttacccggagatggaaaataagtttagcgtgtaaaggatgtcaaaatgcaaggttcaacaattgtctctcgtctttgatgcaatatatgggtcttagaattgcgaagtaggtgtaaattagaggaggatggcgtcacattgggactcgaagttgaaactatgtttctacacttgacggttcaacattgtaggaaactaagtaacaaacattgttagatgattctaaaccttagagaagtttatgaatttgtgaagaaatgaacactttggctt

SEQ ID NO: 20 - DNA, 2503 bp, Arabidopsis thaliana
acaattttttatctccggttaacaaattctttctcgcgacgacttcaacgcgcgacaatggcgcgtgtaagacaaacagaggtttcttggaatatctctccaagtacttttgctgcttctctatcaaaatgggaacaaacttagaaaaaaccaaaagaaatcgaaattacttggaaacaaaacatctgacgatctccagactcagctgaagtttcgagctgaatctcttcttctctacacgcgatttctctgttagattatgcagctcgtagatgtaaaacaataacgcgaggcggtgatgaacaacaaattgagtgattttgagaaaaatctgtacaaaaaactcaagagtggaaagctcgaggtgaaagtctcataccggactttcctgtgtccttattgtcccgataataagaagaaggttggtttgtatgttgacattcttcagcatgcttctggagttggtaatagccaatccaagaaaagaagtttgactgagaaggctagtcaccgtgctcttgccaaataccttattaaagatcttgctcattacgctacttctactatatctaagcgcttaaaagccagaacatcattcattcctgctgaaaccggcgatgctcctataatttatgatgatgctcagttcgagaaacttgtgtggccttggaaaggagttttggttaatattcccacgacgagtacagaagatggtcggtcttgtactggagagagtggaccaaaacttaaggatgaattaatccgaagaggattcaacccaattagagttcgtactgtgtgggaccgtttcggtcattcgggaaccggaatagtggaatttaacagagactggaatggacttcaagatgctttggtgtttaagaaggcttatgaaggagatgggcatgggaaaaaggattggctttgtggtgctactgactcgagcctttatgcatggcttgccaatgctgatgattactacagggctaacattttaggagaaaacttgcggaagatgggtgacctcaaaagtatttataggtttgcagaagaagaggcaaggaaagaccaaaagcttttgcagcgtctgaactttatggttgagaacaaacaatatcggttgaagaaattacagataaaatattcacaggattcagttaaacttaagtatgagactgaagaaaaagaaaagattctccgtgcttacagtgaagatctgacaggaagacaacaaaaatcgactgatcatttcaataggatctttgctgatcatgaaaagcaaaaggtgcagctggagtctcagataaaggaacttgaaattagaaagttggagttggcaaaacgtgaggcagagaatgaaacgcagaggaaaatagtggcaaaagaacttgaacagaatgctgctataaatagttatgttcaactatctgccttggaacaacaaaagaccagagagaaagcgcaaagattggctgtagatcacaagatgcaaaaggaaaagcttcataagagaattgctgcactagaaaggcagcttgatcagaagcaggagcttgaactggaggtccagcaactgaaaagtcagctgagcgtgatgagactcgtggaattggacagtggttctgaaattgtgaacaaggtggagaccttcctcagagaccttagtgagacagaaggagagcttgcacacttaaatcaattcaatcaagatcttgttgttcaagagcggaagagcaatgatgaacttcaagaagctcgaagagcattgataagcaatttgagagacatgggattgcatattggtgttaagagaatgggggagcttgacaccaaaccgtttatgaaagcaatgagaataaagtactgtcaagaagatctagaggattgggcagttgaagttatccagctttgggaggaatatcttaaggacccagattggcatccttttaaacggataaagcttgagactgcagaaacaatagtggaagtaattgatgaggatgacgagaagttaagaaccctgaagaatgaactgggggatgatgcgtaccaagcagtggcaaatgcattgctggagataaacgagtataatccgagtggaaggtacatctcctcagagctatggaacttcagagaagacaggaaggctacgcttgaggaaggtgttaattctctactggagcaatggaatcaagcgaagcatctcaagtcataaaggtttatatttgcatttacccggagatggaaaataagtttagcgtgtaaaggatgtcaaaatgcaaggttcaacaattgtctctcgtctttgatgcaatatatgggtcttagaattgcgaagtaggtgtaaattagaggaggatggcgtcacattgggactcgaagttgaaactatgtttctacacttgacggttcaacattgtaggaaactaagtaacaaacattgttagatgattctaaaccttagagaagtttatgaatttgtgaagaaatgaacactttggct

SEQ ID NO: 21 - DNA, 1686 bp, Arabidopsis thaliana
atggagaaaaatcaacaaaagcaggaatttctagctgagacctcagagatgaagaacaccaaaaacaacgacgactgttctgtacaacaacaacaacgatttgtgtggccatgggttggtctagtagccaacataccaacggaggtggaaccatcgggtcggagagtaggcaaaagcggttcaacgttacgtgatgagttcactatgaaagggtttaatccaacaagagtccaacccatttgggatttcaagggtcattctggttttgctttggttgaattcgctaaagactttgaaggattcgaaagcgccatgaatttcgaaaggagttttaatttagaccgtcatgggaagagagattgggaaaaaggtcatcgcttgagagacaataagctctatggatgggttgccagagaggatgattataatcgaagtgatactgttgggaagaacgtcaagaagaagagagatttgaaaagtatctctcagattgtggaggaagacgagaggaaaatggttcatcttgttgagaatatgtctcaaaccattgagaagaagaagcaaagtaaacaagagcttgaacagaaagttgatgagacttctcgtttcttggagagtttggaattgcataacgttctgttaaacaaaaactaccaagaagggtttcagaagatgcagatgaagatggaagagttgtatcaacaggttctggatggacatgaaaagtctttggcagaactggaggcaaagagggagaagcttgacgagcgtgcaagactgatcgagcaacgggctatcataaacgaagaagagatggaaaagtccagacttgaaagagaaatgaatcaaaaggctatgtgtgagcagaatgaagcgaatgaggaagctatgaagcttgcagaaaagcaccaggcaagtagttcgttaaaagagaaggagaagcttcataaaaggataatggaaatggaagctaagctaaatgaaacgcaagagctggagttggagatagagaagctgaaaggtactacaaatgtgatgaagcatatggtggggagtgatggagataaagatattgtggagaagatagccaaaactcagattcagcttgacgctcaagaaacggctctccatgaaaaaatgatgactctggcacgaaaagaacgtgcaaccaacgacgagtatcaagacgttcttaaagagatgattcaggtatggaacgccaatgaagagttgatgaagcaagagaagattagagtgaagagaatggggcaattaaaccctgcacccttcttgcctgcagtgatgaagaaacataaagttacacaatcaaaggcagagaataaggctatgaagctgtgttcagtgtgggaagcaaacataggagatgtgcaatggactccatttagagtcgatgagtctgatggaacaccaaagagagttgtggatgaaaacgacgagaagcttcgtacgctgaagaaccagtacggtgaagaagtttataatgaagtggtaagaacaaaactagagattgaggaacataacgctagtggcagctatgtgattttagagctttggaactatgaggaaaaccgaaaggcgacgatggaggaagcaacagatgtgatgttgaagataaggtccaaacttgctgctatgaagaacaaacgaaagaggcttgaggtctaa

SEQ ID NO: 22 - DNA, 2183 bp, Arabidopsis thaliana
gtttcctcctccagtaaactgacgacgatacaagctctctcaccaacggcgacagtatctttgccggcggcgggagcgcttctgcttaatctgtagctcaaactaaaaattctctgggtattactcatggtgatttggaataacgatgatgatgattttttggagattgataactttcaatcttctccacggtcatctccaatacatgcaatgcagtgtagggtcgaaaatctagctggtgtagccgtgacaactagttctttgagctctcctactgagacaactgatttagttcagatgggcttctcagacgaggtttttgctacattgtttgacatgggatttcctgttgagatgatttctagagcgatcaaggaaactggaccaaatgtagaaacttcggttataattgatactatctccaaatactcaagcgactgtgaagctggttcttccaagtccaaggctattgatcatttccttgctatgggatttgatgaagaaaaagttgtcaaagccattcaagaacatggagaagacaatatggaagcaattgcaaatgcattgctctcttgtccagaggctaagaaactgccagcagcagtagaggaagaagatggcattgactggtcatcaagtgatgatgataccaattacaccgatatgttaaactcagatgatgagaaagatccaaactcaaatgaaaatggcagcaaaatacggtctttggtgaagatgggtttctcagagcttgaagcttctttagctgtcgagagatgtggagaaaatgtggatattgcagagctcacagacttcctttgtgctgctcaaatggctagggaatttagtgagttttacactgaacatgaagaacaaaagcctagacataatattaagaaaaggcggtttgagtcaaaaggagagccaagatcatctgttgatgacgagccgattcgtctaccaaatccaatgataggatttggggttccaaacgagcccggactcattacacatagatcgcttccagagttagcccgagggccaccttttttctactatgagaatgtcgccctcacacctaaaggcgtttgggagactatttccaggcacttgttcgagatcccacctgagtttgtggactcaaaatatttctgtgttgcagcgaggaagagaggctacatccacaatctccccatcaacaacagatttcagattcagcctccaccaaaatacaccatccatgatgcatttcctttgagtaagagatggtggccagaatgggataaaaggaccaagcttaattgcattttgacttgtacaggtagtgctcagttgactaacaggattcgtgtagcccttgagccttacaatgaagaaccagaaccgcctaagcatgtacaaagatatgtgattgaccagtgcaaaaaatggaatttggtttgggtgggtaaaaacaaagctgccccactcgagccagatgagatggagagtattctgggatttccaaaaaatcatactcgtggtggaggcatgagtagaactgagcgcttcaagtccttaggaaattcgtttcaggttgatactgtggcgtatcatctgtctgtcctgaagcccattttcccacatggaatcaatgttctctctcttttcacgggtattggtggtggggaagtggcacttcatcgtctccaaatcaaaatgaagcttgttgtgtctgttgagatttcaaaagtcaacagaaatattttgaaggacttttgggagcaaactaaccagactggagaattgatcgagttttcagacatccaacacttgactaatgacacaatcgaagggttgatggagaaatatggtggatttgatcttgtaattggaggaagtccttgtaacaatctggcaggcggtaatagggtaagccgagttggtcttgaaggtgatcaatcttcgttgttctttgagtattgccgtattctagaggtggtacgtgcgaggatgagaggatcttgatcattcacattacctgaagtagattgaagtagatatgactccatgaaatctagttgaactttatttttctatatctgttatgtaatatggccatgaaggtacatttttgaataatataagtcaacctaactctcttttgctttttgcgacaatatatctgcaactgcatttgcact

SEQ ID NO: 23 - DNA, 4743 bp, Arabidopsis thaliana
atgcattcgtcgttggagccggagaaaatggaggaaggtgggggaagcaattcgcttaagagaaaattctctgaaatcgatggagatcaaaatcttgattctgtctcttctcctatgatgactgactctaatggtagttatgaattgaaagtgtacgaggttgctaagaacaggaacataattgctgttttggggacagggattgataagtcagagatcactaagaggcttatcaaagctatgggttcttctgatacagacaaaagattgataattttcttggccccaactgtgaatcttgttaaacagcaatgctgtgagatcagagcacttgtgaatttgaaagttgaagagtactttggagctaaaggagttgataaatggacatctcagcgctgggatgaggaatttagcaagcacgatgttttagttatgactcctcaaatattattggatgtccttagaagtgcattcctgaaactagagatggtatgtcttctaataatagatgaatgccaccataccactggcaatcatccctatgcgaagttaatgaaggaattctatcacgaatccactagcaaaccgaagatatttggattgactgcgtcagccgtcattagaaaaggcattgtttcctctccctctaactatgcagctcaagtatcagaacttgagagactcatggactcaaagatttttaatcctgaagagcgtgaaggagtggaaaagtttgctacaacggttaaagaaggtccaatattgtataacccatcaccatcctgtagtttggaattgaaagaaaagttagaaacttcacacctcaagtttgatgcttctcttagaaggcttcaagagttgggaaaagacagttttctgaatatggataataagtttgagacatatcaaaagagattgtctatcgactacagagagattttgcattgccttgataatcttggcctgatttgcgcacacttggcggctgaagtctgcttggagaaaatctcagatacgaaagaggaaagtgaaacttataaagaatgctcaatggtgtgcaaggaatttcttgaggatattttatccaccattggggtgtatttgccgcaagatgataagagtctggtagatttgcagcaaaaccatctgtcagcagtaatttctgggcatgtatctccaaagctaaaagaactcttccatctattggattcctttagaggtgacaagcaaaagcagtgccttattttagttgagagaattataactgcgaaagtgatcgaaagattcgttaagaaagaagcctctttggcttaccttaatgtcttgtatttaaccgaaaacaacccctccaccaatgtatcggcacagaaaatgcaaattgaaatccctgatttatttcaacatggcaaggtgaatcttttattcatcacagatgtggttgaagagggatttcaggttccagattgctcatgcatggtttgttttgacctgcccaaaacaatgtgtagttactcgcagtctcaaaaacatgccaaacagagtaattctaagtctatcatgtttcttgaaagagggaacccgaagcaaagagaccatctgcatgaccttatgcgaagagaagtcctaattcaagatccagaagctccaaacttgaaatcgtgtccacctccagtgaaaaatggacacggtgtgaaggagattggatccatggttatcccagattctaacataactgtatctgaggaagcagcttccacacaaactatgagtgatcctcctagcagaaatgagcagttaccaccgtgtaaaaagttacgcttggataacaatctcttacaatccaacggcaaagagaaggttgcctcttctaaaagtaaatcatcttcatcggctgcaggttcaaaaaaacgtaaggagttgcacggaacaacctgtgcaaacgcattgtcaggaacctggggagaaaatattgatggcgccacctttcaggcttataagtttgacttctgttgtaatatttctggcgaagtatactcgagtttctctcttttgcttgagtcaactctcgccgaggatgttggtaaagttgagatggacctttacttggtcaggaagcttgtcaaggcttctgtctcaccttgtggccagatacgtttgagtcaagaggagctggtcaaagcaaaatattttcagcagtttttctttaatggcatgtttggaaagttgtttgttggatctaagtcacagggaacaaagagagaatttttgcttcaaactgacactagttctctttggcaccctgcctttatgtttctactgctaccagttgaaacaaatgatctagcttcgagtgcgacaattgattggtcagctatcaactcctgtgcctcaatagttgagttcttgaagaaaaattctcttcttgatcttcgggatagtgatgggaatcagtgcaatacctcatccggtcaggaagtcttactagacgataaaatggaagaaacgaatctgattcattttgccaatgcttcgtctgataaaaatagtctcgaagaacttgtggtcattgcaattcatactggacggatatactctatagttgaagccgtaagcgattcttctgctatgagcccctttgaggtggatgcctcatcaggctatgctacttatgcagaatattttaacaaaaagtatgggattgttttagcgcacccgaaccagccgttgatgaagttgaagcagagtcaccatgcgcacaaccttttagtcgacttcaatgaagagatggttgtgaagacagaaccaaaagctggcaatgttaggaaaagaaaaccgaatatccatgcgcatttgcctccagagcttttggctagaattgatgtaccgcgtgctgtgctaaaatcaatctacttgctgccttcagtgatgcaccgcctagagtctctaatgttggccagccagcttagggaagagattgattgtagcatagataacttcagtatatcaagtacatcgattcttgaagcagttacaacacttacatgccccgaatcattttcaatggagcggttggaactgctcggggattcagtcttgaagtatgttgcgagctgtcatctattccttaagtatcctgacaaagatgaggggcaactatcacggcagagacaatcgattatatctaactcaaatcttcaccgcttgacaaccagtcgcaaactacagggatacataagaaatggcgcttttgaaccgcgtcgctggactgcacctggtcaattttctctttttcctgttccttgcaagtgtgggattgatactagagaagtaccattggacccaaaattcttcacagaaaacatgactatcaaaataggcaagtcttgcgacatgggtcatagatgggtagtttcaaaatctgtatcagattgcgctgaggccctgattggtgcctattatgtaagcggtggattgtctgcttctctccatatgatgaaatggctcggtattgacgtcgattttgacccaaacctagtcgttgaagccatcaatagagtttctctacggtgttacattcctaaagaagatgagctcatagagttggagagaaagatccaacatgaattctctgcaaagtttcttttaaaagaggctatcacacactcctctcttcgtgaatcctattcatacgagagattagagtttcttggcgattctgtactggattttctaataacccgtcatctttttaacacctacgaacaaactgggcctggagagatgaccgatcttcgttctgcatgtgtaaacaatgaaaattttgcgcaagttgcagtgaaaaataacctgcatacccaccttcaacgctgtgctacggttctcgagactcaaataaacgactatctgatgtcctttcaaaagccagatgagactggtagatcaatcccttcaatacagggccctaaggctcttggagatgttgtggagagtatcgctggagcattgctgatcgatacgaggttagatctcgatcaagtgtggagagtctttgagccgttgctttctccacttgtaactccagataaacttcagcttcctccataccgggagctcaatgagctatgcgactctcttgggtatttctttcgagtgaaatgttcaaatgatggtgtcaaagcacaagccacgatccagttgcagctggatgatgttcttttaactggagatggatctgaacagacaaataaactggccttgggaaaagcagcttcacatctgcttacacaacttgagaagagaaacatttcacgtaaaacctcgctcggggataatcaaagttccatggatgtcaatcttgcttgcaatcatagcgacagagaaactctgacttcagagactactgaaatccagagtatagtgattccatttattggacctataaacatgaagaaaggcgggcctcgtggaactctacatgagttttgcaagaagcatctgtggccaatgcctactttcgatacctcggaagagaaatccagaactccgtttgaattcatagatggcggtgagaagcggactagcttcagcagtttcacatcgaccataaccctaaggatacccaatcgtgaggctgtgatgtatgctggagaagcaaggcctgacaagaagagttccttcgactctgcagtcgtggaattgctttatgagctcgagcgccgcaagatcgtcataatacaaaagtag

SEQ ID NO: 24 - DNA, 4742 bp, Arabidopsis thaliana
atgcattcgtcgttggagccggagaaaatggaggaaggtgggggaagcaattcgcttaagagaaaattctctgaaatcgatggagatcaaaatcttgattctgtctcttctcctatgatgactgactctaatggtagttatgaattgaaagtgtacgaggttgctaagaacaggaacataattgctgttttggggacagggattgataagtcagagatcactaagaggcttatcaaagctatgggttcttctgatacagacaaaagattgataattttcttggccccaactgtgaatcttgttaaacagcaatgctgtgagatcagagcacttgtgaatttgaaagttgaagagtactttggagctaaaggagttgataaatggacatctcagcgctgggatgaggaatttagcaagcacgatgttttagttatgactcctcaaatattattggatgtccttagaagtgcattcctgaaactagagatggtatgtcttctaataatagatgaatgccaccataccactggcaatcatccctatgcgaagttaatgaaggaattctatcacgaatccactagcaaaccgaagatatttggattgactgcgtcagccgtcattagaaaagctcaagtatcagaacttgagagactcatggactcaaagatttttaatcctgaagagcgtgaaggagtggaaaagtttgctacaacggttaaagaaggtccaatattgtataacccatcaccatcctgtagtttggaattgaaagaaaagttagaaacttcacacctcaagtttgatgcttctcttagaaggcttcaagagttgggaaaagacagttttctgaatatggataataagtttgagacatatcaaaagagattgtctatcgactacagagagattttgcattgccttgataatcttggcctgatttgcgcacacttggcggctgaagtctgcttggagaaaatctcagatacgaaagaggaaagtgaaacttataaagaatgctcaatggtgtgcaaggaatttcttgaggatattttatccaccattggggtgtatttgccgcaagatgataagagtctggtagatttgcagcaaaaccatctgtcagcagtaatttctgggcatgtatctccaaagctaaaagaactcttccatctattggattcctttagaggtgacaagcaaaagcagtgccttattttagttgagagaattataactgcgaaagtgatcgaaagattcgttaagaaagaagcctctttggcttaccttaatgtcttgtatttaaccgaaaacaacccctccaccaatgtatcggcacagaaaatgcaaattgaaatccctgatttatttcaacatggcaaggtgaatcttttattcatcacagatgtggttgaagagggatttcaggttccagattgctcatgcatggtttgttttgacctgcccaaaacaatgtgtagttactcgcagtctcaaaaacatgccaaacagagtaattctaagtctatcatgtttcttgaaagagggaacccgaagcaaagagaccatctgcatgaccttatgcgaagagaagtcctaattcaagatccagaagctccaaacttgaaatcgtgtccacctccagtgaaaaatggacacggtgtgaaggagattggatccatggttatcccagattctaacataactgtatctgaggaagcagcttccacacaaactatgagtgatcctcctagcagaaatgagcagttaccaccgtgtaaaaagttacgcttggataacaatctcttacaatccaacggcaaagagaaggttgcctcttctaaaagtaaatcatcttcatcggctgcaggttcaaaaaaacgtaaggagttgcacggaacaacctgtgcaaacgcattgtcaggaacctggggagaaaatattgatggcgccacctttcaggcttataagtttgacttctgttgtaatatttctggcgaagtatactcgagtttctctcttttgcttgagtcaactctcgccgaggatgttggtaaagttgagatggacctttacttggtcaggaagcttgtcaaggcttctgtctcaccttgtggccagatacgtttgagtcaagaggagctggtcaaagcaaaatattttcagcagtttttctttaatggcatgtttggaaagttgtttgttggatctaagtcacagggaacaaagagagaatttttgcttcaaactgacactagttctctttggcaccctgcctttatgtttctactgctaccagttgaaacaaatgatctagcttcgagtgcgacaattgattggtcagctatcaactcctgtgcctcaatagttgagttcttgaagaaaaattctcttcttgatcttcgggatagtgatgggaatcagtgcaatacctcatccggtcaggaagtcttactagacgataaaatggaagaaacgaatctgattcattttgccaatgcttcgtctgataaaaatagtctcgaagaacttgtggtcattgcaattcatactggacggatatactctatagttgaagccgtaagcgattcttctgctatgagcccctttgaggtggatgcctcatcaggctatgctacttatgcagaatattttaacaaaaagtatgggattgttttagcgcacccgaaccagccgttgatgaagttgaagcagagtcaccatgcgcacaaccttttagtcgacttcaatgaagagatggttgtgaagacagaaccaaaagctggcaatgttaggaaaagaaaaccgaatatccatgcgcatttgcctccagagcttttggctagaattgatgtaccgcgtgctgtgctaaaatcaatctacttgctgccttcagtgatgcaccgcctagagtctctaatgttggccagccagcttagggaagagattgattgtagcatagataacttcagtatatcaagtacatcgattcttgaagcagttacaacacttacatgccccgaatcattttcaatggagcggttggaactgctcggggattcagtcttgaagtatgttgcgagctgtcatctattccttaagtatcctgacaaagatgaggggcaactatcacggcagagacaatcgattatatctaactcaaatcttcaccgcttgacaaccagtcgcaaactacagggatacataagaaatggcgcttttgaaccgcgtcgctggactgcacctggtcaattttctctttttcctgttccttgcaagtgtgggattgatactagagaagtaccattggacccaaaattcttcacagaaaacatgactatcaaaataggcaagtcttgcgacatgggtcatagatgggtagtttcaaaatctgtatcagattgcgctgaggccctgattggtgcctattatgtaagcggtggattgtctgcttctctccatatgatgaaatggctcggtattgacgtcgattttgacccaaacctagtcgttgaagccatcaatagagtttctctacggtgttacattcctaaagaagatgagctcatagagttggagagaaagatccaacatgaattctctgcaaagtttcttttaaaagaggctatcacacactcctctcttcgtgaatcctattcatacgagagattagagtttcttggcgattctgtactggattttctaataacccgtcatctttttaacacctacgaacaaactgggcctggagagatgaccgatcttcgttctgcatgtgtaaacaatgaaaattttgcgcaagttgcagtgaaaaataacctgcatacccaccttcaacgctgtgctacggttctcgagactcaaataaacgactatctgatgtcctttcaaaagccagatgagactggtagatcaatcccttcaatacagggccctaaggctcttggagatgttgtggagagtatcgctggagcattgctgatcgatacgaggttagatctcgatcaagtgtggagagtctttgagccgttgctttctccacttgtaactccagataaacttcagcttcctccataccgggagctcaatgagctatgcgactctcttgggtatttctttcgagtgaaatgttcaaatgatggtgtcaaagcacaagccacgatccagttgcagctggatgatgttcttttaactggagatggatctgaacagacaaataaactggccttgggaaaagcagcttcacatctgcttacacaacttgagaagagaaacatttcacgtaaaacctcgctcggggataatcaaagttccatggatgtcaatcttgcttgcaatcatagcgacagagaaactctgacttcagagactactgaaatccagagtatagtgattccatttattggacctataaacatgaagaaaggcgggcctcgtggaactctacatgagttttgcaagaagcatctgtggccaatgcctactttcgatacctcggaagagaaatccagaactccgtttgaattcatagatggcggtgagaagcggactagcttcagcagtttcacatcgaccataaccctaaggatacccaatcgtgaggctgtgatgtatgctggagaagcaaggcctgacaagaagagttccttcgactctgcagtcgtggaattgctttatgagctcgagcgccgcaagatcgtcataatacaaaagtagactaatttagactgtactatatatgattc

SEQ ID NO: 25 - DNA, 4596 bp, Arabidopsis thaliana
atgcattcgtcgttggagccggagaaaatggaggaaggtgggggaagcaattcgcttaagagaaaattctctgaaatcgatggagatcaaaatcttgattctgtctcttctcctatgatgactgactctaatggtagttatgaattgaaagtgtacgaggttgctaagaacaggaacataattgctgttttggggacagggattgataagtcagagatcactaagaggcttatcaaagctatgggttcttctgatacagacaaaagattgataattttcttggccccaactgtgaatcttcaatgctgtgagatcagagcacttgtgaatttgaaagttgaagagtactttggagctaaaggagttgataaatggacatctcagcgctgggatgaggaatttagcaagcacgatgttttagttatgactcctcaaatattattggatgtccttagaagtgcattcctgaaactagagatggtatgtcttctaataatagatgaatgccaccataccactggcaatcatccctatgcgaagttaatgaagatttttaatcctgaagagcgtgaaggagtggaaaagtttgctacaacggttaaagaaggtccaatattgtataacccatcaccatcctgtagtttggaattgaaagaaaagttagaaacttcacacctcaagtttgatgcttctcttagaaggcttcaagagttgggaaaagacagttttctgaatatggataataagtttgagacatatcaaaagagattgtctatcgactacagagagattttgcattgccttgataatcttggcctgatttgcgcacacttggcggctgaagtctgcttggagaaaatctcagatacgaaagaggaaagtgaaacttataaagaatgctcaatggtgtgcaaggaatttcttgaggatattttatccaccattggggtgtatttgccgcaagatgataagagtctggtagatttgcagcaaaaccatctgtcagcagtaatttctgggcatgtatctccaaagctaaaagaactcttccatctattggattcctttagaggtgacaagcaaaagcagtgccttattttagttgagagaattataactgcgaaagtgatcgaaagattcgttaagaaagaagcctctttggcttaccttaatgtcttgtatttaaccgaaaacaacccctccaccaatgtatcggcacagaaaatgcaaattgaaatccctgatttatttcaacatggcaaggtgaatcttttattcatcacagatgtggttgaagagggatttcaggttccagattgctcatgcatggtttgttttgacctgcccaaaacaatgtgtagttactcgcagtctcaaaaacatgccaaacagagtaattctaagtctatcatgtttcttgaaagagggaacccgaagcaaagagaccatctgcatgaccttatgcgaagagaagtcctaattcaagatccagaagctccaaacttgaaatcgtgtccacctccagtgaaaaatggacacggtgtgaaggagattggatccatggttatcccagattctaacataactgtatctgaggaagcagcttccacacaaactatgagtgatcctcctagcagaaatgagcagttaccaccgtgtaaaaagttacgcttggataacaatctcttacaatccaacggcaaagagaaggttgcctcttctaaaagtaaatcatcttcatcggctgcaggttcaaaaaaacgtaaggagttgcacggaacaacctgtgcaaacgcattgtcaggaacctggggagaaaatattgatggcgccacctttcaggcttataagtttgacttctgttgtaatatttctggcgaagtatactcgagtttctctcttttgcttgagtcaactctcgccgaggatgttggtaaagttgagatggacctttacttggtcaggaagcttgtcaaggcttctgtctcaccttgtggccagatacgtttgagtcaagaggagctggtcaaagcaaaatattttcagcagtttttctttaatggcatgtttggaaagttgtttgttggatctaagtcacagggaacaaagagagaatttttgcttcaaactgacactagttctctttggcaccctgcctttatgtttctactgctaccagttgaaacaaatgatctagcttcgagtgcgacaattgattggtcagctatcaactcctgtgcctcaatagttgagttcttgaagaaaaattctcttcttgatcttcgggatagtgatgggaatcagtgcaatacctcatccggtcaggaagtcttactagacgataaaatggaagaaacgaatctgattcattttgccaatgcttcgtctgataaaaatagtctcgaagaacttgtggtcattgcaattcatactggacggatatactctatagttgaagccgtaagcgattcttctgctatgagcccctttgaggtggatgcctcatcaggctatgctacttatgcagaatattttaacaaaaagtatgggattgttttagcgcacccgaaccagccgttgatgaagttgaagcagagtcaccatgcgcacaaccttttagtcgacttcaatgaagagatggttgtgaagacagaaccaaaagctggcaatgttaggaaaagaaaaccgaatatccatgcgcatttgcctccagagcttttggctagaattgatgtaccgcgtgctgtgctaaaatcaatctacttgctgccttcagtgatgcaccgcctagagtctctaatgttggccagccagcttagggaagagattgattgtagcatagataacttcagtatatcaagtacatcgattcttgaagcagttacaacacttacatgccccgaatcattttcaatggagcggttggaactgctcggggattcagtcttgaagtatgttgcgagctgtcatctattccttaagtatcctgacaaagatgaggggcaactatcacggcagagacaatcgattatatctaactcaaatcttcaccgcttgacaaccagtcgcaaactacagggatacataagaaatggcgcttttgaaccgcgtcgctggactgcacctggtcaattttctctttttcctgttccttgcaagtgtgggattgatactagagaagtaccattggacccaaaattcttcacagaaaacatgactatcaaaataggcaagtcttgcgacatgggtcatagatgggtagtttcaaaatctgtatcagattgcgctgaggccctgattggtgcctattatgtaagcggtggattgtctgcttctctccatatgatgaaatggctcggtattgacgtcgattttgacccaaacctagtcgttgaagccatcaatagagtttctctacggtgttacattcctaaagaagatgagctcatagagttggagagaaagatccaacatgaattctctgcaaagtttcttttaaaagaggctatcacacactcctctcttcgtgaatcctattcatacgagagattagagtttcttggcgattctgtactggattttctaataacccgtcatctttttaacacctacgaacaaactgggcctggagagatgaccgatcttcgttctgcatgtgtaaacaatgaaaattttgcgcaagttgcagtgaaaaataacctgcatacccaccttcaacgctgtgctacggttctcgagactcaaataaacgactatctgatgtcctttcaaaagccagatgagactggtagatcaatcccttcaatacagggccctaaggctcttggagatgttgtggagagtatcgctggagcattgctgatcgatacgaggttagatctcgatcaagtgtggagagtctttgagccgttgctttctccacttgtaactccagataaacttcagcttcctccataccgggagctcaatgagctatgcgactctcttgggtatttctttcgagtgaaatgttcaaatgatggtgtcaaagcacaagccacgatccagttgcagctggatgatgttcttttaactggagatggatctgaacagacaaataaactggccttgggaaaagcagcttcacatctgcttacacaacttgagaagagaaacatttcacgtaaaacctcgctcggggataatcaaagttccatggatgtcaatcttgcttgcaatcatagcgacagagaaactctgacttcagagactactgaaatccagagtatagtgattccatttattggacctataaacatgaagaaaggcgggcctcgtggaactctacatgagttttgcaagaagcatctgtggccaatgcctactttcgatacctcggaagagaaatccagaactccgtttgaattcatagatggcggtgagaagcggactagcttcagcagtttcacatcgaccataaccctaaggatacccaatcgtgaggctgtgatgtatgctggagaagcaaggcctgacaagaagagttccttcgactctgcagtcgtggaattgctttatgagctcgagcgccgcaagatcgtcataatacaaaagtag

SEQ ID NO: 26 - DNA, 2764 bp, Arabidopsis thaliana
agggtttcatttcgtctctttatcttccttcgtctctttagcttccttcgattctctgactcaatcatggcgccgaagcgaaagagacctgcgacaaaggatgacactaccaaatccattcccaaaccgaagaagagagctcctaagcgagctaagacggtgaaagaagagccggtgacagtggtcgaggaaggggaaaagcatgttgcgaggtttctagacgagccaattccagaatctgaagcgaagagtacctggcctgacagatacaaaccgattgaggtacagccacctaaggcttcgtcaagaaagaagacgaaggatgacgaaaaagttgagatcattcgtgctcgatgccattatagacgtgcgattgttgatgagcgtcagatatatgagctgaatgatgatgcttatgtacagtctggtgagggaaaggatcccttcatttgtaaaatcattgaaatgtttgaaggggctaatgggaaactgtatttcacggctcggtggttttatagaccttctgatactgtaatgaaagagttcgagattctgatcaagaaaaagcgtgtgtttttctctgagatacaagatacaaatgaattgggattacttgaaaagaagctgaacattttgatgattcccttgaatgaaaatactaaagagactatccctgcaacagaaaactgtgactttttctgtgacatgaactatttcttgccttacgatacatttgaagctatacaacaagaaaccatgatggctataagtgaaagttcaacaatatccagtgatactgatataagagaaggagctgctgccatatcagagattggagaatgttctcaagaaacagaaggtcacaaaaaggcaactttgcttgacctttactccggctgtggagctatgtcgacagggttgtgcatgggtgcacaactgtctggtttgaacctcgtcactaaatgggctgttgacatgaatgcacatgcatgtaaaagcttgcagcataaccacccagagacaaacgtgagaaacatgaccgcagaagatttcttgtttctgcttaaggagtgggagaagctatgcattcatttctctttgagaaatagtccaaattcagaagaatatgccaaccttcacggtttgaataatgttgaggacaatgaagatgtcagcgaggagagtgaaaatgaagatgatggagaagtttttactgttgacaagattgttggtatttccttcggagtccctaaaaagttattgaaacgtggactttatttgaaggtaaggtggctgaattatgatgattctcatgatacatgggagcctattgaaggactcagtaattgccggggtaaaattgaagagttcgttaaacttggatataaatctggcatccttccgttaccaggaggtgttgatgttgtctgcggtgggccaccatgccaaggaatcagtggtcacaaccgcttcaggaacttattggaccctctagaagatcagaaaaacaagcagcttttggtgtatatgaacattgtagaatatttgaagcctaagttcgttttgatggaaaacgtcgttgacatgctgaagatggctaagggctatcttgcacggtttgctgttggacgccttctacagatgaattaccaagtgaggaatggaatgatggcagctggagcttatgggcttgctcagtttcgtttgaggttctttctatggggtgcactccctagtgagataattccgcagttcccacttccaacacatgatctagttcatagaggaaatattgtcaaggagtttcagggaaacatagtagcctatgatgaaggacatactgtgaagttagcagacaagcttttgttgaaggatgtgatttctgatcttcctgcagttgccaacagtgaaaaaagagacgagattacatatgacaaagatcccacaacgccatttcaaaagttcatcagattgagaaaggatgaagcgtcaggttcacaatcaaagtccaagtccaaaaagcatgtcttatatgatcatcaccctcttaatcttaatataaatgactatgaacgggtttgtcaggtccccaagagaaagggagcgaattttagggactttcctggtgttattgttggacctggtaatgtagtcaagttggaagagggaaaggaaagggtcaaacttgaatctggaaaaacattggttcccgattatgccttaacatatgtcgatgggaaatcatgcaaaccttttggtcgtctttggtgggacgaaattgtccccactgttgtcacacgggcagaaccccacaaccaggtgatcattcatccagagcaaaatcgggttttatccattcgagaaaatgcgagactccaaggctttcctgatgactacaaactctttggcccacccaaacagaagtacattcaagtaggtaacgctgtagctgtgccagtagcgaaggcccttggatatgctttgggaacagctttccagggactcgcagttgggaaagatccacttcttactctgcctgaaggttttgcattcatgaagccaactcttccttccgagcttgcatgaacactgttgattcatcgcatttttcgatttatcttctattcattgttttcctaggatttatctttagaccatttgctgcggaatttggatttgttttgtttaagtttcacgactttcaagtttagcaactctgaatttctggtaactttgttttaatcagatgttatggatttgtggg

SEQ ID NO: 27 - DNA, 3018 bp, Arabidopsis thaliana
caccaaaacaaacaaaccctttcttcttcctctcataatccctctctctcttcttctctctcgctcgctgctctgtttagggtttttctcgttcgtctcttctataagtactagagatggattctgatgaaccgaatgggagtggattaccacctccaccacctttcgttccagcaaatcttgtccctgaagtggagcctgtaaaaaagaacattcttctcccaatggctcggcctcgaggcagcggctccaaaggacagaagattcctcttcttactaatcactttggagtcaagttcaacaaaccaagcggttacttctttcattacagtgttgctatcaattatgaagatggccgtccagtggaggctaaaggtatcggccgaaagattcttgacaaagttcaggagacctatcaaagtgatttgggtgccaaatactttgcttatgatggcgagaagactctcttcactgttggtgctcttcccagcaacaaacttgacttctctgttgttcttgaagaaataccttctagcagaaatcacgctggaaatgatacaaatgatgctgatagaaaaagatcaaggcgtcccaaccaaactaagaaattcatggttgagataagttatgctgcaaagatccccatgcaggctattgcaagcgctcttcaagggaaggagacagagaatcttcaagacgctctgagagtgctggatattattttgcgccagagtgcagctaggcaaggttgcctccttgttcgccagtcctttttccacaatgacgtaaagaactttgtacctattggtggaggtgtcagtggttgcagagggttccattcaagtttcagaactactcagggaggcttatccctgaatattgacacttcaactacgatgatagtacaacctggacctgtagttgatttcctgcttgctaaccagaacaagaaagatccatacggaatggactggaacaaggctcgacgtgtcctcaagaatctgagagttcaaattactctttccaatagagaatacaagataagtggactaagtgaacacagctgcaaagatcaactatttacatggaggaaacctaacgacaagggagaatttgaggaggttgagatcacagtgctcaattactataaagagcgtaacattgaagtgcgttattcaggtgacttcccttgcatcaatgttggtaagccgaagcgtcccacttacttccccattgagttctgtaatcttgtgtctctacagcgatacacaaaatcgcttaccaattttcagagggctgccctagttgaaaagtctaggcagaagccacctgaaaggatggcctcgctaaccaaaggtctgaaggacagcaattacaatgccgacccggtattgcaagatagtggtgttagcattatcaccaattttacccaagttgaaggccgtatcttaccaacaccaatgctgaaagtgggcaagggagaaaacctttccccaatcaaaggaaaatggaactttatgcgtaagacactcgctgagccaacgacggttactagatgggctgttgtgaacttctctgctcgctgtgatacaaatacacttattcgtgacttgattaaatgtggacgggagaaaggaattaatgtagagcctccattcaaggatgtcatcaacgagaatcctcagtttaggaatgcaccagctactgtgagagtagagaatatgtttgagcagataaaatccaaactcccaaagccgcctctgttccttctttgcatactcgctgaaaggaaaaactctgatgtttatggcccttggaaaaaaaagaatcttgttgatcttggaattgtgactcagtgcattgctcccaccagactgaacgatcagtatctcaccaatgttctcctgaagataaatgccaagcttggtggattgaattcgttgttagctatggagcgctcaccagcaatgccaaaagtaacgcaagttcctaccatcattgttgggatggatgtatcccatggttcccctggccagtctgatataccatcaattgctgctgttgtgagctcaagacaatggccactcatctcaaaatataaggcatgtgtacgcacacaatcacgcaaaatggaaatgattgataatctcttcaaacccgtcaatggcaaagacgaaggaatgttcagggaactcttgttagacttttactacagttcagagaataggaaaccagagcacatcattattttcagggatggtgtaagcgagtctcagttcaatcaagttcttaatattgaattggatcagatgatgcaggcatgcaagtttcttgatgatacgtggcatccgaagtttacagtgatagttgcccagaagaaccaccacacaaagttcttccagtctcgaggccctgataatgttcctccaggaacaatcattgacagccagatctgtcacccacgcaactttgatttctatctctgcgcccatgctggcatgattggaactacaaggccaacacattaccatgttctgtatgacgagattgggtttgccacagacgacctccaagaacttgtgcattctctgtcctatgtctaccagaggagcaccactgcgatctcagtcgttgcacctgtatgttacgctcatttggcagctgcacagatgggaactgtgatgaagtatgaagagttgtctgagacttcttcgagccatggaggaatcaccacacctggagcagtccctgtgccacctatgccgcagctgcacaataatgtttcaacctccatgttcttctgttgatggaacatggtccagtccacacgatagctgagtttatatgcttttgatggagaaccaacgaacttttgtttactcttctctgggtttggttcctcttttgtttttcgtcgaccctttaacattgaggagatactctttatattctgtcggtttttgtgggcgctgttggttgatactttattatgcttaatcagatttggtattttaaggc

SEQ ID NO: 28 - DNA, 2997 bp, Arabidopsis thaliana
cattcttttgcttgtctgggaaacccaaagagactgtgacggagaagagaaatgagctaaataaattcctctctttgattcaccggaaccctagaaatcctcttcttaattctttcaaagattattttcccctggaaggatggagacatcttcatctctgccactgtcacccataagtatagaaccagaacagcccagccatcgagattatgacatcacaactagacgtggggttggaaccacaggcaacccaatagaattgtgcaccaatcactttaatgtttctgtgagacagccggatgtagtattttaccagtacactgttagtatcaccacagaaaacggtgatgctgttgatgggacaggaataagcagaaagcttatggaccaactattcaagacttactcttctgatcttgatggtaaaaggttggcatatgatggagagaagactttatatactgttggtcctctaccacagaacgaatttgactttctagtcatcgtggaagggtcattttcaaaacgtgattgtggtgtctctgatggtggtagttcttccggtacttgcaagcgatcaaaacgttctttcttgccaagaagttacaaggttcagatacattatgctgcagaaataccgttgaagactgttcttggcactcagagaggagcttatacaccagataagagtgctcaggatgcacttagagtgcttgacattgtactgaggcagcaagcagctgaaaggggatgccttttggtcagacaggcatttttccatagcgatgggcaccccatgaaagttggaggaggtgttataggtattcgaggtttacattcgagctttcgtccaactcatggaggactctcgcttaacattgatgtgtcaacaacaatgatcttagaacctggtccagttattgaattcctgaaagccaatcagagtgttgagacaccacggcaaatcgactggattaaggctgcgaaaatgcttaaacatatgagggttaaggcaacacaccgtaacatggaatttaaaattataggtctaagttcgaaaccgtgcaatcagcaactgttttcaatgaagattaaagatggtgaacgtgaggtacctattagagagattactgtgtatgactatttcaagcaaacctacacagagcctatttcttctgcgtactttccatgccttgatgttggcaagccagatcggcccaactatcttccactggagttttgtaatcttgtatctctgcaacgttatacaaaaccattgtcagggaggcaaagagttttacttgttgaaagttcaagacaaaaacctctagagagaattaaaacactcaatgatgcaatgcatacctactgctatgacaaggacccatttttggctggatgtggcatctccattgaaaaagaaatgactcaagttgaaggccgtgttctcaagcccccaatgctgaagtttggcaagaatgaagattttcaaccttgcaacggacggtggaactttaacaacaagatgcttctagaaccaagagctattaaaagctgggctatcgtcaacttttcttttccatgcgacagtagtcacatttcccgtgagcttataagctgtggcatgaggaaaggcattgaaattgatcgaccttttgcactagttgaagaggatccacagtacaaaaaagcaggtcctgttgaaagggtagaaaaaatgattgcaacgatgaagttaaaatttccagatcctcctcattttatcctctgtattctgccagaacggaaaacttctgatatctatggtccctggaagaagatatgcctcactgaagaagggatccacacacaatgcatctgcccaatcaagatcagtgaccaatatctcaccaatgtacttctgaagataaattcgaagcttggaggcatcaattctctgttgggaatagagtactcttacaacattccattgataaacaaaattcccaccttgattttgggtatggatgtatctcatgggcctccaggtcgggcagatgttccttcagtagcagcggttgttggttcaaaatgctggcccttaatctcaaggtatagggcagctgtaagaactcagtcaccacgtctggagatgattgattcgctcttccaacctatcgagaacactgagaaaggagataacggtatcatgaacgaattatttgtagagttctatcggacaagcagggcacggaaacctaagcagattatcattttcagggatggtgtgagtgaatcacagttcgagcaagtcttgaagatcgaagtggaccaaattataaaggcgtatcaacgtcttggtgaatctgatgtgccaaaattcactgtcattgtggctcagaagaaccaccacaccaagttgtttcaagctaagggtcctgaaaatgttcctgcaggaactgtcgtggacaccaagatcgtacacccgacaaactacgatttttacatgtgtgctcatgcaggaaaaataggaacttcaagaccggctcattaccatgtattacttgatgagattggtttctcccccgatgacttgcagaatctcatccattctctctcctatgtcaaccaacgtagcacaactgcaacttcgatcgtggctccagtacgatacgctcatcttgcagcagctcaagttgcgcaattcacaaagtttgaaggtatatcggaggacgggaaagttccagagcttccacgtctgcacgagaatgtcgaaggcaacatgttcttctgctgagtacatataagtagttctgcttcctccctagtctaaacccaaaccctcctctttagaggaagtttatcattttgcatatatgcaatcatcaccgtacagtttcattagaagtaagaagaaagatcctcgcgtagattaagaggctcattggcttattgatagcccaagtttgcttactaaacggcagcgatttttgcgtttagcttttggatttttcaata

SEQ ID NO: 29 - DNA, 2553 bp, Arabidopsis thaliana
atggatacgactctaccgcctcctcaacacatggaacgtgaacctttgaagagcaagagtagtcttcttccaatgactcgccgtggcaacggttccaaaggacagaagattcttctgctcactaaccacttcagagtcaacttcagaaaaccaaacagtcataatttcttccattacagcgttactatcacatatgaagatggtagtccacttttagccaaaggttttggcagaaagattcttgaaaaagttcaacagacttgtcaagctgatttgggttgcaaacattttgcttatgatggcgacaagaatctttatactgttggtcctcttcctagatccagtctagacttctctgttgttcttgaaaccgcgccttctaggagaaacgcagacaaaagactaaagcttcctcaccaatccaagaaattcaatgttgcaatcctttttgcgcctccagaaatcccaatggaagctattgcaaatgctcttcaaggaaagaaaactaaacatcttctagatgctatcagagtgatggactgtattttgagccaaaatgcagctagacaaggttgcctcctagttcggcaatctttcttccacaatgacgcaaagtactttgcgaatatcggtgaaggtgtagattgttgcaaaggatttcattcaagcttcagaactactcagggaggcttgtccctcaatattgatgtttcgactgctatgatagtaaaacctggtcctgttgttgattttcttattgcaaatcaaggtgtgaacgatccattctctattaactggaaaaaggctaaaaatactctgaaaaatcttagagttaaagtcctcccttcaaatcaagaatacaagataaccggactaagtggactacactgcaaagatcaaacgtttacttggaagaaaaggaaccaaaacagggaatttgaggaggttgagattacagtgtccgattacttcactaggatccgtgaaatcgaactgcgttactcgggtggcttaccttgtatcaatgttggtaagccaaatcgtcctacctactttcccattgagctctgtgagcttgtatctctacaacgctatactaaagcgctaaccaaattccagaggagtaaccttatcaaagaatcaaggcagaatccacaacaaagaattggtgtgttaaccagagctctcaagactagtaattataatgatgacccaatgttgcaagaatgtggtgttaggattggctctgacttcactcaagtcgaaggccgcgtgttaccaacaccaaagcttaaagctggcaaagaacaagacatctatcctattaatgggagttggaacttcaagaacaagccagccacagttactagatgggctgttgtgaacttctctgctcgctgtgacccgcaaaagattattgatgatttgaccagatgtggaaagatgaaaggaattaacgtagattctccataccatgtcgtctttgaagaaaatcctcagtttaaggatgccactggttctgtaagagttgataagatgtttcaacatttacaatcaatactcggcgaagttcctccaaaattccttctatgcatactcgaaaagaaaaactctgatgtttatgaaaaatcttgttcaatgtggaattgtgaatgtattgttcctcctcaaaacttaaatgatcagtatctcacaaatcttctactaaagataaatgccaagcttggtggattgaattcagttttggatatggagctgtcaggaacaatgcctctggtaatgagagttcctaccatcattattggaatggatgtatctcatggttctcctggacagtctgatcatataccatccattgccgcggttgtgagctccagagagtggccactgatctcaaaatacagggcttgtgtgcgtacacagtcgcctaaagttgaaatgatcgatagcctctttaaacccgtctctgacaaagatgatcaaggtatcatgagagagctcttgcttgactttcactcaagttctggaaagaaaccgaatcacattatcattttcagggatggtgtcagtgaatctcagtttaaccaagttcttaatattgaactggatcagatgatgcaaataaaccaccacacgaagttcttccaaaccgaaagccctaataatgttcttccaggaacaataattgacagcaacatctgtcaccaacacaacaacgatttctatctttgtgctcatgctggaaagattggaactacaaggccaacacattaccatgtgctctacgacgagattggatttgacacagatcaactccaagaacttgtgcattcactatcctatgtctaccagcggagcacaactgccatctctcttgttgcgccgatatgttatgctcatttggcggctgcacagatggcaactgcaatgaagtttgaggacatgtctgagacttcatcgagccacggcgggatcaccacagctggagcagtccctgtgcctcccatgccgaagctgaacaccaacgttgctagttcaatgttcttttgctga

SEQ ID NO: 30 - DNA, 2994 bp, Arabidopsis thaliana
atgtcaaatcgtggtggtggtggtcacggcggcgctagtcgtggtcgaggaggtggacgaaggtctgaccagagacaagatcagtcttctggtcaagttgcttggccgggtttacaacaaagctacggtggtcgtggtggttctgtttccgccggtagaggtcgtggaaacgtcggaagaggtgaaaatactggagatctgacggcgacgcaagttccggttgcttctgctgtttctggcgggagaggtcgtggtaacatcggagatccgacgttttctgttgcgtcttcgtctaagacggtgtctgttgcttcttcatctaaagaggaaagtaagaatacggaggtttctgagaccatgtcgaaccttcagattacttcgacggagacgaaacctgaaatgacgtcacttcctccggcgtcatctaaagcggttacgtttccggtacggccaggacgtggtactttggggaagaaagtcatggttcgtgcgaatcatttccttgttcaagttgctgatcgtgatctctaccattacgatgtttcgatcaatcctgaggttatatcaaagacagtgaacagaaacgtgatgaaacttctggttaagaattataaagactctcacttgggagggaagtcaccagcgtatgatggaaggaaaagcctctatactgctggtccattaccttttgactcgaaagagtttgttgtgaatctggcggagaaaagagctgacggttcctctgggaaggacagaccgtttaaagttgctgtaaagaatgtgacaagcactgatctttatcagttgcaacagttccttgatcgtaagcaaagagaggctccatatgatactatccaagtgcttgatgttgttcttagggataagccctctaatgattatgtctctgttgggaggtcttttttccacactagtttgggaaaggacgcaagagatggtaggggtgagcttggagatggtattgagtactggagaggttatttccaaagtctaaggctgactcagatgggtttgtctctgaacattgacgtttcagcaagatcattttatgaaccgattgttgtcactgactttattagcaagtttctgaatataagggacttaaacaggccacttagagactcagatcgacttaaggtgaagaaagttttgaggacactgaaagttaagttgcttcactggaacggcacaaaaagtgccaaaattagtgggatttctagtctacccatcagggagctaaggttcactctggaggacaaatcagagaagacggttgttcaatattttgctgaaaaatataattatagagtgaaataccaggctctacctgctattcaaacagggagtgacacaagacccgtctacctaccaatggagctctgccaaattgacgaagggcaaagatacaccaaaaggctcaatgagaagcaagtgactgcattgctaaaagctacctgccaacgaccccctgatagagagaactcgatcaaaaacttggttgtgaaaaataattacaatgatgatctgagcaaggagtttgggatgtcagtgactacccaactagcctcgattgaagctcgtgtacttcccccaccgatgttgaagtaccatgacagtggtaaagagaaaatggtaaatccaaggctaggacagtggaacatgattgacaagaaaatggttaatggagcaaaagtcacttcttggacttgcgtaagtttctctactcggattgaccgtggtttaccccaagagttctgcaaacagttgattgggatgtgtgtcagcaaaggaatggaatttaagcctcaacctgctattccgttcatctcttgtccccctgaacatattgaggaagctcttctcgatatccacaaaagggcacctggtctccaactgttgattgtaatattgcctgatgtgactggatcatatggaaaaataaaaaggatctgtgaaacagaattggggattgtctctcagtgttgccaacctagacaagttaataaactcaacaagcagtacatggaaaatgttgccttgaagatcaatgtcaagactgggggaaggaacactgttcttaatgatgctattagaagaaacatacctcttattactgatcgtccaaccatcatcatgggtgctgatgtgactcacccacagcctggagaggactcaagtccttctattgctgctgttgtggcctctatggactggcctgagataaacaaataccgaggattggtttctgctcaagctcatagggaagaaattattcaggacctgtataagctggttcaggatccacaacgtgggctagtccactctggtttgataagggaacatttcatagcattcaggagagctacaggccagatacctcaaaggatcatcttctatcgtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtactgtcgtggacactaaaatctgtcaccctaatgaattcgacttctatttgaacagccatgctggtattcagggaacaagcaggccggcacattaccatgtacttctcgatgagaacggtttcaccgctgatcagttgcaaatgctcacaaacaacctctgctacacgtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaa

SEQ ID NO: 31 - DNA, 5109 bp, Arabidopsis thaliana
atgcgtgacgaagttgacttgagcttgaccattccctcgaagcttttggggaagcgagacagagaacaaaaaaattgtgaagaagaaaaaaacaaaaacaaaaaagctaaaaagcagcaaaaggacccaattcttcttcacactagtgctgccactcacaagtttcttcctcctcctttgaccatgccgtacagtgaaatcggcgacgatcttcgctcactcgactttgaccacgccgatgtttcttccgaccttcacctcacttcttcttcctctgtttcttcgttttcctcttcttcgtcttctttgttctccgcggctggtacggatgatccttcaccgaaaatggagaaagaccctagaaaaatcgccaggaggtatcaggtggagctgtgtaagaaagcaacggaggagaacgttattgtatatttgggtacaggttgtgggaagactcacattgcagtgatgcttatatatgagcttggtcatttggttcttagtcccaagaaaagtgtttgtatttttcttgctcccaccgtggctttggtcgaacagcaagccaaggtcatagcggactctgtcaacttcaaagttgcaatacattgtggaggcaagaggattgtgaagagccactcggagtgggagagagagattgcagcgaatgaggttcttgttatgactccacaaatacttctgcataacttacagcactgtttcatcaagatggagtgtatctcccttctaatatttgatgagtgtcaccatgctcaacaacaaagcaaccatccttatgcagaaatcatgaaggttttctataaatcggaaagtttacaacggcctcgaatatttggaatgactgcatctccagttgttggcaaagggtcttttcaatcagagaatttatcgaaaagcattaatagccttgaaaatttgctcaatgccaaggtttattcagtggaaagcaatgtccagctggatggttttgtttcatctcctttagtcaaagtatattattatcggtcagctttaagtgatgcatctcaatcgaccatcagatatgaaaacatgctggaggacatcaaacagcggtgcttggcatcacttaagctgctgattgatactcatcaaacacaaaccctcctaagtatgaaaaggcttctcaaaagatctcatgataatctcatatatactctgctgaatcttggcctctggggagcaatacaggctgctaaaatccaattgaatagtgaccataatgtacaagacgagcctgtgggaaagaatcctaagtcaaagatatgtgatacatatctttctatggctgctgaggccctctcttctggtgttgctaaagatgagaatgcatctgacctcctcagcttagcggcgttgaaggaaccattattctctagaaagctagttcaattgattaagatcctttcggtattcaggctagagccacacatgaaatgtataatatttgtcaatcggattgtgactgcaagaacattgtcatgcatactaaataacttggaactgctacggtcttggaagtctgatttccttgttggacttagttctggactgaagagcatgtcaagaaggagtatggaaacaatacttaaacggttccaatctaaagagctcaatttactggttgccactaaagttggtgaagaaggccttgatattcagacatgctgtcttgtgatccgttatgatttaccagagactgttaccagcttcatacagtccagaggtcgtgctcgaatgcctcagtctgaatatgcgtttctagtggacagcggaaacgagaaagagatggatcttattgaaaattttaaagtaaatgaagatcgaatgaatctagaaattacttacagaagctcagaggaaacttgtcctagacttgatgaggagttatacaaagttcatgagacaggagcttgtatcagtggtggaagcagcatctcccttctctataaatattgttctaggcttccacatgatgaattttttcagcccaagccagagtttcaattcaagcctgttgacgaatttggtggaactatctgtcgcataactttacctgctaatgctcctataagtgaaatcgaaagttcactactaccttcgacagaagctgctaaaaaggatgcttgtctaaaggctgtgcatgagttgcacaacttgggtgtacttaacgattttctgttgccagattccaaggatgaaattgaggacgaattgtcagatgatgaatttgattttgataacatcaaaggtgaaggctgttcacgaggtgacctgtatgagatgcgtgtaccagtcttgtttaaacaaaagtgggatccatctacaagttgtgtcaatcttcattcttactatataatgtttgtgcctcatcccgctgataggatctacaaaaagtttggtttcttcatgaagtcacctcttcccgttgaggctgagactatggatatcgatcttcaccttgctcatcaaagatctgtaagtgtaaagatttttccatcaggggtcacagaattcgacaacgatgagataagactagctgagcttttccaggagattgccctgaaggttctttttgaacggggggagctgatcccggactttgttcccttggaactgcaagactcttctagaacaagcaaatccaccttctaccttcttcttccactctgtctgcatgatggagaaagtgttatatctgtagattgggtgactatcagaaactgcttgtcatcaccaatctttaagactccatctgttttagtggaagatatatttcctccttcgggctctcatttaaagctagcaaatggctgctggaatattgatgatgtgaagaacagcttggtttttacaacctacagtaaacaattttactttgttgctgatatctgccatggaagaaatggtttcagtcctgttaaggaatctagcaccaaaagccatgtggagagcatatataagttgtatggcgtggaactcaagcatcctgcacagccactcttgcgtgtgaaaccactttgtcatgttcggaacttgcttcacaaccgaatgcagacgaatttggaaccacaagaacttgacgaatacttcatagagattcctcccgaactttctcacttaaagataaaaggattatctaaagacatcggaagctcgttatccttgttaccatcaatcatgcatcgtatggagaatttactcgtggctattgaactgaaacatgtgctgtctgcttcgatccctgagatagctgaagtttctggtcacagggtactcgaggcgctcacaacagagaaatgtcatgagcgcctttctcttgaaaggcttgaggtgcttggtgatgcattcctcaagtttgctgttagccgacacctttttctacaccatgatagtcttgatgaaggagagttgactcggagacgctctaacgttgttaacaattccaacttgtgcaggcttgcaataaaaaaaaatctgcaggtctacatccgtgatcaagcattggatcctactcagttctttgcatttggccatccatgcagagtaacctgtgacgaggtagccagtaaagaggttcattccttgaatagggatcttgggatcttggagtcaaatactggtgaaatcagatgtagcaaaggccatcattggttgtacaagaaaacaattgctgatgtggttgaggctcttgtgggagctttcttagttgacagtggcttcaaaggtgctgtgaaatttctgaagtggattggtgtaaatgttgattttgaatccttgcaagtacaagatgcttgtattgcaagcaggcgctacttgcccctcactactcgcaataatttggagacccttgaaaaccagcttgactataagttcctccacaaaggtctacttgtacaagcctttatccatccatcttacaacaggcatggaggaggctgctaccagagattggagtttcttggggatgctgttctggactacttgatgacatcctattttttcacagtcttcccgaaactgaaacctggtcaactgaccgatctaagatctctctcagtaaataatgaggcgctagcaaatgttgctgtcagtttttcgctaaagagatttctattttgcgagtccatttatcttcatgaagttatagaggattataccaatttcctggcatcttccccattggcaagtggacaatctgaaggtccaagatgcccaaaggttcttggtgacttggtagaatcctgtttgggggctcttttcctcgattgtgggttcaacttgaatcatgtctggactatgatgctatcatttctagatccggtcaaaaacttgtctaaccttcagattagtcctataaaagaactgattgaactttgccagtcttacaagtgggatcgggaaatatcagcgacgaaaaaggatggtgcttttactgttgaactaaaagtgaccaagaatggttgttgccttacagtttctgcaactggtcggaacaaaagagagggcacaaaaaaggctgcacagctgatgattacaaacctgaaggctcatgagaacataacaacctcccatccgttggaggatgttctgaagaatggcatccgaaatgaagctaaattaattggctacaatgaagatcctatagatgttgtggatcttgttgggctggacgttgaaaacctaaatatcctagaaacttttggcgggaatagtgaaagaagcagctcatacgtcatcagacgaggtctcccccaagcaccatctaaaacagaagacaggcttcctcaaaaggccatcataaaagcaggtggaccaagcagcaaaaccgcaaaatccctcttgcacgaaacatgtgttgctaactgttggaagccaccacacttcgaatgttgtgaagaggaaggaccaggccacctgaaatcattcgtctacaaggtaatcctggaagttgaagatgcgcccaatatgacattggaatgttatggtgaggctagagcaacgaagaaaggtgcagcagagcacgctgcccaagctgctatatggtgcctcaagcattctggattcctttgctga

SEQ ID NO: 32 - DNA, 5648 bp, Arabidopsis thaliana
caaaagatgtattttaaaatctctaaactcaataactccacaaaaattttcagaatcaatgattgtagaaacacatgatttctggttcagaatttcacacactccacccaaaaaaatacccttaaaaagttataattgtattgattagctgataaaatcaatttattggaaagaaatcctaataataacgctgtaatagaagagaagagaagagagagggagacgtgagatcgtgaattatgcgtgacgaagttgacttgagcttgaccattccctcgaagcttttggggaagcgagacagagaacaaaaaaattgtgaagaagaaaaaaacaaaaacaaaaaagctaaaaagcagcaaaaggacccaattcttcttcacactagtgctgccactcacaagtttcttcctcctcctttgaccatgccgtacagtgaaatcggcgacgatcttcgctcactcgactttgaccacgccgatgtttcttccgaccttcacctcacttcttcttcctctgtttcttcgttttcctcttcttcgtcttctttgttctccgcggctggtacggatgatccttcaccgaaaatggagaaagaccctagaaaaatcgccaggaggtatcaggtggagctgtgtaagaaagcaacggaggagaacgttattgtatatttgggtacaggttgtgggaagactcacattgcagtgatgcttatatatgagcttggtcatttggttcttagtcccaagaaaagtgtttgtatttttcttgctcccaccgtggctttggtcgaacagcaagccaaggtcatagcggactctgtcaacttcaaagttgcaatacattgtggaggcaagaggattgtgaagagccactcggagtgggagagagagattgcagcgaatgagcactgtttcatcaagatggagtgtatctcccttctaatatttgatgagtgtcaccatgctcaacaacaaagcaaccatccttatgcagaaatcatgaaggttttctataaatcggaaagtttacaacggcctcgaatatttggaatgactgcatctccagttgttggcaaagggtcttttcaatcagagaatttatcgaaaagcattaatagccttgaaaatttgctcaatgccaaggtttattcagtggaaagcaatgtccagctggatggttttgtttcatctcctttagtcaaagtatattattatcggtcagctttaagtgatgcatctcaatcgaccatcagatatgaaaacatgctggaggacatcaaacagcggtgcttggcatcacttaagctgctgattgatactcatcaaacacaaaccctcctaagtatgaaaaggcttctcaaaagatctcatgataatctcatatatactctgctgaatcttggcctctggggagcaatacaggctgctaaaatccaattgaatagtgaccataatgtacaagacgagcctgtgggaaagaatcctaagtcaaagatatgtgatacatatctttctatggctgctgaggccctctcttctggtgttgctaaagatgagaatgcatctgacctcctcagcttagcggcgttgaaggaaccattattctctagaaagctagttcaattgattaagatcctttcggtattcaggctagagccacacatgaaatgtataatatttgtcaatcggattgtgactgcaagaacattgtcatgcatactaaataacttggaactgctacggtcttggaagtctgatttccttgttggacttagttctggactgaagagcatgtcaagaaggagtatggaaacaatacttaaacggttccaatctaaagagctcaatttactggttgccactaaagttggtgaagaaggccttgatattcagacatgctgtcttgtgatccgttatgatttaccagagactgttaccagcttcatacagtccagaggtcgtgctcgaatgcctcagtctgaatatgcgtttctagtggacagcggaaacgagaaagagatggatcttattgaaaattttaaagtaaatgaagatcgaatgaatctagaaattacttacagaagctcagaggaaacttgtcctagacttgatgaggagttatacaaagttcatgagacaggagcttgtatcagtggtggaagcagcatctcccttctctataaatattgttctaggcttccacatgatgaattttttcagcccaagccagagtttcaattcaagcctgttgacgaatttggtggaactatctgtcgcataactttacctgctaatgctcctataagtgaaatcgaaagttcactactaccttcgacagaagctgctaaaaaggatgcttgtctaaaggctgtgcatgagttgcacaacttgggtgtacttaacgattttctgttgccagattccaaggatgaaattgaggacgaattgtcagatgatgaatttgattttgataacatcaaaggtgaaggctgttcacgaggtgacctgtatgagatgcgtgtaccagtcttgtttaaacaaaagtgggatccatctacaagttgtgtcaatcttcattcttactatataatgtttgtgcctcatcccgctgataggatctacaaaaagtttggtttcttcatgaagtcacctcttcccgttgaggctgagactatggatatcgatcttcaccttgctcatcaaagatctgtaagtgtaaagatttttccatcaggggtcacagaattcgacaacgatgagataagactagctgagcttttccaggagattgccctgaaggttctttttgaacggggggagctgatcccggactttgttcccttggaactgcaagactcttctagaacaagcaaatccaccttctaccttcttcttccactctgtctgcatgatggagaaagtgttatatctgtagattgggtgactatcagaaactgcttgtcatcaccaatctttaagactccatctgttttagtggaagatatatttcctccttcgggctctcatttaaagctagcaaatggctgctggaatattgatgatgtgaagaacagcttggtttttacaacctacagtaaacaattttactttgttgctgatatctgccatggaagaaatggtttcagtcctgttaaggaatctagcaccaaaagccatgtggagagcatatataagttgtatggcgtggaactcaagcatcctgcacagccactcttgcgtgtgaaaccactttgtcatgttcggaacttgcttcacaaccgaatgcagacgaatttggaaccacaagaacttgacgaatacttcatagagattcctcccgaactttctcacttaaagataaaaggattatctaaagacatcggaagctcgttatccttgttaccatcaatcatgcatcgtatggagaatttactcgtggctattgaactgaaacatgtgctgtctgcttcgatccctgagatagctgaagtttctggtcacagggtactcgaggcgctcacaacagagaaatgtcatgagcgcctttctcttgaaaggcttgaggtgcttggtgatgcattcctcaagtttgctgttagccgacacctttttctacaccatgatagtcttgatgaaggagagttgactcggagacgctctaacgttgttaacaattccaacttgtgcaggcttgcaataaaaaaaaatctgcaggtctacatccgtgatcaagcattggatcctactcagttctttgcatttggccatccatgcagagtaacctgtgacgaggtagccagtaaagaggttcattccttgaatagggatcttgggatcttggagtcaaatactggtgaaatcagatgtagcaaaggccatcattggttgtacaagaaaacaattgctgatgtggttgaggctcttgtgggagctttcttagttgacagtggcttcaaaggtgctgtgaaatttctgaagtggattggtgtaaatgttgattttgaatccttgcaagtacaagatgcttgtattgcaagcaggcgctacttgcccctcactactcgcaataatttggagacccttgaaaaccagcttgactataagttcctccacaaaggtctacttgtacaagcctttatccatccatcttacaacaggcatggaggaggctgctaccagagattggagtttcttggggatgctgttctggactacttgatgacatcctattttttcacagtcttcccgaaactgaaacctggtcaactgaccgatctaagatctctctcagtaaataatgaggcgctagcaaatgttgctgtcagtttttcgctaaagagatttctattttgcgagtccatttatcttcatgaagttatagaggattataccaatttcctggcatcttccccattggcaagtggacaatctgaaggtccaagatgcccaaaggttcttggtgacttggtagaatcctgtttgggggctcttttcctcgattgtgggttcaacttgaatcatgtctggactatgatgctatcatttctagatccggtcaaaaacttgtctaaccttcagattagtcctataaaagaactgattgaactttgccagtcttacaagtgggatcgggaaatatcagcgacgaaaaaggatggtgcttttactgttgaactaaaagtgaccaagaatggttgttgccttacagtttctgcaactggtcggaacaaaagagagggcacaaaaaaggctgcacagctgatgattacaaacctgaaggctcatgagaacataacaacctcccatccgttggaggatgttctgaagaatggcatccgaaatgaagctaaattaattggctacaatgaagatcctatagatgttgtggatcttgttgggctggacgttgaaaacctaaatatcctagaaacttttggcgggaatagtgaaagaagcagctcatacgtcatcagacgaggtctcccccaagcaccatctaaaacagaagacaggcttcctcaaaaggccatcataaaagcaggtggaccaagcagcaaaaccgcaaaatccctcttgcacgaaacatgtgttgctaactgttggaagccaccacacttcgaatgttgtgaagaggaaggaccaggccacctgaaatcattcgtctacaaggtaatcctggaagttgaagatgcgcccaatatgacattggaatgttatggtgaggctagagcaacgaagaaaggtgcagcagagcacgctgcccaagctgctatatggtgcctcaagcattctggattcctttgctgatgatctcgagcggctatatatcggttagaaatagatgttatcataggcatatataacttttaccagagctacatattagcatatatgatcgacacctacaatttctcgaaagagaaaaaaggatgtctgaaaactaaccttaaaccatagattttggagcggagagctttcggcaaaagttctcttcgattgctcttctgaatttctgaatataagtatatgtttacttgtacttgatgaacccatagcatgataggctccaaaaatatagtttactcatctctcatgcatcaaatatgttcctgtgtgatcttaattaaacaatatatgaactaagcgtta

SEQ ID NO: 33 - DNA, 3324 bp, Arabidopsis thaliana
atggggaagacaattcaagtgtttggattccctaatggtgtgagcgcagaagaagttaagaagtttcttgaaagactcactggttcaggcactgtttacgcaatcaaagttagacaaccaaagaaaggtggtccaagagtctatgccattgttcaattcacatctgagagacatacgaggctgatcatcactgcggcagcagaacgtctttactatggaagatcttatctcaaggcttttgaagttgaacaagacattgttccaaagccaagagcttcattacacaccatctctggtttaaagatgttctttggatgtcaagtctcgactaagaagtttttaactctatggagtgctcaagatgtttgtgtctcgtttggaattgggatgaggaaactgcatttttcgttttcttggtatcaaaaggattatcgtcttgagctttcgtatgagaatatatggcagattgatttgcattctccgcaaggacgatcatcgaagtttcttgtgattcaggtgattggtgctcctaaaatatttgagaaagaggatcaacctatcaatcttttgtttggaataatggatttttacagtgatgggtctgatgagcaatggattagaactacagatttcacttcatcttcttgtattggtcaatcaacagcgttttgtttagagcttcctgttcatcttaatgttcctgatttcagagagaattttgccaactatgcagagcacagagccagctcttttctcattgaatctggttctagctattcatctaatgctaacacacttgttcctgttgttgatcctcctccagggtttagtttgccttttgagatcttgtttaaacttaacacattggtgcagaacgcgtgtctctccgggccagctcttgatcttgacttttatcggttgcttaatcagaaaaaatatgatagagctctcatagatcactgtcttgaaaaactctttcaccttggagaatgttgctatgagcctgctcattggcttcgcgatgagtacaagaagtggatatcgaaaggaaagcttccactgtctcctacaatatctcttgatgatggacttgtttatatgtatcgcgttcaagttacaccagcaagagtctatttctctggaccggaggtgaatgtttctaatcgtgtgcttcgacattactccaagtatatcaacaacttcctcagggtctcatttgttgatgaagatcttgaaaaggttcgttccatggatctatctccacgctcttctactcaaagaagaaccaagttatacgacaggatatattctgttcttcgcgatgggattgtcataggcgataagaagtttgagtttctcgccttttcttccagccagttgcgggagaactctgcttggatgtttgcaccaatagatcggattacagcagcacatatcagagcttggatgggtgattttgaccatataagaaatgtagctaaatatgctgcaaggcttggtcaatcttttagctcttcaagagagacacttaatgttaggagtgatgagattgaagtgattcctgatgttgagattatatctttagggacacgctatgtgttttccgatggaataggaaagatatcagctgaatttgctagaaaggtagcgaggaaatgtggtcttacagagttttctccatctgcttttcaaatccgttatggcggttataaaggagtggtggctgttgatccaaactcatcaaagaaactgtctctgaggaagagtatgagcaaattcgaatcggagaacaccaagcttgatgttctggcgtggagcaagtaccaaccttgttatatgaacagacaactgattacacttttgtctactcttggagttacggacagtgtgtttgagaagaaacaaagggaagttgtggatcgtctcgacgcaatcttgactcatcctttggaagctcacgaggctcttggtttaatggctccaggggaaaacacaaatattctcaaggcattgatcttgtgtggctataaacctgacgctgaacctttcctttcaatgatgcttcagaatttcagggcatctaagttgttggaactacggacaaaaacaaggattttcatttctggtggaagatctatgatgggatgcctagacgagaccagaacactggagtatggtcaggtagtagtgcagtattcagatcccatgaggccgggaaggcgattcatcatcaccggacctgttgttgttgccaaaaacccatgcctgcatcctggtgacgtgcgtgttcttcaagctgtcaatgtcccagctttaaatcatatggtggactgcgttgtgttcccgcaaaagggcttgaggccacacccaaatgaatgttctgggagtgatttagatggagatatttactttgtatgttgggatcaagaattggttccgccaagaacgtctgaaccaatggactacactcctgaaccaactcaaatcttggatcatgatgtcacaattgaggaagttgaagagtactttgcgaactacattgtgaatgatagtttagggatcatcgcgaatgctcataccgcctttgcggataaggaaccactcaaggcgtttagtgacccatgcattgagcttgcaaagaagttttcaactgcggtagatttcccaaaaactggtgttgcagctgtgataccgcaacatctttacgtgaaagagtatcctgatttcatggagaaaccggataagccaacatatgagtcgaagaacgtgattggtaagctttttagagaggtaaaagagcgagctccaccgttgatctcgatcaaatcattcacgcttgatgtggcctcaaagtcttatgataaagacatggaagttgacggatttgaggagtatgttgatgaagctttctaccagaaggcgaattatgatttcaagttaggtaatttgatggattactatgggattaagactgaggctgagattcttagtggtggtataatgaggatgtcaaagtcattcaccaagagacgagatgcagaatcgattggaagagcggttcgggcgttgaggaaagaaactttgtcgttgttcaatgcttctgaagaagaagaaaatgagtcagcaaaggcttcggcttggtatcatgtaacgtaccactcaagttactggggactttataatgagggtttgaatcgtgaccatttcttaagttttgcgtggtgcgtttatgataagcttgtgaggatcaagaagaccaatcttgggaggcgtcagcggcaggagacgctcgagcggttagaccatgttctgcgtttcggttga

SEQ ID NO: 34 - DNA, 7324 bp, Arabidopsis thaliana
tgccataagacggtatgagaatctacggtctcactaataccctaacatgcatagaataaaagaagggataaatgaaagcaattaaactatatatagtagataattgaaaactaaactaacaaaattaagaactaaaatgagcaaataaacaagatagataaattgaacaatcaagatgttagaaatcatgcaatcgatctacatattttcaagataatgaacctctaacaattaggctaattcatgattagtgtggtaaaagcctctaacgtaacttagccaaattcaaaatcaatttggtaaactatcacaatggttaagaaacaatgcacacaaattcctttaagttacaaagcatccgatcctaaatatcacttgctagatggttaggccagaaatcgttttctttcaattttctttgggtctgaacgtagacacaactcaaacacctctcttgatcttgtatgctttaaaatgtggtctcttcaagtcgggtatcttgtttgttttggttccgagtgcatctgtctttagccacctagctagctagaaggtaattgtagatatccattttcaccaactagctagtttttgtcctccagctggcttggctaactacgtacgttccaaatgtcaaacacttaaaaactatatgtcaacactaactaactaaatttattatatcctatatctcaagtgtacacaatgtataatattaataacataattcaagcacctcctgatcttatatacttcaaaaatgtgatgtctctctaagtggagtatcattttaattttggttccaattgcatctgtaattaaccatatatagctaacttgccgatgtgtgtaatataactaaactatagagaatatttgtagataccctcattctccagctggctagctatgtaagttccaaatgtcacacacttgactatttgtctttctccacttataaccttaatcacagatcaagaatcatctccaattatagttttctttattgaatccacctaatctctattcaccaatttataatttttataattgcggcttagatacctttttagtcaataatcaaaaatggattccagtgaggatcaaccataaacgagatcattgaagcacataaactaattgacaataagttacatagtttaggagacataaaactgtttaaattttatattgtgcttaataataatttataattattgtaacacagttgttaaatccatagttatgtagcatgtacgtgtcaattaatgcgcacattcaatattagaacacagaaggtttgtctaccaccactaccaattgaaattaaaaaatttaaaataatctagcgggacacaaagcgaagtcaataacataagtcaaccattttaacggtcaagattgtaagagtagctctactatgatggagccgtgacgtagaggaacataactgaaagcgaagaatcctcgatttatgctactgtcactgaaccattttcctctcaggtcggagctaaattttgagagtaaaataaaaaagcaaaagagagaaattgaaaaaaaaagaaagaaaaataatcctctcttgtttcggctagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagatggattcaacaaatggtaacggagctgatcttgaatcagcaaatggggcaaacgggagtggggttactgaggcattaccacctcctccaccagttatacctccaaatgtggaaccagttcgtgttaaaactgaacttgctgagaagaaggggccagttcgagttcctatggctcgaaaaggatttggaacaaggggccaaaagatccccttgttaacaaatcatttcaaagtcgatgtggctaatcttcagggtcatttcttccactacagtgtaagtttttgaaactattttgtgttatttttgttggatgattgatgtcactagaatggatgcagtgtgtatgtttttttgctactgttatgttgacttattctgttatttggttctgaatgatgtcaaactaatgggattatttgtgggtttgtacaggtggctctattctatgatgatggtcgtcctgttgaacaaaagggtgttggaagaaaaatccttgacaaggtgcatcagacttaccattctgatctggatggtaaagagtttgcttatgacggtgagaagacgttgtttacatatggagctttgcctagtaacaagatggatttttctgtggtgcttgaggaagtatctgctacaaggtaaaacatcatctgactatagtcattacattggttgtgtgctttagtttttgttcttagtaaggattttgtgagcagggctaatggaaacggaagccccaatgggaatgaaagtccaagtgatggtgataggaaaagactgcgtaggcctaaccggtccaaaaactttagagtggagatcagctatgcggccaaaattcctcttcaagctcttgctaatgcaatgcggggacaagaatcagagaattcccaggaggcaatacgggttcttgatatcatattgaggcaacatgctgctagacagtaagtgtcaagtgtatatatgtattttgttaatctcatatatttgtctttctaatacctatggtacaaattgcagaggttgcttgcttgttcgacagtcttttttccacaatgatccaaccaactgtgaaccagttggtggtaacatcttaggatgtaggggatttcactccagtttcagaacaacgcagggtggcatgtcacttaatatgggtacataatttcacttgtacttgatgttggtgtttgattctgtctgttgtagcaataatttagtgtctaatagtttatgttttgttcttatgctagatgttacaaccaccatgatcatcaagcctggtccagtggttgatttcctaattgctaaccaaaatgctagggacccttattcgattgactggtctaaggttaactacttattatgatatgtggctttttcataatctaaacatgttccttacctcttttgcttggcttgacacattttaacatgttgttttcaacaggctaaacgaacccttaagaacctaagggtaaaggtcagcccctcaggccaagaattcaagataaccggattgagtgacaagccttgcagggaacaaacgtaagatattcactaatttgactttgttgtgagatgcatttgtttctgttttagttttctgacgttgtgatctctttcaaagataaatggttctctgaagtttgctttttacactgtctaggtttgaattgaagaaaaggaacccaaatgaaaatggagagttcgaaactactgaagttacagttgctgactacttccgcgatacaaggcatattgatttgcaatattctgcggatttgccttgcatcaatgttgggaagccaaagcgacccacttacattcctctcgaggtttgcctcttatactcatcaacgttctcatagtcatggtattaatttgttttcaaaaatcatgctaatgtatgtaatgtggtggaattttcgcagctctgcgcgttggttccacttcagaggtacacaaaagcacttaccacgttccaaagatctgcccttgttgagaaatccagacagaaaccccaagagaggatgactgttctgtccaaagtaaagtatcctgaccgcttcataactgttctgttttgtcagtgaactggaatttacatatctttggtttcatgctttcaggctctgaaagttagcaactatgatgcggaaccactcctgcgatcctgtggcatttcgatcagctccaactttactcaggtggagggtcgtgttctaccagctcccaaggtatggtgcgatcgcttactttttgacatgatgaattgtttttagcttttgcatacatgtaatattctcttgttttctttgactgacagctgaaaatgggatgtggatctgaaacctttcccagaaatggtcgctggaacttcaacaacaaggtgctgtttctctctgcctttctttgtattttacctgttcagagagtctgattccctttgttgtacaggaatttgttgagcccaccaaaattcaacgatgggttgttgtcaatttctctgctcgctgtaatgtacgtcaagttgttgatgatctgataaaaattggaggatcaaaaggaattgtaagcaggattctcttcttttgtttttagtattcttgaaaacttgtttgtgattatcaacaatttagatactgcttctttctgtattctgtcccaggaaattgcttctccctttcaagtgtttgaggagggtaatcaattccgccgtgctcctcctatgattcgtgttgagaacatgtttaaggacatccaatcgaaactccctggtgtcccacaattcatactatgtgtgctccctgacaaaaagaacagtgatctctatggttagatatctcttaaatccagtcttcaatcatctttttgttttatataatagaagtttccttggataaatactttgaatccttcatcaggtccatggaagaaaaaaaacttaactgaatttggcattgttactcaatgcatggctccaacgcggcaacctaatgatcagtatcttactaacttacttctgaagattaatgcaaaggtgatctctctccttttttctcttttggaaatggtttttgcttcttgtgtgcaatctctgataacatataactacagcttggaggcctgaactcaatgttaagtgtagagcgtacacctgcgttcactgtgatttctaaggttccaaccattatccttgggatggatgtttcacatggatctcctggacagtctgatgtcccgtccatcgctgctgtaaaatgtttactcactgctgttgtttgctttttagtttggctagttcttcaagactgatatttagttgtctcttttgttatgattaacttaggtggtgagttctagggagtggccactgatatccaaatatagagcatctgttcggacacagccttctaaggctgagatgattgagtcccttgtcaagaaaaatggaactgaagacgatggcattatcaagtgtgcacttacactaactcttgatgtggcttttgtttaatctttgcatgaagtctggtttaagtatctatgtaactttatttgttgattgcagggagttgctggtagatttctacaccagctcgaataagagaaaaccagagcatatcataattttcaggtatgttacatcagagcttttgtctcttcatttttcccatctttattttctcatattggttgtttcgatgtttaatgcttctagggatggtgtgagtgaatctcaattcaatcaggttctgaatattgaacttgatcagatcatcgaggtagttgaaacttcaaaataaaagtttctcagtgtaattttcttcttctgttagtacttaattgcatttctctttcctcaggcttgcaagctcttagacgcaaattggaacccaaagttccttttgttggtggctcaaaagaatcatcataccaagttcttccagccaacgtctcctgaaaatgttcctccaggtgattgacaaatctatattataaccttttttgacacatagctgatctctatctcatgggggttttggttattttgcagggacaatcattgacaacaaaatatgtcacccaaagaacaatgatttctacctctgtgctcacgctggaatgattgtaagtttcatctatcaactcaaaactttatttgttaatgtttgctcctctgaatcgttttaatactctttatgttctgaattagggaactacccgcccaactcactaccacgtcctgtatgatgagattggtttttcagctgacgaacttcaggaacttgtccactcgctctcctatgtgtatgtagtctcttattcaaccttcattacattttttgtgacaacttcgattgtgatgataacagaaattatctgatttctttctttggcaaaattccaggtaccaaagaagcaccagtgccatttctgttggtaattaccataactgttttctctactccatcgatttaaagtcgtcttcatttgttctcttaataactgacattttaattttttgtgcagttgcgccgatctgctatgctcacttggcagctgctcagcttgggacgttcatgaagtttgaagatcagtctgagacatcatcaagccatggtggtatcacagctccaggaccaatctctgttgcacagctcccaagactcaaagacaacgtcgccaactccatgttcttctgttaaatgagcagccctacttggctcagtaagtaagtagtagttcaataggctatctgactttcagcttaggatctctctcggccttgaagccaggcatcgacactaaggcttggaatgttttttgtgactattatcgccagccttgtttgcctgttggggtttgaatatgcttttgtcccccttaacaattcggttgtttaattaaagacttattgtagtgaatatctaagttcaggaagttacccttttgtctaaatcgttctt

SEQ ID NO: 35 - DNA, 7324 bp, Arabidopsis thaliana; identical to SEQ ID NO: 34

SEQ ID NO: 36 - DNA, 7586 bp, Arabidopsis thaliana
aatagaaaaggatacaagatgacaaaaacatccactgcacatctcagaaactcgccctcgttatttcatgctacacaactgcagcatttactattttgtttttatacgtttggtatttgcaggacacagagacattacgtacaaccagttttcttttatcttttgtggtaaatagttttgtaatcttttcactttttcaataactaatttcaaaattcaaaccagtgatcaaatttgaggtgatgacaaaaaaaaaattagtcaaacggtcaaactgagatatttatatctatcaattgtgaaaatgtgattagttcttttaacctatagtatactttagttcttttcaaagttgttgatatttgaagacgttaaacttgcgatttttcttcattttcacttccatgtatataggattgtcactgcatgcctaataataatatatgtgtgaaaccattttgccacaatcacaattgtttattggaacacttgtaatacatatatgttgcaaaaaaaggatatatacatttgctcttaatacaaagataggtacgtaattaagtagtatatcatgttactaatttgttcatatagctctttttgtgtatttgaatatatggatctgattcaagaattaataatcattgcatatcatagttcgtttattgtaacatatagcatgtgttatacagttttatagacttgggtcatgtagccacatcgatgcatcatggcttaaagatattcataaatgaaactaacactttcaagttttaactgatatcatccacaatggttctggtactcatttaagagagttattacctccaaatctatattataccatagagtaattccgctaatgtttttgtaaaactgttagaattcgaacaaaaaattatctggaagaggagaaagatataccagtcatttaatactataataaagaacaacatctttagcaccaaaattgataaagaacgacataaataggaatggtgaagaaaaagatgatcccaaaggtagaaaacagtaagtggagaagaagagcttttttgttactagtatattcaacaactcattcactgttgcaagattctaatttatagatgtgttaacttgaaccagatcataacaaataagatgaataaccggtttaagtacctgaatatttgcactagtaatccaccaaacaatgaaattccatatactatttacttgtaaacgatttgattctatatatactcttaagattccatataacatcgaatcacctaacattattttgtccaaatccaaattgtttctaaattctctaacaataataaaaaaaacgtaacgagagaagtaaattgataagacattgaaacgaaaagaaaggaatatggagcgaaaaaataattaagaaaagaaagaaaacagtgggacctacctataaaacctcttgcgtcttgcgtctgcggctttctttataagcgacacacctatattttagtgaatcaccaaaacaaacaaaccctttcttcttcctctcataatccctctctctcttcttctctctcgctcgctgctctgtttagggtttttctcgttcgtctcttctataagtactaggtttgttttttactcaaaaatcgttcaatgtatgttcgattttgaagctttcatgcatgattcctgttcatttcgtcgattttggtggtttttttctcttttttttagcgatttctgcgctgttagtgttcatctgtatttttcgtcgtcgtcgtttggtgttaaacaagtgatttttgttgtttcatgagtttctctggattttttggtcatggtagtgtttgtttatgttgaatctcactgttttttttctctttgaagctgcgttcgttgttacatgattttcgtcttcttcttcctctgagtaatcgctgtttatttttctactctggattttttgtttttttggtcttctctttgacctctgttaagaaatctggaaaaataaatgttggcgtgtgttttttactaaaaaatttgtttgcattttcccgagaaaaatcttctgggtttcttttgctgctttgtgttctttgtctctaccttcatttttttattcgctttatccaacagatctctctctctctctctccctctcgctttttaggtgaccattttttttttgtcatatatgatcatgtcacgtacatctcttcttcaccattttttttttctgtcatagatcttccttatgcggctttgaagcatgacgcgaatgattttgtttgcttttgagtaatctgagtctagtttgtgatggtgacgaatctgttctttagatctgtagatttcatctctagtacttgttcaagtgtgggttgatcagtgtttttgcgtgaatgcttttgtttatgccatctttctgtttgttcctgaatcatgttttatatgctgtgatttaatggttttaagtaactgtgtgaagatcgctttgcttttatcaagatgacacctgactccatgagtttttctatgtgacgtttgctttgtcctgtgatttaatagttctcagctctactggcttagattttcgggtcagaattattttcatactaaaaatttgtgataaatctggcttcaacaatggtttctttgtagcgtttatgctttcccattgctttaaacagattatattttggtgctgttcttttctgaccttctgatatttgtatcccagagatggattctgatgaaccgaatgggagtggattaccacctccaccacctttcgttccagcaaatcttgtccctgaagtggagcctgtaaaaaagaacattcttctcccaatggctcggcctcgaggcagcggctccaaaggacagaagattcctcttcttactaatcactttggagtcaagttcaacaaaccaagcggttacttctttcattacagtgtatgtatactgtgacctctaataatcctctatttgtatcagtgcgtttcctgttttatctctatgatacatgatggatttgtttctttaaaatttgctacaggttgctatcaattatgaagatggccgtccagtggaggctaaaggtatcggccgaaagattcttgacaaagttcaggagacctatcaaagtgatttgggtgccaaatactttgcttatgatggcgagaagactctcttcactgttggtgctcttcccagcaacaaacttgacttctctgttgttcttgaagaaataccttctagcaggtgtgattatgacttcttttgatttttttttccctgtgaaatttctcgactgtttccttttcttcaaagtctaatatgctttgatatcctctttatctgcagaaatcacgctggaaatgatacaaatgatgctgatagaaaaagatcaaggcgtcccaaccaaactaagaaattcatggttgagataagttatgctgcaaagatccccatgcaggctattgcaagcgctcttcaagggaaggagacagagaatcttcaagacgctctgagagtgctggatattattttgcgccagagtgcagctaggcagtaagttaaatattctgggtatttgtatttcaaataaattctctgcttgatctttaatgtcatgttctcatatctgttcgcagaggttgcctccttgttcgccagtcctttttccacaatgacgtaaagaactttgtacctattggtggaggtgtcagtggttgcagagggttccattcaagtttcagaactactcagggaggcttatccctgaatattggtaattcttttccagatctaatgtgtattagattcttccttgacattcggctgctaaactttgatttttttgctttggcatttcttcagacacttcaactacgatgatagtacaacctggacctgtagttgatttcctgcttgctaaccagaacaagaaagatccatacggaatggactggaacaaggtacatcattttcttttatgttgtactatttcactgatgtattttatctgattttatctcatcaggctcgacgtgtcctcaagaatctgagagttcaaattactctttccaatagagaatacaagataagtggactaagtgaacacagctgcaaagatcaactgtatgtcaaatttctttgatcacaagtttatatgcttttgagtttattctaagatattggtctttgattgatagatttacatggaggaaacctaacgacaagggagaatttgaggaggttgagatcacagtgctcaattactataaagagcgtaacattgaagtgcgttattcaggtgacttcccttgcatcaatgttggtaagccgaagcgtcccacttacttccccattgaggtaaataaaatgaattgttgtttttctgttttccacatatttttttgtaacggattatgacaatcgttttggttttcatgtttgcagttctgtaatcttgtgtctctacagcgatacacaaaatcgcttaccaattttcagagggctgccctagttgaaaagtctaggcagaagccacctgaaaggatggcctcgctaaccaaagtagttcttgtttccatagttcttcttcccattatccttgacgctttttctgtttcttatgttttatgttctgatttatcttgcagggtctgaaggacagcaattacaatgccgacccggtattgcaagatagtggtgttagcattatcaccaattttacccaagttgaaggccgtatcttaccaacaccaatggtgactttcgttgattctcttgctttccttgctgtattttttcctttttgcttgtggatgttttattgttgattatctttgtccttgtttacagctgaaagtgggcaagggagaaaacctttccccaatcaaaggaaaatggaactttatgcgtaaggtgcttagattttctatcttttgccctagtttgaatattgtaacctcgactagtactgattgaattctaatgcagacactcgctgagccaacgacggttactagatgggctgttgtgaacttctctgctcgctgtgatacaaatacacttattcgtgacttgattaaatgtggacgggagaaaggaattgtaagccttctttaggttcattggttactatacaaacgaatcatatgcacaactccttttaattcgtcccttttgtttttcccttttatcccagaatgtagagcctccattcaaggatgtcatcaacgagaatcctcagtttaggaatgcaccagctactgtgagagtagagaatatgtttgagcagataaaatccaaactcccaaagccgcctctgttccttctttgcatactcgctgaaaggaaaaactctgatgtttatggtacatcacatcacactttacattcttgaatatggcctgttttcccccttgaatgtaaatgtttaacttttcatgtgtctgaaattttttaggcccttggaaaaaaaagaatcttgttgatcttggaattgtgactcagtgcattgctcccaccagactgaacgatcagtatctcaccaatgttctcctgaagataaatgccaaggtagctggaggttgtaaattcattcaattcgaatttcaagactgattgtaaagactttacaagcttacaagcttacagctgaaatgatttataattcgtatatgtagcttggtggattgaattcgttgttagctatggagcgctcaccagcaatgccaaaagtaacgcaagttcctaccatcattgttgggatggatgtatcccatggttcccctggccagtctgatataccatcaattgctgctgtaatactgattttgttttgttaatttttcgtgtgatctcatttagtgttgtgtgttcattcttggcaacaactctggtaacttggtgtttgttggaaatcgtaggttgtgagctcaagacaatggccactcatctcaaaatataaggcatgtgtacgcacacaatcacgcaaaatggaaatgattgataatctcttcaaacccgtcaatggcaaagacgaaggaatgttcaggtaaaattcataggcagcgtttttgtcatcttaattctattttagggccttgtgaatggtacaatattcttttatacttgtacaaaaaggtatgtcagcatcagtgtaattagagatttcctactgtttacagggaactcttgttagacttttactacagttcagagaataggaaaccagagcacatcattattttcaggtatacttaaatctattaaggtatcatgtaaaataatatactccaatttgttaactcactgttactaatatacatgtagggatggtgtaagcgagtctcagttcaatcaagttcttaatattgaattggatcagatgatgcaggtatggattatagttctagagcttcagagcttttagtgacacaaagacgttttatttagtatatcttggatatctttgggcctgcctgatctctttttttgttactttattaggcatgcaagtttcttgatgatacgtggcatccgaagtttacagtgatagttgcccagaagaaccaccacacaaagttcttccagtctcgaggccctgataatgttcctccaggtaaaatccatttgacaaatgcatgattttctgttggtcattattttgtgtttaaaatgacctgaaacctggcttttgcctgcaggaacaatcattgacagccagatctgtcacccacgcaactttgatttctatctctgcgcccatgctggcatgattgtaagttatagctcctgcagaaatactttgaccacttagttactatataaatccaacttaacagttttctatattgattttggatgtgttagggaactacaaggccaacacattaccatgttctgtatgacgagattgggtttgccacagacgacctccaagaacttgtgcattctctgtcctatgtgtaagaattatatcacttttaactcttaatctgataggtatctttgtggaattatatcacttttgacaataatcttcaaattgtttgctttgattcttgtagctaccagaggagcaccactgcgatctcagtcggttagtctcacatcttttatgcgttgctgctgatagctacaacattatgtgcaatatctcaattctcaagtttctttatgtttgtttgcagttgcacctgtatgttacgctcatttggcagctgcacagatgggaactgtgatgaagtatgaagagttgtctgagacttcttcgagccatggaggaatcaccacacctggagcagtccctgtgccacctatgccgcagctgcacaataatgtttcaacctccatgttcttctgttgatggaacatggtccagtccacacgatagctgagtttatatgcttttgatggagaaccaacgaacttttgtttactcttctctgggtttggttcctcttttgtttttcgtcgaccctttaacattgaggagatactctttatattctgtcggtttttgtgggcgctgttggttgatactttattatgcttaatcagatttggtattttaaggc

SEQ ID NO: 37 - DNA, 6980 bp, Arabidopsis thaliana
agtatctgcatgttcctctcagcttcttcctgttccatttttctcttcctttccgcaagaagtgtcagaagattatcaacctccttaattgacacatcacaaccctgtctaagtatgaacgcaggaagtcaatatttgatcaaaagaaatgacttagaattgctttttactccaataataattctgagaaagcaaacttaaagaggaaaaaatgaaacataaaaagcttgttaagaaccgaccctttgtagtgcttcccgaaactgatccaagggcgatgcagtttttgacacatgccgagctgaagttttcttcaatagctacacaattgatacataaacgtcatataataagctgcattccagtgataaatagtttcaatacactatcattcctataaacatgcttctatttagctgtaataagcagaatcctaccacaatactacacatcaaaaacaaaacaaaaccttcctaagaaaatctaatggcaaggttcattggaatcgattaaagactaagctagcttacttgtttccacaaaaaccacgacaaaaaccaaacttgattacaagctaagactcaaacaagcaacacccgaacttgaactgaaaagctaaggaccaaacacaaattacgagtaaaattagaaaaagaaaccttatcgagcaagaaattagggtaaagctgattattggtgaggtgttggctacaacagggacaatcactcttgttcctaagatgtgtgatgatacacatatagcagaaactatgaccacaagccgtgaggaaagcatctttaataatctgcatacaaatcggacaaagcaagtctttatccagatccggtgctccaatctcagaaccgccgcttcctccgtcgtcattttcatgacgattagcaccttcaccaactgaagatgttctcgggtcaggtttcaccgctggaacaaccggatccgtcgaaatctcttccattttgctttcaaaagatttcttcgattgtgattttggtttttgagaaaatcggaattgtgagaaaagagtggtttgggtatgacgtcggagatgaaggaggagtgaggctgaggtgtggtgggatccaccgtggttcttttctgaggtgacaaatcctacacgttctggtctacgcgcttcttttcgcgcgtgtgtctggcgtttctccaagcgctggtacggtttaattatccggcttctaatttatagtccggttcaatgaaatttcttacaattaccacgacggtctaatttaatttcttacaaccattcattttatttcttactatttgaaatgaataagttgggaatttcaatccattcaaccggagcataaccctagaaatagaataagttttgaaggattcggtttaataattttggaataaaccatttttatttcagttcttaaattttgttactgtaaaaaatgactgaaaagtgaaatatattttaattttcccatcactggaaacgttccctccattcttttgcttgtctgggaaacccaaagagactgtgacggagaagagaaatgagctaaataaattcctctctttgattcaccggaaccctagaaatcctcttcttaattctttcaaaggtgcgctgttttcactagatatcgctgttgtaattgttgttgattcggagctaggttttgtttttgtctctctttcggagaatttgcatgaagctaggatttgtctgttgatagttgtatggttttggctgcgttgtttctctcttgaaagtcttgttatgctactgtatgacacactcgaatgagtttttgtttgtgtaatgtttctcaattttgaaggcgaccaacagttaaaggtgccattttttttccagattaagtttgttcctcatctgaaatttataccatttctcgcgatttagcaggatatgcccagaaattaaaatcttagaacgacaatggtggtaaagtttttagctttttaccttttggagttgtcttcttaatttggtgtttttcttttctttcttagtctcctgagcattgtgttttggactggtttttgcacactgtaaccaacctccacttttctctcttgcagattattttcccctggaaggatggagacatcttcatctctgccactgtcacccataagtatagaaccagaacagcccagccatcgagattatgacatcacaactagacgtggggttggaaccacaggcaacccaatagaattgtgcaccaatcactttaatgtttctgtgagacagccggatgtagtattttaccagtacactgtaagattcattagtcacttttctgcattctttcatcagtgtctgtgcgtgtgtgagatgtttgacatatcggtaccttttttgcaggttagtatcaccacagaaaacggtgatgctgttgatgggacaggaataagcagaaagcttatggaccaactattcaagacttactcttctgatcttgatggtaaaaggttggcatatgatggagagaagactttatatactgttggtcctctaccacagaacgaatttgactttctagtcatcgtggaagggtcattttcaaaacggtatgtccctcttatctggattgatatttaatcgtttcaaggtgtcaagatagatcttgttgatcttctaactaacgcagtcttgttaagtttatagtgattgtggtgtctctgatggtggtagttcttccggtacttgcaagcgatcaaaacgttctttcttgccaagaagttacaaggttcagatacattatgctgcagaaataccgttgaagactgttcttggcactcagagaggagcttatacaccagataagagtgctcaggatgcacttagagtgcttgacattgtactgaggcagcaagcagctgaaaggtaaatctttctatctgtttgcttttgtgcagtttatatttttattaaaatagatactctacgttctaatggaccaatttttattatcatattttcactttgttggtgaaatttaatcaatgtacaactatttgcattttgtgaccatgctcgatgcttactatagaaaactgttgataatgcaggggatgccttttggtcagacaggcatttttccatagcgatgggcaccccatgaaagttggaggaggtgttataggtattcgaggtttacattcgagctttcgtccaactcatggaggactctcgcttaacattggtatttttcagtatacctttctcatctccagctttcataaacttgtcttaattgtggatagttttattaataagcaaaactgttttcgttttgtgatggtttgcagatgtgtcaacaacaatgatcttagaacctggtccagttattgaattcctgaaagccaatcagagtgttgagacaccacggcaaatcgactggattaaggtagttctggcttttaaatgcaataactgagaacatgactggctgcttttgttttgagcttgtgaagttttcattgaaacttggcaggctgcgaaaatgcttaaacatatgagggttaaggcaacacaccgtaacatggaatttaaaattataggtctaagttcgaaaccgtgcaatcagcaactgtaggttccccatgattgtactatcaatatatattttgtcctctttttcagcctttgcttgactttcttcaccgttttccaggttttcaatgaagattaaagatggtgaacgtgaggtacctattagagagattactgtgtatgactatttcaagcaaacctacacagagcctatttcttctgcgtactttccatgccttgatgttggcaagccagatcggcccaactatcttccactggaggtatccatctccagcagtgtttccttcgttaatttttttgtagtctcttatcccacttctggaggtgtgtatgtttgaacttctaattcttttcttgcagttttgtaatcttgtatctctgcaacgttatacaaaaccattgtcagggaggcaaagagttttacttgttgaaagttcaagacaaaaacctctagagagaattaaaacactcaatgatgtgagcttcgttttctgacctcggatgatgcttgatctatcttggatggcaaatactgttactgactagaattgtaggcaatgcatacctactgctatgacaaggacccatttttggctggatgtggcatctccattgaaaaagaaatgactcaagttgaaggccgtgttctcaagcccccaatggtaaacctgtttatgttttgtttgcagatagaaagatatgatctaccatggaaattatagtcccatattgacccatttgtaatatacagctgaagtttggcaagaatgaagattttcaaccttgcaacggacggtggaactttaacaacaaggtaattgtctgcaaagatttccgggcatcactatttcccttttatttttaccctttgtttcttgctttacagatgcttctagaaccaagagctattaaaagctgggctatcgtcaacttttcttttccatgcgacagtagtcacatttcccgtgagcttataagctgtggcatgaggaaaggcattgtaggttttgtagatactgtctcaattttcttatatggtttgtagtgttgttctatggttattgacagagtctgaatatggtttgttaatttgcaggaaattgatcgaccttttgcactagttgaagaggatccacagtacaaaaaagcaggtcctgttgaaagggtagaaaaaatgattgcaacgatgaagttaaaatttccagatcctcctcattttatcctctgtattctgccagaacggaaaacttctgatatctatggtattatctcacctttttcctgcggatattaaagtttgaactctctcattcaactggtcgttgcatactataaaggtccctggaagaagatatgcctcactgaagaagggatccacacacaatgcatctgcccaatcaagatcagtgaccaatatctcaccaatgtacttctgaagataaattcgaaggtatatcaccaaccacgctaacacttgagatatcttcttttgatgtgttattctctgtgaattgacttcttttcttccgtcttaatatagcttggaggcatcaattctctgttgggaatagagtactcttacaacattccattgataaacaaaattcccaccttgattttgggtatggatgtatctcatgggcctccaggtcgggcagatgttccttcagtagcagcggtattgattacatgtcttttcctttgtatgttcattgtatctggttatcttaggatctgattatttatctgtttactttctcgatctctgctgcaaggttgttggttcaaaatgctggcccttaatctcaaggtatagggcagctgtaagaactcagtcaccacgtctggagatgattgattcgctcttccaacctatcgagaacactgagaaaggagataacggtatcatgaagtatgtgaaccctagttttaatcaatttcaacaactcaagatgtttaagtctcttcttcatgtttaattattcgtttcaacagcgaattatttgtagagttctatcggacaagcagggcacggaaacctaagcagattatcattttcaggtattagcaaaacatttactgtttatctttgttgtctaacctccaatatctaaaagtctatccttacacaaaccttgggcatttgatagggatggtgtgagtgaatcacagttcgagcaagtcttgaagatcgaagtggaccaaattataaaggtcttgtttcaaagtcccatggctggttctggtttcaatctattagtcaaattgtagtgaagatattatttaacagttttgcttcttttttacatggcgcaggcgtatcaacgtcttggtgaatctgatgtgccaaaattcactgtcattgtggctcagaagaaccaccacaccaagttgtttcaagctaagggtcctgaaaatgttcctgcaggtaaaaaatactttttattcttcacccgtcactaggattccatttctttccgtaactatttcatcataaaaaaaacaatgtcgtttgtcaggaactgtcgtggacaccaagatcgtacacccgacaaactacgatttttacatgtgtgctcatgcaggaaaaatagtaagtgtagacaaaagtttagcttcactcctcgcacctttattaaaatcaacgctatataatgtttccctctatgatctctcagggaacttcaagaccggctcattaccatgtattacttgatgagattggtttctcccccgatgacttgcagaatctcatccattctctctcctatgtgtaagttcactccttaacgtcaattacaaaaaccaacttagctttaccatcactaagatctaattgtctcgaatcatcatcattccagcaaccaacgtagcacaactgcaacttcgatcggtaacactccttaatcaaactctcttctataaataaaaatgcgacctcctcttttacactatacagaaactactcaactcaatattcaatgtgtcctctcttttgtgtgtgtttgtgctctcagtggctccagtacgatacgctcatcttgcagcagctcaagttgcgcaattcacaaagtttgaaggtatatcggaggacgggaaagttccagagcttccacgtctgcacgagaatgtcgaaggcaacatgttcttctgctgagtacatataagtagttctgcttcctccctagtctaaacccaaaccctcctctttagaggaagtttatcattttgcatatatgcaatcatcaccgtacagtttcattagaagtaagaagaaagatcctcgcgtagattaagaggctcattggcttattgatagcccaagtttgcttactaaacggcagcgatttttgcgtttagcttttggatttttcaata

SEQ ID NO: 38 - DNA, 5881 bp, Arabidopsis thaliana
tgcacctcatgaaaccaccctcgctagcacgtcaggttctgatgtatatatttgggacgttagcagtgagactccattggcgatcatccctgatgctcatgagggtaccacttactctttggcaagaagccatactggggatttcctgtttactggtggagaagatggagggattaaaatgtttgagatcagaagatacggtagtgaaacaagcgttgtacttatatctcaatggatgcctcacactagtcctgtctactctctttcttttgagtttccttggcttgtctcagcatccggtgacggtaaactcgcacttatcgacgttaggaaactgttaaaaactaaccgttgtgcctattccaaaaggatttcttcgagtactgtggaaccgccacaacgaatgctgcacgggttcgggtcaaacttgttctctgtggacgtgggttatgaccgtatagtgtgtggaggtgaagaaggcacagtccggatatggaacttcacacaagcattggagatagagcgaaggacccgagctctgaaaggaatgaggcatgagaataggatgagacgaaggagaatgcaaatggagatgaacgcaaagaatggaaggcctgaccaatgctccattgctgctcataagaaccccatcaatggagaaaggaaccgagcctggcatagtaaacgaagagcaagcgggaaggcgaaggcctaagcgataagattggatttatctttaatacatttagtaaagcaattttataaccttgacacatgttggctttaacttttaagctatcagagttgggtctttatgattggtggaaaatgagaaaattggcttttagttcatatattttggaagcttttagtatgaaaaaatgcaagagattcctcgaaggttcactaacttctaactgaatttcaaaatcttacaatacaacaaacatagtaatatttttcaagttcaaaaacaagaaaacgaaaaatataaacaaaaaaggaagttccaattctctattggcttttctttgaaacttgaagaatttgatatttgatcgaccatgacagaatagcaaagcctcatgagtcttggttctttcgtttgaattcccagatcaattcctagttctctcgtttgaattcctagtctcttcgacttcaatctacccactaaattctattgcagttaatccacaacaaaagccaataattatccacttaattaaaaaagtaatgcatgcaatgtaagtgagaaatcaatgactagtgtaccctctcgaatttcatgtacaagaaaaactctttgtcttccttagcgtaaaacataaaaaggctttaagactctttgcactcaccgcacgcctcttcatctcctcttacataatcctttcttttactatttaagggttattccttattcggggccaaacaccttaggtacgtcaaagccagaaccgaactaaggatcaacgacgcataacatctggaggccgagaaatggatacgactctaccgcctcctcaacacatggaacgtgaacctttgaagagcaagagtagtcttcttccaatgactcgccgtggcaacggttccaaaggacagaagattcttctgctcactaaccacttcagagtcaacttcagaaaaccaaacagtcataatttcttccattacagcgtgcgctttttgtttcccttcctgttcctgtttccatgacttgatttggaaaacatactttatagtgtgctttgtctctttggatacaggttactatcacatatgaagatggtagtccacttttagccaaaggttttggcagaaagattcttgaaaaagttcaacagacttgtcaagctgatttgggttgcaaacattttgcttatgatggcgacaagaatctttatactgttggtcctcttcctagatccagtctagacttctctgttgttcttgaaaccgcgccttctaggagaaacgcagacaaaagactaaagcttcctcaccaatccaagaaattcaatgttgcaatcctttttgcgcctccagaaatcccaatggaagctattgcaaatgctcttcaaggaaagaaaactaaacatcttctagatgctatcagagtgatggactgtattttgagccaaaatgcagctagacagttagtgaaccttttttagtttttttttcttagatatattcttggatatttgatgttcttgatgttcatgttgtgacacatttctattttgcgcagaggttgcctcctagttcggcaatctttcttccacaatgacgcaaagtactttgcgaatatcggtgaaggtgtagattgttgcaaaggatttcattcaagcttcagaactactcagggaggcttgtccctcaatattggtaatttcttttcttttaacatatgttttttcatgtggtattaaaaacattctttgtaacatttcagttttaatttctttcatcagatgtttcgactgctatgatagtaaaacctggtcctgttgttgattttcttattgcaaatcaaggtgtgaacgatccattctctattaactggaaaaaggtatttacaagaatttcaaatggtgttttagcatatctttgaggtgaagtacttcattttctgatttttttttttgtttctctctcgtataggctaaaaatactctgaaaaatcttagagttaaagtcctcccttcaaatcaagaatacaagataaccggactaagtggactacactgcaaagatcaaacgtatgttgtgagttgatatttattttaagttttcttgttttgcttctcgtttatctctttttcttgtgtgatttaggtttacttggaagaaaaggaaccaaaacagggaatttgaggaggttgagattacagtgtccgattacttcactaggatccgtgaaatcgaactgcgttactcgggtggcttaccttgtatcaatgttggtaagccaaatcgtcctacctactttcccattgaggtaatatttgttttttgttttgtttttcttccacataatctcatgtttaatggcttatgatacttatgatactttcccatcttttgttttataaaacattttgcagctctgtgagcttgtatctctacaacgctatactaaagcgctaaccaaattccagaggagtaaccttatcaaagaatcaaggcagaatccacaacaaagaattggtgtgttaaccagagtaaggactttaaattttccatttatcctctttttatttgcatttttatgtatactaagttccatgttttgcaggctctcaagactagtaattataatgatgacccaatgttgcaagaatgtggtgttaggattggctctgacttcactcaagtcgaaggccgcgtgttaccaacaccaaaggtgatttttcttccattacatttttggttatggaaggtttgattttattattatatatctgtggtctcttaatcccttataaacagcttaaagctggcaaagaacaagacatctatcctattaatgggagttggaacttcaagaacaaggtccttaactatcctctgtcttctcaaacaagttttgttttgaaaacttgtgacactgatcatcaaactttcatctacagacattttttaagccagccacagttactagatgggctgttgtgaacttctctgctcgctgtgacccgcaaaagattattgatgatttgaccagatgtggaaagatgaaaggaattgtaagcttacttttcgtcatcaggaccattggttactacaataaagaacactaataacaaaaccctctcttggtttttttgttttgttttcattaccagaacgtagattctccataccatgtcgtctttgaagaaaatcctcagtttaaggatgccactggttctgtaagagttgataagatgtttcaacatttacaatcaatactcggcgaagttcctccaaaattccttctatgcatactcgaaaagaaaaactctgatgtttatggtaacactaagcacttaacctttcctgaatcatatagtatacaccttttttttttttctcatatggaaaattttatcacttaggtccttggaaaaagaaaaatcttgttcaatgtggaattgtgaatgtattgttcctcctcaaaacttaaatgatcagtatctcacaaatcttctactaaagataaatgccaaggtgatgatctcttcttgaatcaatctttgtagtttctgatataataatcttatagttaatctctgccatttctgtatagcttggtggattgaattcagttttggatatggagctgtcaggaacaatgcctctggtaatgagagttcctaccatcattattggaatggatgtatctcatggttctcctggacagtctgatcatataccatccattgccgcggtaacattgtttttttttttctttttcactttcttgtgttgtatttttatgtaagctactgatatctttggaatgcataggttgtgagctccagagagtggccactgatctcaaaatacagggcttgtgtgcgtacacagtcgcctaaagttgaaatgatcgatagcctctttaaacccgtctctgacaaagatgatcaaggtatcatgaggtaatactatatattactggactattttgtaactcgtattaattagccctgcttttatgtaacagtatatgatttttaagattcaatgatgtgtttacagagagctcttgcttgactttcactcaagttctggaaagaaaccgaatcacattatcattttcaggtatgcatgtataatttttaggcatgcatgtagtttaatacaatttttctaactcttaactacaccaatacatgcagggatggtgtcagtgaatctcagtttaaccaagttcttaatattgaactggatcagatgatgcaagtaaggattttggttttaccatttttaagctcttaaatacttagcctatgtttgaccattttggagtttaaggtttaacttttgttacattattaggcatgcaagttcttggatcagaagtaagatcccaagtttacactgatcatagctcagataaaccaccacacgaagttcttccaaaccgaaagccctaataatgttcttccaggtaaacagttgcagatatttttttgtgttttgtttgtttgttagtgttgttgaaatgacttgaaacctgttctctatttacccgcaggaacaataattgacagcaacatctgtcaccaacacaacaacgatttctatctttgtgctcatgctggaaagattgtaagtgataagtatatatattattatgctcgaatcctttatgaatcgaacaaaaacttaaaaacacttttcgatgtgttagggaactacaaggccaacacattaccatgtgctctacgacgagattggatttgacacagatcaactccaagaacttgtgcattcactatcctatgtgtaagcagcacatcacttcaaacttttttttacctgatacattaaatctctgtattgaatttagccattaatctcttaattctttgctttattacttgtagctaccagcggagcacaactgccatctctcttggtaattcttttggcatttgatatctcagctttatgtgtagaatttgaaaaattgacacaacttgattattatgcagttgcgccgatatgttatgctcatttggcggctgcacagatggcaactgcaatgaagtttgaggacatgtctgagacttcatcgagccacggcgggatcaccacagctggagcagtccctgtgcctcccatgccgaagctgaacaccaacgttgctagttcaatgttcttttgctga

SEQ ID NO: 39 - DNA, 6768 bp, Arabidopsis thaliana
acatagtggacccatgacaagaaataaggcccaaaagttgggctaatttcagccatcacgacaaaggctacttctcatttcgacatccatattattctattcttgtacacttctctttcattcactcgtcattaatatgccttcaatctaatatatttaaggacacaattatacacacgtccatatataaacttatattgttgccttgttggatatatataaaagttattgtaattagtagttactagttagagtaattttcaggtctaatagtgatgagattaacgtattttcttctttaaatttcagttatttgcaaataatgtcactgctcgatttcctggaataaaggagctaataagagtatcatgttctccttcatgttaccatttcacgtttgcacgttttttttttttttattatgaacaagattacgatcacacgttcggtttgttgtttagtcgttccaagtgtataggagttttatccacacaaaaaaaattttgataggaatgtgtaattccataaagatttccatcgttacacactaaagttttatcttacgcgccacgccgtttgtggagtaaccgagtaactaatttactactagtcttgatgttggtaggattaaataaaagaatcatggagataggatacgattgtgtttgaataattcaatatgtttatatctggaaagatctacaaatttgatatgatcactaagattgtgggaatttattcaaatccaaaacacatagttacaaatcatatacaaatatggaaaataaataatgtctaataacatttgtgtaacatcatctttaatgcgagtcatttagaaatgtaactttttttctttctgatatgtttatttctggaaatatatacaaaattgacctgatcactaagattgtgggaataattccaaaccaatatagaaagtgataatttattaaaaactgaacatttgtgtaatctttttttttttttttttaatgtaatgtcaaattatattcaaaaaaaacatatacttttttacaacttgtgcttcatgtgtaagaaagggagagtgctaaaaaaaattctgaaattgtccaaaaatgattagatctttcgtagagtcgatgttgactaccccgggaatgaacccatttgtgtaatcttttaacatttattaaaaacaaatcatagatagctaagattgtgggaagaattccaaacgaaattaaattcacactaacacatttactaaaatcatagatagatatagaaagaaaaaacttttctactaatttttttgacatttgtgtactcattatagcgagagaaagagatgggcctcaaaacttttattaggcccaaacgttttaaattcattataaaaataaaacaattccacgaaaatttcgaaacccatcactttggcgcttatgtgacgcgcttatttcgccctcaatctcagattatttagtcctcacactcgtcacacccccgcttcctagggtttcatttcgtctctttatcttccttcgtctctttagcttccttcgattctctgactcaatcatggcgccgaagcgaaagagacctgcgacaaaggatgacactaccaaatccattcccaaaccgaagaagagagctcctaagcgagctaagacggtgaaagaagagccggtgacagtggtcgaggaaggggaaaagcatgttgcgaggtttctagacgagccaattccagaatctgaagcgaagagtacctggcctgacagatacaaaccgattgaggtaatttcatacatcggaaactggaattttgggtgtttgtgtatgaaatagttagatctagttgaaatttgctgagatttgttgcagatctgttgatttctgaaggattttttgtttgttttgtttcaggtacagccacctaaggcttcgtcaagaaagaagacgaagtaagttccttgaatcctttggttcttgtgtatagtcagattgagaggctttacttttgtttgattagaaatgttttttgtttcgtaaatagttgattaagtgaattcgttttgtagggatgacgaaaaagttgagatcattcgtgctcgatgccattatagacgtgcgattgttgatgagcgtcagatatatgagctgaatgatgatgcttatgtacaggtatgactctattacgtctaaattgcatttgttacattttaaagcgtagatttatgtggtacattgaagaaaatgagttagagaggagaatgtgcatgacattgtgtttcttggtgtttgagtttgatgactattgaggttttaccacttttttaatgtgccaacatggttttactgtgtagaaaattttgatgtgtagggtaaataattaaccaaagttgatcacattctcctccctcaccactatcaactgtccgcaataaatatttgtgcattgtctctgtttgtcatgctttgtatatctccaagtccttatgatagtagttacctttcgaagctgagttctcatctgtaacaataactagctgattgttatttagactggcattgcatattatgcattggctatatgaacgtttatcatgttgttttatgtttttcgtacagcgtaggtagatgctttaccatatataacttctgtttttaacaactgagttttgtaatttttgtgcagtctggtgagggaaaggatcccttcatttgtaaaatcattgaaatgtttgaaggggctaatgggaaactgtatttcacggctcggtggttttatagaccttctgatactgtaagaataaaaaaaatcttcttcttcactttctctttaatctatgttgaattgtctgaagttttttttctattcttaactttcaggtaatgaaagagttcgagattctgatcaagaaaaagcgtgtgtttttctctgagatacaagatacaaatgaattgggattacttgaaaagaagctgaacattttgatgattcccttgaatgtatgttcttacttcactgttacttgtagtgtatgcttttggtatacagtatcttagtacaatcttccattgatactgaacttatttttgtttctcatgccaggaaaatactaaagagactatccctgcaacagaaaactgtgactttttctgtgacatgaactatttcttgccttacgatacatttgaagctatacaacaaggttagtgcttttaacaattgatcttcaagtttagaaactgccaactggattagataaaatgctgcagtttttgaagataactaagcatttacagatctttcaattgtgcagaaaccatgatggctataagtgaaagttcaacaatatccagtgatactgatataagagaaggagctgctgccatatcagagattggagaatgttctcaagaaacagaaggtcacaaaaaggcaactttgcttgacctttactccggctgtggagctatgtcgacagggttgtgcatgggtgcacaactgtctggtttgaacctcgtcactgtgagtcatttttgcttgctaataatcttctcagatttgtttaatctctcaatgcttaacttttgctttttttttaaaatgattctcaagaaatgggctgttgacatgaatgcacatgcatgtaaaagcttgcagcataaccacccagagacaaacgtaagtttttagttttcctttctcccaattcgattgactacagaaattctcaagagcctaaatcatttcattttaggtgagaaacatgaccgcagaagatttcttgtttctgcttaaggagtgggagaagctatgcattcatttctctttgagaaatagtccaaattcagaagaatatgccaaccttcacggtttgaataatgttgaggacaatgaagatgtcagcgaggagagtgaaaatgaagatgatggagaagtttttactgttgacaagattgttggtatttccttcggagtccctaaaaagttattgaaacgtggactttatttgaaggtattgttgctctgcttgtacaaatttcacattacatctcatggtttagccttgttatatagttaatcatctctggtgttttgatataataggtaaggtggctgaattatgatgattctcatgatacatgggagcctattgaaggactcaggtgagcaaaacattaagaatgtttgcattaaagttatatatgttaatgcgttgttaaaatctctaaatttgtccttgaacagtaattgccggggtaaaattgaagagttcgttaaacttggatataaatctggcatccttccgttaccagtatgtattttttatacctgattcttttgctttccttaaacttctgaagctagtgcataattttcagatatttaatctaaaagccaataatctaagttattgtatgtgataagttctatgggtcttatgttgttctgcgtcagttaattgttgaggggtgatagatttagtcacagaacagttgatgtttagagcaatatcctgacattgtttatatgttgttgatgtttagggaggtgttgatgttgtctgcggtgggccaccatgccaaggaatcagtggtcacaaccgcttcaggaacttattggaccctctagaagatcagaaaaacaagcagcttttggtgtatatgaacattgtagaatatttgaagcctaagttcgttttgatggaaaacgtcgttgacatgctgaagatggctaagggctatcttgcacggtttgctgttggacgccttctacagatgaattaccaagtgaggaatggaatgatggcagctggagcttatgggcttgctcagtttcgtttgaggttctttctatggggtgcactccctagtgaggtaaaattcttaatgttttctctttgttttatattaatgaatagatgctgttcttaatttgtatctttctgtttcagataattccgcagttcccacttccaacacatgatctagttcatagaggaaatattgtcaaggagtttcaggtaaactggtatattagtacctttcaatttgttttagcaaattctcatatttatttgtaactaatgcagggaaacatagtagcctatgatgaaggacatactgtgaagttagcagacaagcttttgttgaaggatgtgatttctgatcttcctgcagtaagtattgatgtttttagcaaattttgactaaaattaggtacagtttgtcttgaatattttcttacttcctatgtttttgtattaggttgccaacagtgaaaaaagagacgagattacatatgacaaagatcccacaacgccatttcaaaagttcatcagattgagaaaggatggtaagattcttattatttttttgggcaaacagtgtaaaaacatatatttgacaactattatggcaactgatgttcattaacaaattgtttctgaattttttcaacagaagcgtcaggttcacaatcaaagtccaagtccaaaaagcatgtcttatatgatcatcaccctcttaatcttaatataaatgactatgaacgggtttgtcaggtccccaagagaaaggtacaactttctttatactcgattgacgatcatatatttttttggctctggtctgttttagtgtctaggaatattctgattatttcaaaacatcttttggtatcagggagcgaattttagggactttcctggtgttattgttggacctggtaatgtagtcaagttggaagagggaaaggaaagggtcaaacttgaatctggaaaaacattggtaagaatgatcatctcttttttttggtctcatatcaagttacttttctcctgattggctggctatgttattcaaacaggttcccgattatgccttaacatatgtcgatgggaaatcatgcaagtgagttttaattctcttttcttcgtctctgaaaattctgtatttgactattgttttctgttatggaaattgacttaagcccttcgctgtttccagaccttttggtcgtctttggtgggacgaaattgtccccactgttgtcacacgggcagaaccccacaaccaggtgagacctctcatgacaatcaagtatttgttctgaattttggctagttgttattctagtgttctaggtttgcatagatttattagtatgcatgttacactggaaccaacttaaagagtataattgtttgatgttgctggtgattgattgcaggtgatcattcatccagagcaaaatcgggttttatccattcgagaaaatgcgagactccaaggctttcctgatgactacaaactctttggcccacccaaacagaagtgagtattgttaagaccttgagtttatgtgtgttcttggtggatttattgctgctatagttcttaagactaatcttacataatttctgtttttcaggtacattcaagtaggtaacgctgtagctgtgccagtagcgaaggcccttggatatgctttgggaacagctttccagggactcgcagttgggaaagatccacttcttactctgcctgaaggttttgcattcatgaagccaactcttccttccgagcttgcatgaacactgttgattcatcgcatttttcgatttatcttctattcattgttttcctaggatttatctttagaccatttgctgcggaatttggatttgttttgtttaagtttcacgactttcaagtttagcaactctgaatttctggtaactttgttttaatcagatgttatggatttgtggg

SEQ ID NO: 40 - DNA, 8783 bp, Arabidopsis thaliana
cgtagtttcaacgaaaaatcaatgctagaactgattcgtagtctagatgttccatccggtaagaacgatatttcactgtgtttttgttgtggcgtgttctttgcgttatgtttaaaatcaatttggtctcttcactgttgtaggaaccaaggcatttgtagcgaaatatattcatcctgaaaacgctattgtaaaaattactcatctctttttttttttacttcagtacgtttatgatatggattcgatacactgaaacatgattgtgtctttatatcttagactgcctacaatgatggacttggatgtggattatggacacttctcacatctagcatttctgttatttacgttactccttctacatgggacaaacattttaatcttagtatttggagtttggtgatgaatcttaactctcaaacttttatgatttcatgtctatcctcacatcaattgcaataaaaatatttgcttttctcttcgtaggatggtggcaggaaactcgcactggaaatgtttccatcacttaaattgacaacgaaaattgacgacaatgctcgagctaatgcactactcattgctgcatatggtcatgctacaagtgatacaagatattactcattttctcaaattaagtgacatatctaacatgtaaaaatgagtaatgttttggtgatttcacttatatattgcatctctttctctgctcctttggctttcagaaaattcttcactaattagaaaaaaatattttgtttattctttttccgtattcaaaatctctcaaaatttggtcatttttcgatttctatatttatctaattttcaaggtgagagttgttaatgtagtttggttatgatttaacccgaccgaaatcctcatgacctaacaaattataaataatctctgacaaaacaaggtaaattgtctcgggttgaaagagacattagaattagatgatattaacataagtcagcccctcttctacatttttagctttcttttagtcgaaaatcattccaaactcggaacatacattgtggtgtttatttgggaagaagtccacgctaaagtattttagtacatttctaccagattacccggataaataaaaaaagcgaagttacttacaacatgaaacagcttgcacattgaagaaaagtaatcaatcagcagtatatccaatgaatctatgcatcttgtcaggtccattgggccttagaggcctaaatatttgaagaaagagtaaaatcaaaaataaagtatcgaaaaaaggtaacccaaaaattaatatagtttgactaattttgttgcagtttttttttctagttaaaaattcaacattcgaaactcatgttctgacctcatttatacacttgcccagtggtcagtgcagaaaaagagaaaaagaatcacctttttgttttaatctcaaagtcgaaattcgaaattcctctactcttcccgttaagtgtgttcctttttatccgttcgtcatgcattcgtcgttggagccggagaaaatggaggaaggtgggggaagcaattcgcttaagagaaaattctctgaaatcgatggagatcaaaatcttgattctgtctcttctcctatgatgactgactctaatgggtatcatcatcttcctctctttgtacttgattttgggtcttatgggtttttagtctttttcactaaagtttactttttttttggcagtagttatgaattgaaagtgtacgaggttgctaagaacaggaacataattgctgttttggggacagggattgataagtcagagatcactaagaggcttatcaaagctatgggttcttctgatacagacaaaagattgataattttcttggccccaactgtgaatcttgttaaacaggcaagtctcttgtttgattgtaaaaagaaaaactgtttcatttggattttaatcattttgagttgatgatgttggctaatgagtcgccttgggagcttatttttgaatgttttattggtgtgtgtggttttagcaatgctgtgagatcagagcacttgtgaatttgaaagttgaagagtactttggagctaaaggagttgataaatggacatctcagcgctgggatgaggaatttagcaagcacgatgtaagtttctgtttctttttgtgtatatttggctagttatacgccaacaaagtgacttgcttgtagttttggtgattttatatcaaaatttctttgtgtggttagtgaaactttggcagaatgttgtaatccactttgaccagctcattgttgtattttgagtcatgaatgttctctgagttagttaaaagcccattccaatttgttacttttggggttggttcttcttccaatgctgattatttcttaattattttgtttgaacttgtttgcttgagcccttgacgtagatttgtgactgcattgatctcactaacagaatcacatacttctcttttgttgccgaatccacgtgagtctattatctgcaatgaaattatgttttgtatggttcaggttttagttatgactcctcaaatattattggatgtccttagaagtgcattcctgaaactagagatggtatgtcttctaataatagatgaatgccaccataccactggcaatcatccctatgcgaagttaatgaaggtgtgttttctcagtaatgataagctctattagttttttcataatagagtttccataacttgtcaacgaactagattctttcttgttttcatgaaggaattctatcacgaatccactagcaaaccgaagatatttggattgactgcgtcagccgtcattagaaaaggcatgctatttaaaagtttcttatttcctctgtatgccaaaccaaagatcctgcttcctgtaactactttttaatgtttgaacttcatgtaaggaacataaactcatactacaagtgtttcctctccctctaactatgcagctcaagtatcagaacttgagagactcatggactcaaaggtactttgtttttgtgtaacaaggaaacagatatagtttacaaattaatgctatgcaatcttactttgaattcagatttttaatcctgaagagcgtgaaggagtggaaaagtttgctacaacggttaaagaaggtccaatattgtataacccatcaccatcctgtagtttggaattgaaagaaaagttagaaacttcacacctcaaggtatataatatatgctcactgaatatgatccagaacatgactctttcctattatgtttcagagtgcttgaaaaatattctgttttttttcgtacagtttgatgcttctcttagaaggcttcaagagttgggaaaagacagttttctgaatatggataataagtttgagacatatcaaaagagattgtctatcgactacagagagattttgcattgccttgataatcttggcctgatttgcgcacacttggtatttttctaccagtttagtttttattaccagttcttcatttgcttactcattgttacttttttctcccgctagcatacctgttgtgctgattatttttcttttttttttcatcttgctttcgcgataggcggctgaagtctgcttggagaaaatctcagatacgaaagaggaaagtgaaacttataaagaatgctcaatggtgtgcaaggaatttcttgaggatattttatccaccattggggtgtatttgccgcaaggtaatgtattcaaagctctatattgcattgagtcctcttctagtcactaatttttacactgtttatcatttgtgttatttaacagatgataagagtctggtagatttgcagcaaaaccatctgtcagcagtaatttctgggcatgtatctccaaagctaaaagaactcttccatctattggattcctttaggtaaatttaaattgtttatccaactcccaaaattgcaccaagatctccatctgttctgacaatttcaatttgcttgcagaggtgacaagcaaaagcagtgccttattttagttgagagaattataactgcgaaagtgatcgaaagattcgttaagaaagaagcctctttggcttaccttaatgtcttgtatttaaccgaaaacaacccctccaccaatgtatcggcacagaaaatgcaaattgaaatccctgatttatttcaacatggcaaggttacctgttcttcatcacagtcagatgttttatagattgagaaatgtttttattttgtcttctctgaaagctttttaatgcatgtaggtgaatcttttattcatcacagatgtggttgaagagggatttcaggttccagattgctcatgcatggtttgttttgacctgcccaaaacaatgtgtagttactcgcagtctcaaaaacatgccaaacagagtaattctaagtctatcatgtttcttgaaaggtaggaagcaatatttatttaacacaaaatgtttaccaaattccagtttttgtagcttatttctgaatactaattattgtagagggaacccgaagcaaagagaccatctgcatgaccttatgcgaagagaagtcctaattcaagatccagaagctccaaacttgaaatcgtgtccacctccagtgaaaaatggacacggtgtgaaggagattggatccatggttatcccagattctaacataactgtatctgaggaagcagcttccacacaaactatgagtgatcctcctagcagaaatgagcagttaccaccgtgtaaaaagttacgcttggataacaatctcttacaatccaacggcaaagagaaggttgcctcttctaaaagtaaatcatcttcatcggctgcaggtatgttttctaatttattaattcgtcaattagctggtgtcgctgattttagtctttagttcctctatcagccgctgttgtatcacacacatacacgcacacatcagcagttgcatatcatatgtctatgtctaaggtcatggagcttgtcttaatttgtttatttatgtatacatttctttttcttttcgctgaacaggttcaaaaaaacgtaaggagttgcacggaacaacctgtgcaaacgcattgtcaggaacctggggagaaaatattgatggcgccacctttcaggcttataagtttgacttctgttgtaatatttctggcgaagtatactcgagtttctctcttttgcttgagtcaactctcgccgaggatgttggtaaagttgagatggacctttacttggtcaggaagcttgtcaaggcttctgtctcaccttgtggccagatacgtttgagtcaagaggaggtacataactctgatccctagttataaacagtttcttgtttcatggtttgaacttgatgtcttcttctttgtgttttggatgcagctggtcaaagcaaaatattttcagcagtttttctttaatggcatgtttggaaagttgtttgttggatctaagtcacagggaacaaagagagaatttttgcttcaaactgacactagttctctttggcaccctgcctttatgtttctactgctaccagttgaaacaaatgatctagcttcgagtgcgacaattgattggtcagctatcaactcctgtgcctcaatagttgagttcttgaagaaaaattctcttcttgatcttcgggatagtgatgggaatcagtgcaatacctcatccggtcaggaagtcttactagacgataaaatggaagaaacgaatctgattcattttgccaatgcttcgtctgataaaaatagtctcgaagaacttgtggtcattgcaattcatactggacggatatactctatagttgaagccgtaagcgattcttctgctatgagcccctttgaggtggatgcctcatcaggctatgctacttatgcagaatattttaacaaaaagtaagtgatattctagctttggctgttctttcaatctacttatcataactctctagttaatgttattcccttttaatcaggtatgggattgttttagcgcacccgaaccagccgttgatgaagttgaagcagagtcaccatgcgcacaaccttttagtcgacttcaatgaagagagtaagttgattcttgagaatttctccaacatatggaatcattgtgtatgttctcatgatattgtagtgtgtgagctctaagatgttgtttccaatgtaaatggacagtggttgtgaagacagaaccaaaagctggcaatgttaggaaaagaaaaccgaatatccatgcgcatttgcctccagagcttttggctagaattgatgtaccgcgtgctgtgctaaaatcaatctacttgctgccttcagtgatgcaccgcctagagtctctaatgttggccagccagcttagggaagagattgattgtagcatagataacttcagtatatcaagtacatcggtatggtttttgaaaactatctgtcatttagagatgaaactagatatcttgattgtcattaaactcttgtcttggttcaataaatcagattcttgaagcagttacaacacttacatgccccgaatcattttcaatggagcggttggaactgctcggggattcagtcttgaagtatgttgcgagctgtcatctattccttaagtatcctgacaaagatgaggggcaactatcacggcagagacaatcgattatatctaactcaaatcttcaccgcttgacaaccagtcgcaaactacaggtatcttctaacatttgcaagtaatgtcttacatcagtcagaacaccaaagaaatatctttccatggggattggtttgatagggatacataagaaatggcgcttttgaaccgcgtcgctggactgcacctggtcaattttctctttttcctgttccttgcaagtgtgggattgatactagagaagtaccattggacccaaaattcttcacagaaaacatgactatcaaaataggcaagtcttgcgacatgggtcatagatgggtagtttcaaaatctgtatcagattgcgctgaggccctgattggtgcctattatgtaagcggtggattgtctgcttctctccatatgatgaaatggctcggtattgacgtcgattttgacccaaacctagtcgttgaagccatcaatagagtttctctacggtgttacattcctaaagaagatgagctcatagagttggagagaaagatccaacatgaattctctgcaaagtttcttttaaaagaggctatcacacactcctctcttcgtgaatcctattcatacgaggtatgacttcatcattttcaacccctgcattatttggctgacttattcccaggtttccaacctcatgctatcatttttttcctcaaacagagattagagtttcttggcgattctgtactggattttctaataacccgtcatctttttaacacctacgaacaaactgggcctggagagatgaccgatcttcgttctgcatgtgtaaacaatgaaaattttgcgcaagttgcagtgaaaaataacctgcatacccaccttcaacgctgtgctacggttctcgagactcaaataaacgactatctgatgtcctttcaaaagccagatgagactggtagatcaatcccttcaatacagggccctaaggtaaaaaatatacttgcatgaccatttaaagtccctgcctgagatttcagattataaagagagcaaataggttgacatacttgtctattttggtttaggctcttggagatgttgtggagagtatcgctggagcattgctgatcgatacgaggttagatctcgatcaagtgtggagagtctttgagccgttgctttctccacttgtaactccagataaacttcagcttcctccataccgggagctcaatgagctatgcgactctcttgggtatttctttcgagtgaaatgttcaaatgatggtgtcaaagcacaagccacgatccagttgcagctggatgatgttcttttaactggagatggatctgaacagacaaataaactggccttgggaaaagcagcttcacatctgcttacacaacttgaggtatatatattctgatgtttccacttgcgtgtgtgttggtgtgtgtgctcaaactttctttggttcttcagaagagaaacatttcacgtaaaacctcgctcggggataatcaaagttccatggatgtcaatcttgcttgcaatcatagcgacagagaaactctgacttcagagactactgaaatccagagtatagtgattccatgtaagcactgttatttacctagagagattcttcttttcttcttcagtttttttttttttttgtatcaagggttatgcatttcatggttttatgtgtttcagttattggacctataaacatgaagaaaggcgggcctcgtggaactctacatgagttttgcaagaagcatctgtggccaatgcctactttcgatacctcggaagagaaatccaggtgacttctcattttggttccttttttctctgctctcatgtatcccgagtcctgaccaatctgagactgataactgcacagaactccgtttgaattcatagatggcggtgagaagcggactagcttcagcagtttcacatcgaccataaccctaaggatacccaatcgtgaggctgtgatgtatgctggagaagcaaggcctgacaagaagagttccttcgactctgcagtcgtggaattgctttatgagctcgagcgccgcaagatcgtcataatacaaaagtag

SEQ ID NO: 41 - DNA, 8812 bp, Arabidopsis thaliana
cgtagtttcaacgaaaaatcaatgctagaactgattcgtagtctagatgttccatccggtaagaacgatatttcactgtgtttttgttgtggcgtgttctttgcgttatgtttaaaatcaatttggtctcttcactgttgtaggaaccaaggcatttgtagcgaaatatattcatcctgaaaacgctattgtaaaaattactcatctctttttttttttacttcagtacgtttatgatatggattcgatacactgaaacatgattgtgtctttatatcttagactgcctacaatgatggacttggatgtggattatggacacttctcacatctagcatttctgttatttacgttactccttctacatgggacaaacattttaatcttagtatttggagtttggtgatgaatcttaactctcaaacttttatgatttcatgtctatcctcacatcaattgcaataaaaatatttgcttttctcttcgtaggatggtggcaggaaactcgcactggaaatgtttccatcacttaaattgacaacgaaaattgacgacaatgctcgagctaatgcactactcattgctgcatatggtcatgctacaagtgatacaagatattactcattttctcaaattaagtgacatatctaacatgtaaaaatgagtaatgttttggtgatttcacttatatattgcatctctttctctgctcctttggctttcagaaaattcttcactaattagaaaaaaatattttgtttattctttttccgtattcaaaatctctcaaaatttggtcatttttcgatttctatatttatctaattttcaaggtgagagttgttaatgtagtttggttatgatttaacccgaccgaaatcctcatgacctaacaaattataaataatctctgacaaaacaaggtaaattgtctcgggttgaaagagacattagaattagatgatattaacataagtcagcccctcttctacatttttagctttcttttagtcgaaaatcattccaaactcggaacatacattgtggtgtttatttgggaagaagtccacgctaaagtattttagtacatttctaccagattacccggataaataaaaaaagcgaagttacttacaacatgaaacagcttgcacattgaagaaaagtaatcaatcagcagtatatccaatgaatctatgcatcttgtcaggtccattgggccttagaggcctaaatatttgaagaaagagtaaaatcaaaaataaagtatcgaaaaaaggtaacccaaaaattaatatagtttgactaattttgttgcagtttttttttctagttaaaaattcaacattcgaaactcatgttctgacctcatttatacacttgcccagtggtcagtgcagaaaaagagaaaaagaatcacctttttgttttaatctcaaagtcgaaattcgaaattcctctactcttcccgttaagtgtgttcctttttatccgttcgtcatgcattcgtcgttggagccggagaaaatggaggaaggtgggggaagcaattcgcttaagagaaaattctctgaaatcgatggagatcaaaatcttgattctgtctcttctcctatgatgactgactctaatgggtatcatcatcttcctctctttgtacttgattttgggtcttatgggtttttagtctttttcactaaagtttactttttttttggcagtagttatgaattgaaagtgtacgaggttgctaagaacaggaacataattgctgttttggggacagggattgataagtcagagatcactaagaggcttatcaaagctatgggttcttctgatacagacaaaagattgataattttcttggccccaactgtgaatcttgttaaacaggcaagtctcttgtttgattgtaaaaagaaaaactgtttcatttggattttaatcattttgagttgatgatgttggctaatgagtcgccttgggagcttatttttgaatgttttattggtgtgtgtggttttagcaatgctgtgagatcagagcacttgtgaatttgaaagttgaagagtactttggagctaaaggagttgataaatggacatctcagcgctgggatgaggaatttagcaagcacgatgtaagtttctgtttctttttgtgtatatttggctagttatacgccaacaaagtgacttgcttgtagttttggtgattttatatcaaaatttctttgtgtggttagtgaaactttggcagaatgttgtaatccactttgaccagctcattgttgtattttgagtcatgaatgttctctgagttagttaaaagcccattccaatttgttacttttggggttggttcttcttccaatgctgattatttcttaattattttgtttgaacttgtttgcttgagcccttgacgtagatttgtgactgcattgatctcactaacagaatcacatacttctcttttgttgccgaatccacgtgagtctattatctgcaatgaaattatgttttgtatggttcaggttttagttatgactcctcaaatattattggatgtccttagaagtgcattcctgaaactagagatggtatgtcttctaataatagatgaatgccaccataccactggcaatcatccctatgcgaagttaatgaaggtgtgttttctcagtaatgataagctctattagttttttcataatagagtttccataacttgtcaacgaactagattctttcttgttttcatgaaggaattctatcacgaatccactagcaaaccgaagatatttggattgactgcgtcagccgtcattagaaaaggcatgctatttaaaagtttcttatttcctctgtatgccaaaccaaagatcctgcttcctgtaactactttttaatgtttgaacttcatgtaaggaacataaactcatactacaagtgtttcctctccctctaactatgcagctcaagtatcagaacttgagagactcatggactcaaaggtactttgtttttgtgtaacaaggaaacagatatagtttacaaattaatgctatgcaatcttactttgaattcagatttttaatcctgaagagcgtgaaggagtggaaaagtttgctacaacggttaaagaaggtccaatattgtataacccatcaccatcctgtagtttggaattgaaagaaaagttagaaacttcacacctcaaggtatataatatatgctcactgaatatgatccagaacatgactctttcctattatgtttcagagtgcttgaaaaatattctgttttttttcgtacagtttgatgcttctcttagaaggcttcaagagttgggaaaagacagttttctgaatatggataataagtttgagacatatcaaaagagattgtctatcgactacagagagattttgcattgccttgataatcttggcctgatttgcgcacacttggtatttttctaccagtttagtttttattaccagttcttcatttgcttactcattgttacttttttctcccgctagcatacctgttgtgctgattatttttcttttttttttcatcttgctttcgcgataggcggctgaagtctgcttggagaaaatctcagatacgaaagaggaaagtgaaacttataaagaatgctcaatggtgtgcaaggaatttcttgaggatattttatccaccattggggtgtatttgccgcaaggtaatgtattcaaagctctatattgcattgagtcctcttctagtcactaatttttacactgtttatcatttgtgttatttaacagatgataagagtctggtagatttgcagcaaaaccatctgtcagcagtaatttctgggcatgtatctccaaagctaaaagaactcttccatctattggattcctttaggtaaatttaaattgtttatccaactcccaaaattgcaccaagatctccatctgttctgacaatttcaatttgcttgcagaggtgacaagcaaaagcagtgccttattttagttgagagaattataactgcgaaagtgatcgaaagattcgttaagaaagaagcctctttggcttaccttaatgtcttgtatttaaccgaaaacaacccctccaccaatgtatcggcacagaaaatgcaaattgaaatccctgatttatttcaacatggcaaggttacctgttcttcatcacagtcagatgttttatagattgagaaatgtttttattttgtcttctctgaaagctttttaatgcatgtaggtgaatcttttattcatcacagatgtggttgaagagggatttcaggttccagattgctcatgcatggtttgttttgacctgcccaaaacaatgtgtagttactcgcagtctcaaaaacatgccaaacagagtaattctaagtctatcatgtttcttgaaaggtaggaagcaatatttatttaacacaaaatgtttaccaaattccagtttttgtagcttatttctgaatactaattattgtagagggaacccgaagcaaagagaccatctgcatgaccttatgcgaagagaagtcctaattcaagatccagaagctccaaacttgaaatcgtgtccacctccagtgaaaaatggacacggtgtgaaggagattggatccatggttatcccagattctaacataactgtatctgaggaagcagcttccacacaaactatgagtgatcctcctagcagaaatgagcagttaccaccgtgtaaaaagttacgcttggataacaatctcttacaatccaacggcaaagagaaggttgcctcttctaaaagtaaatcatcttcatcggctgcaggtatgttttctaatttattaattcgtcaattagctggtgtcgctgattttagtctttagttcctctatcagccgctgttgtatcacacacatacacgcacacatcagcagttgcatatcatatgtctatgtctaaggtcatggagcttgtcttaatttgtttatttatgtatacatttctttttcttttcgctgaacaggttcaaaaaaacgtaaggagttgcacggaacaacctgtgcaaacgcattgtcaggaacctggggagaaaatattgatggcgccacctttcaggcttataagtttgacttctgttgtaatatttctggcgaagtatactcgagtttctctcttttgcttgagtcaactctcgccgaggatgttggtaaagttgagatggacctttacttggtcaggaagcttgtcaaggcttctgtctcaccttgtggccagatacgtttgagtcaagaggaggtacataactctgatccctagttataaacagtttcttgtttcatggtttgaacttgatgtcttcttctttgtgttttggatgcagctggtcaaagcaaaatattttcagcagtttttctttaatggcatgtttggaaagttgtttgttggatctaagtcacagggaacaaagagagaatttttgcttcaaactgacactagttctctttggcaccctgcctttatgtttctactgctaccagttgaaacaaatgatctagcttcgagtgcgacaattgattggtcagctatcaactcctgtgcctcaatagttgagttcttgaagaaaaattctcttcttgatcttcgggatagtgatgggaatcagtgcaatacctcatccggtcaggaagtcttactagacgataaaatggaagaaacgaatctgattcattttgccaatgcttcgtctgataaaaatagtctcgaagaacttgtggtcattgcaattcatactggacggatatactctatagttgaagccgtaagcgattcttctgctatgagcccctttgaggtggatgcctcatcaggctatgctacttatgcagaatattttaacaaaaagtaagtgatattctagctttggctgttctttcaatctacttatcataactctctagttaatgttattcccttttaatcaggtatgggattgttttagcgcacccgaaccagccgttgatgaagttgaagcagagtcaccatgcgcacaaccttttagtcgacttcaatgaagagagtaagttgattcttgagaatttctccaacatatggaatcattgtgtatgttctcatgatattgtagtgtgtgagctctaagatgttgtttccaatgtaaatggacagtggttgtgaagacagaaccaaaagctggcaatgttaggaaaagaaaaccgaatatccatgcgcatttgcctccagagcttttggctagaattgatgtaccgcgtgctgtgctaaaatcaatctacttgctgccttcagtgatgcaccgcctagagtctctaatgttggccagccagcttagggaagagattgattgtagcatagataacttcagtatatcaagtacatcggtatggtttttgaaaactatctgtcatttagagatgaaactagatatcttgattgtcattaaactcttgtcttggttcaataaatcagattcttgaagcagttacaacacttacatgccccgaatcattttcaatggagcggttggaactgctcggggattcagtcttgaagtatgttgcgagctgtcatctattccttaagtatcctgacaaagatgaggggcaactatcacggcagagacaatcgattatatctaactcaaatcttcaccgcttgacaaccagtcgcaaactacaggtatcttctaacatttgcaagtaatgtcttacatcagtcagaacaccaaagaaatatctttccatggggattggtttgatagggatacataagaaatggcgcttttgaaccgcgtcgctggactgcacctggtcaattttctctttttcctgttccttgcaagtgtgggattgatactagagaagtaccattggacccaaaattcttcacagaaaacatgactatcaaaataggcaagtcttgcgacatgggtcatagatgggtagtttcaaaatctgtatcagattgcgctgaggccctgattggtgcctattatgtaagcggtggattgtctgcttctctccatatgatgaaatggctcggtattgacgtcgattttgacccaaacctagtcgttgaagccatcaatagagtttctctacggtgttacattcctaaagaagatgagctcatagagttggagagaaagatccaacatgaattctctgcaaagtttcttttaaaagaggctatcacacactcctctcttcgtgaatcctattcatacgaggtatgacttcatcattttcaacccctgcattatttggctgacttattcccaggtttccaacctcatgctatcatttttttcctcaaacagagattagagtttcttggcgattctgtactggattttctaataacccgtcatctttttaacacctacgaacaaactgggcctggagagatgaccgatcttcgttctgcatgtgtaaacaatgaaaattttgcgcaagttgcagtgaaaaataacctgcatacccaccttcaacgctgtgctacggttctcgagactcaaataaacgactatctgatgtcctttcaaaagccagatgagactggtagatcaatcccttcaatacagggccctaaggtaaaaaatatacttgcatgaccatttaaagtccctgcctgagatttcagattataaagagagcaaataggttgacatacttgtctattttggtttaggctcttggagatgttgtggagagtatcgctggagcattgctgatcgatacgaggttagatctcgatcaagtgtggagagtctttgagccgttgctttctccacttgtaactccagataaacttcagcttcctccataccgggagctcaatgagctatgcgactctcttgggtatttctttcgagtgaaatgttcaaatgatggtgtcaaagcacaagccacgatccagttgcagctggatgatgttcttttaactggagatggatctgaacagacaaataaactggccttgggaaaagcagcttcacatctgcttacacaacttgaggtatatatattctgatgtttccacttgcgtgtgtgttggtgtgtgtgctcaaactttctttggttcttcagaagagaaacatttcacgtaaaacctcgctcggggataatcaaagttccatggatgtcaatcttgcttgcaatcatagcgacagagaaactctgacttcagagactactgaaatccagagtatagtgattccatgtaagcactgttatttacctagagagattcttcttttcttcttcagtttttttttttttttgtatcaagggttatgcatttcatggttttatgtgtttcagttattggacctataaacatgaagaaaggcgggcctcgtggaactctacatgagttttgcaagaagcatctgtggccaatgcctactttcgatacctcggaagagaaatccaggtgacttctcattttggttccttttttctctgctctcatgtatcccgagtcctgaccaatctgagactgataactgcacagaactccgtttgaattcatagatggcggtgagaagcggactagcttcagcagtttcacatcgaccataaccctaaggatacccaatcgtgaggctgtgatgtatgctggagaagcaaggcctgacaagaagagttccttcgactctgcagtcgtggaattgctttatgagctcgagcgccgcaagatcgtcataatacaaaagtagactaatttagactgtactatatatgattc

SEQ ID NO: 42 - DNA, 8783 bp, Arabidopsis thaliana; identical to SEQ ID NO: 40

SEQ ID NO: 43 - DNA, 4952 bp, Arabidopsis thaliana
agttatatattaccaatctttggcttgtccaacttttggttagcctctatttccaggtgagagtggagttgaccagctagttgagataataaaggtacttcaatttggttaaacaaacacacataatcctagccattgctatattgaacatagagtggatcattgattatatggaatgaagaggctccatttcctgctattgattgccatcattttgtttactgtgtgtgttacaggttcttggaacaccaacacgggaggaaatcaaatgcatgaatccaaactacacagaattcaaattcccgcaaataaaggctcatccttggcacaaagtaagcaaacacatcatcagtttttccttaacattgatctccatatattcttacgattgaaaaatctgttgttggttcttaagatattccataagcgtacacctccagaagctgtagaccttgtctcaagacttctccagtattctccaaacctcagatcaaccgctgtaagtcaatgaagtgattaccataataacattatgtttgatatatctggttggttgattcaaacttacttgttattgtagatggaggcgatagttcacccgttcttcgatgagctacgtgatcccaatacacgtcttcctaatggtcgtgccttgcctcctctcttcaactttaaacctcaaggtctgtctcctccaaatatgcttttgtttgtttcccaatgctccgttttaacaaagactaaaagtgtgtgcttcttgttaaatatgtagagctaaaaggagcaagtttagagttgttgtccaagcttatacctgaccacgcccgaaaacaatgttccttcctcgctctctaaatctcttcctctctctctatatatatgtgtgtgtgtgtgtatgtacacatgcatataatatgcttatcgtttctaagtaatggagatagcttctcaggattatcattagctttcatctttcatgtatctttgttgtttattgtcttatcacaacctttgtactttattacatacaatgattagtgtaatgtatgtgacggtctttgactcgccggtcgctacagttatgttggatactaaattataaaataaacttctcgctcgtcacgtgtcattgcatgcatccaaagctcatgcttcaaagcttagccaaacttatttttaaaaaagcctatgttctgtgtaaaagtgtcatttacgagagtttcttgtttaagtttaaccaatttcacttcctcaaacgaaatacggtaattggtaatatcctctaaacatgaattatcattgactataaaaattagtttcgcaaattgcctctaagcaccacaagtgtcacgtaacgtgtcatttattcatgtttattgatttagttaattaaaaacattgtagtttaattattgaagtagtacaaagaatagggactaaattgcaatactctgaatttgtttttttcttttttagaatcatccgactttttgtttcacggtttcctcctccagtaaactgacgacgatacaagctctctcaccaacggcgacagtatctttgccggcggcgggagcgcttctgcttaatctgtagctcaaactaaaaattctctgggtattactcatggtgatttggaataacgatgatgatgattttttggagattgataactttcaatcttctccacggtcatctccaatacatgcaatgcagtgtagggtcgaaaatctagctggtgtagccgtggtaagtgatccaatccaacagtcataagtttatgcctaagcagaatcattgcttatgtgaatttttgttttgtttcagacaactagttctttgagctctcctactgagacaactgatttagttcagatgggcttctcagacgaggtttttgctacattgtttgacatgggatttcctgttgagatgatttctagagcgatcaaggaaactggtgaggcttttttctcttgtttgtattcctttctggatatatatgatccgtaacttgataccaataattatacaggaccaaatgtagaaacttcggttataattgatactatctccaaatactcagtgagtttctaatactttgatctcttgggttgcttgtcatttacatgtgcttctgtcatcacagtattcatatcctctcctttgtttatttgtgaagagcgactgtgaagctggttcttccaagtccaaggctattgatcatttccttgctatgggatttgatgaagaaaaagttgtcaaagccattcaagaacatggtacttacagatttctctcctccttaagtaagaagtaacactttatcactttgctgatatttgctttataaatcgcaggagaagacaatatggaagcaattgcaaatgcattgctctcttgtccagtaagcgatgttacgaaaatatactgtctcttgacattaaaaaaatagtacttaaagttcgttgatggtttgtaggaggctaagaaactgccagcagcagtagaggaagaagatggcattgactggtcatcaagtgatgatgataccaattacaccgatatgttaaactcagatgatgaggtataactctttcatgttggtgataacatatttaagcatcccaggtttgaattgtaaatgtatctcactgctattttgtatatgtatctaattttatgcgttcttaatctattttaaatcatgacagaaagatccaaactcaaatgaaaatggcagcaaaatacggtctttggtgaagatgggtttctcagagcttgaagcttctttagctgtcgagagatgtggtaactttattttaaacgattgccattgtcattaaattttagttccgttttgttcaggtttcttctagacaacgtcgtataaattgcttggtttagcctctgatttagtggtgtaggccttagatgtgtttgctgagcattttgattgtatttcactaatcgaaagttgtcattagttctgtcttagcttctggttctgtgatgtacgccttagatatgtttgtagagaatgtgatcgtatttcacaaaatgataaaagttgtcagtacttgataaaattgtatgttcactagttcctttttattcaggtttcttctagaggaagtggcataagccaaattgcttagttttagtgtaatgtgatagtcaaattgtggctttagcctctggttctgtgatttaggcttgaaatgtgtttgctgagcattgtgattgtatttcactaaatgatacagttgtcagatgttaatatatatctcttacttactctaagtatgttgctgccttatccagactcatatgattgtaatttcaggagaaaatgtggatattgcagagctcacagacttcctttgtgctgctcaaatggctagggaatttagtgagttttacactgaacatgaagaacaaaaggtactgttaaaaccttttttataatctatcttttgtaagttaattcctttgggaactgattattttgggaaatttggtgtatgcagcctagacataatattaagaaaaggcggtttgagtcaaaaggagagccaagatcatctgttgatgacgagccgattcgtctaccaaatccaatgataggatttggggttccaaacgagcccggactcattacacatagatcgcttccagagttagcccgagggccaccttttttctactatgagaatgtcgccctcacacctaaaggcgtttgggagactatttccaggcacttgttcgagatcccacctgagtttgtggactcaaaatatttctgtgttgcagcgaggaagagaggctacatccacaatctccccatcaacaacagatttcagattcagcctccaccaaaatacaccatccatgatgcatttcctttgagtaagagatggtggccagaatgggataaaaggaccaagcttaattgcattttgacttgtacaggtagtgctcagttgactaacaggattcgtgtagcccttgagccttacaatgaagaaccagaaccgcctaagcatgtacaaagatatgtgattgaccagtgcaaaaaatggaatttggtttgggtgggtaaaaacaaagctgccccactcgagccagatgagatggagagtattctgggatttccaaaaaatcatactcgtggtggaggcatgagtagaactgagcgcttcaagtccttaggaaattcgtttcaggtaattttacatatcatatgcgtaataatactctttgtagttaaagtcttttgcgtatttgattcattggtgggtggcttgaataccttggtttaatggttggttgaacttgttttaggttgatactgtggcgtatcatctgtctgtcctgaagcccattttcccacatggaatcaatgttctctctcttttcacgggtattggtggtggggaagtggcacttcatcgtctccaaatcaaaatgaagcttgttgtgtctgttgagatttcaaaagtcaacagaaatattttgaaggacttttgggagcaaactaaccagactggagaattgatcgagttttcagacatccaacacttgactaatgacacaatcgaagggttgatggagaaatatggtggatttgatcttgtaattggaggaagtccttgtaacaatctggcaggcggtaatagggtaagccgagttggtcttgaaggtgatcaatcttcgttgttctttgagtattgccgtattctagaggtggtacgtgcgaggatgagaggatcttgatcattcacattacctgaagtagattgaagtagatatgactccatgaaatctagttgaactttatttttctatatctgttatgtaatatggccatgaaggtacatttttgaataatataagtcaacctaactctcttttgctttttgcgacaatatatctgcaactgcatttgcact

SEQ ID NO: 44 - DNA, 4785 bp, Arabidopsis thaliana
acttagtctatatcaaaattatagaacaaatttcgagaaacagaagaagagaagaagccatgaagctaactagtacagtcacaaaaggacgacaccgtttcgaaattgggccagagacaaaactaaactggatcttaaatcagcccaagccgttaactataaatttgttacattagtcacggactcacgtgtcacgtccttcgaaaacaacgtatccgcacgtgacatcgccaccggcctttttttttttttttcacaccgcacgaggaagtttaggtttcttcaaaatcacaaaaccaaacaacaacaaccaaaaaaaaaaaactcaaaccattttctctctaacttctctgtcatttctctctctagtggcaaagtatggcggattggggacctgttgtagtcgctgtgatactgttcgtgcttttgactccgggacttctctttcagattccggcgagaggtcgtgttgttgaatttggtaatatgcagactagtggagcgtcgattctcgtccacaccatcattttcttcggtcttataaccatcttcaccatcgccattcgtctccatatctataccggttaatttcaccgtaccggattcgtaacttcccccggttgtctagttttatggtttgttttggattttgtttcttctctgtgtcttgtcaaaacgttatgaatttgtgaatctgaatatgcattaagttaatttcaaaattcgctatgtttgattctcggtttggtttaaatctggttatggcgttgatttgaatttgatggtaggcactaggcagttagccttagtttggtttattggtattcgagttcaaattggaattgagtactaaaatgctctgttactcatttctgcatcttgagttcttatggatttgcttacgaaatgttcaattttgtttggtctggttcggttcgttctgaaacgaatgtcgagagtcttttgcttgactcgaaacttgccttgtgtcagcgtgtaggggtttgtaagaataaaatgggctttaaaattaagttattaatgggccaacacatgatccaccaagaagaagtgatccggttgcatcttagattctcatgtgatgtgattgaacgttgaaagtgcacagaagtagacctgtttaaagatgtttcacactttcactgcgtactatgtaactagtggagtcagtcccgtcatgcgtatgagtaaagcgcgtcgataccacgggaacacacaaaaacatgtcaccctagtaaaaactgtgttcgttagctcattgtaaattgcagtatatggcataaacaattgtttctacaaattccaagaatgtaagaatcaagacaataaaatgtgactatatcaagaacttaactaaagtttcatccacttaaatgaaaaagttgatttggatagaacaaaagacgtaatattcgatgtgttctctctctctcccatctttacttttattgactttttattttcactttaatgtgtgatgtaaaaataaaaagtaattatttgttcaaccctaggtgaaataaaggacgacccaaaacaagtgacgagagagcagagagagcttcttcttccggacactgaacagtgagagcacccatctccaacctcttcctgtaagtttccccaactactctgtttcttaaatgttctgcgttctttaaaacaaagtatagaagatttaggttgtaagatcgatctcgtttgatttcaaactcactatctgaaactctttgattacaaacccatcttcataatctctgtaaaaatcaaacatgcaattcacttaatggtgcaaaaaccccagaagagggaaaaaggaatcaaatttagtttataaaagcagtggaattgagttgcattgttgaaatattcaaaagcaagatcagatttttgataaagaatttcacttttgattgcaacttataatcaaggaacaagatgggaagcactgtgattttaagctcagatgatgaagattcagatattagtgaatctgaaatggatgagtatggagacaaaatgtacctaaaccttaaaggtgggaagctgaaagtgagactctctcctcaagcttttatctgtccttattgtccaaacaagaagaaaactagttttcaatacaaagatcttcttcaacatgcttctggagttggtaatagcaattctgataaaagaagtgcaaaggagaaagcaagtcaccttgctcttgtcaaataccttcaacaagatcttgctgattcagcttcagaagcagagccttcatcaaagcgtcagaaaaacggaaaccctattcaagattgtgatcatgacgagaagcttgtgtatccttggaaaggtacacactttaaaggttcttacttttctccttaagattgtactgcaatgtgtgtttagtgtttgtgtatatgtggttgaaacaggtattgtggtgaatattccaactacaaaggcacaagatggtcgatctgcgggcgagagtggatcgaagctaagggatgagtatattctaagaggatttaacccgactagagttcgtcctttatggaactacttgggacattcaggaacagctattgtggagtttaacaaagattggaatggacttcacaatggtcttttgtttgacaaggcttatacagtagatggtcatgggaagaaggactggttgaagaaagacggtcccaagttaggtctttacggttggattgctcgtgctgatgattataacggtaataatattattggagaaaacttgaggaagacgggtgatctgaaaactatagctgagcttacggaagaagaggcgaggaaacaggaattgcttgtgcagaacctgagacaacttgtagaagagaagaaaaaagacatgaaggagattgaggagctttgttcagttaagtcagaggaacttaatcagttgatggaagagaaggagaagaatcagcaaaagcattaccgtgagctgaatgctatacaagaaagaacaatgagtcacattcaaaagatagttgatgatcatgagaaattgaagaggctgttggagtcagagaggaagaaactcgaaatcaaatgtaatgagttggcaaagcgcgaagtgcacaatggaaccgagagaatgaaattgtctgaagatcttgaacaggtatccatttactctctgtatctctcttttcaagatatatgttcaagaaataattggtttttttctcttatcagaatgcatctaagaatagctctcttgaactagctgccatggaacaacaaaaggcagacgaggaagttaaaaaacttgctgaagaccaaagggttagtgactttcttcttctttgtaaaaatggttgggcttattttcgtgattactgagaaaattctgtacctaacagaggcaaaaggaggagcttcatgagaaaatcataagactagaaagacagagagatcagaaacaagcgattgagctagaagttgagcagttgaaaggacagctcaatgtgatgaagcacatggcatcagatggcgatgctgaagttgtgaaagaggtggacatcatcttcaaagatttaggtgagaaggaagcacaactcgcagatctcgataaatttaaccaaactcttatccttagagagcgcaggaccaacgatgagcttcaagaagctcataaagaattggtaaacgtatgtatcattcaaagtgttgttcttttcaatcacatcgaaaagctatgagaaagcttgacattttactaaaatcttggttttgtttgtttcatgtgccttcatagattatgaaagaatggaacacaaatatcggtgttaagagaatgggagagctcgtgacgaaaccattcgtggatgcaatgcagcagaagtattgtcagcaagatgtggaggaccgagcagttgaagttctccaactttgggaacactatctcaaagattcagattggcatccattcaagcgggtcaagctcgaaaatgaagatagagaagtggtaagaccgccttcttgactctgtttgttatgttgaatctctctgaaagattaaaaagcttttttggtgttgttgttaattgtgtttaggaagtgatagatgatagagacgaaaagctgagggagctaaaggcagatttgggagatggtccttacaatgcggtcacgaaagctttgttggagataaacgagtataacccgagtggaaggtatattacaacagagctatggaacttcaaagcagataagaaggctacacttgaagaaggtgtcacttgtttacttgatcaatgggaaaaggcgaaacgcaagcgtggaatggcttagaggtttaaccatttttgataaccgaacaaaaatatgttttcatttgcaattgttatttgctaatataggatttcgattgatggtttgcagctgcaagatgatggacatgggactgaataaaaagccgatgcggtttttagttgcagagaaatgtgtttggtttgaccaaactttggtggattctgtttgtttttcttctcagaacttagtgaataattgacacaactttgatgtcttgcatcggttcttttcattgtaacatttgtaggagtttggccgctttggacaataagaaataaaaatatcattgtaatataattcacatgtaaaacaactagatttggcctctcttctgtctcatatcttaagcatgtcatttagaaccttttattgtaaaaacaaactttgtcatgagttactttttgtagtcaaatttgatattgacccctt

SEQ ID NO: 45 - DNA, 3482 bp, Arabidopsis thaliana
agatttttataagctcttgattccactttgtaatataaaattaggtcgggttttaggtctctctgacgtgattgattttaatcaatctaattttaattaatcggtgtaattgtcattatttagtattaaagataattgtctgtgtttagacttcaaatatattcaaatatagaggaaaacagtttgtaattgtttagtagatttgtgtatcccatccacacatacagtatagcgtaaggtgtatatatatgtatgtatgacattaatttgtgtagatatgtatgtatgacattaatttgtgtagatatgtatgtatgtatccacataatcaattttctatctgcaacgtataaaattgtaaattttattttagttttaatgtgttctatttaaattccagttaaaaaatcgaacacaaataatgtttttgtgtaatatcatgtttaagtataatatcatgtttatgtgttctttcataatcaagtgaataatgtttttttatatctataaatacgaattagaaaacaaaattcgtaagttaatcaagaatattataccaaataaatatgtgttcaaatataaccctgtacaaacgttttaagtacgggtacggatattcaatctaaattcattttccgttctctcatacgttgaactaaattttaaccattctcagataggtaattaatttaaatgaaataattatgtgatgagaaatttcaagataggcaaagagacgggacatgactaatctactcactcattttatctacactcaattgaaaccaaataaaacaccaaaatgatatgaattcaaattatgagtattataccaaataaatatctacacatattatcctacacatacgtaagatctaaatttatatatacgaccaaaacaacaaaataatctatatcattttaaaaaaatatgaaatatgcacgtatgtgcggggcagaagctagtgtgttatataaaaaagtagcatattgacaaagagagatttccaattatcacgtgtaattcgaaaaagtagcgtggtataaaagaaaataaaacaaatttaaaaaaaaaaacataacgacggagattccaaaaaagaatcaaaatcgaataaaataaaatgacaaatcttctgcaaattgagggagagatgatttatcaatataaataacatttggcagcctagatttatcgaaaaagagatcgggtggatgagatggtggaagatgtggtggttgtggtggtggaataaagagagatgagatgattctaagtgttctgtaaatttttggaaaataacatgtaatatatataaaatacgaaaatgggtaaaaaggtaattgcaagtgaagaaagagggtgtactctgacaccgtagctattttgttaattcttttacaattcatagttatctagtacatattctctaatttttatgtcaacattttgggttataatttttaaaaaaattcttaaaaagttttctcccttttttctctcttaaaaaattcttaatggcatggagtcttcagttactaagagccggcgaatactgtggaagaagcacatggtgttgatttgaccaagcccgaccgccggagcaaggtggatcgtggatcaaccggcgccgttgtgtttcaacatctcttcatctcacgttagacatgtgtctgctacgtggcactttattttcttaaccttatctttaaatttgggtgggttaagctggaccttagatttaaatcaaagttgtaaatggtaagagatcggactttttcaccagcatatgtaataccctttattgggctttaataattaatacgaaacttggccgacaaaaagaaaaaaaaactaaaaaaaaattcctaatattttcattgtaaatagaaaaaatacatacataatacaatttatatatgtatataagaagaaagtaaatattagaagttttagaacttgagaagaaagttcacttttttttatataacataaccgtgtttatgtttgtcacaatagtacatataaaataataggtgaaaaaggttatataaataaaaaaatattaagaaggatttttagaaggtacatatcaatttttttataagaaaatcagaaatgttgaaaggtaagagtaataactaaaccaagatcattaagcatgacatcagacagaaattggagatggagattcaagagctaaaaggcaaattccaagtgataaaacatttaggagatgatgatgatagcatttgataacaatgttccctcatgtttacacacttgcatttttcttttaacaaaaaaaaaaacacttgcatttttccattatatagcatttgataacaaagttcctaagaagttattctctttttcgcatctgaagtgctgtaaacatgatcaaacactctagtttgttgaatacttcagttgacaataaatttatttgatggggatggagtgaagatgaattctcatttgataaggttaagaggactatgactgttgtggatactaataaaattcacaaaaacttaccgcaataggttttctaagataatacatactgtctttaacaagaaccaaagttggaattatctatgtgtgattaattttggcctatgttagttttaatttgaatatttaagtactttttttccgagtttgactggattgttgagtatccatacaatatcaataacatgataaaaaaatttggagaaaattgattttaaacctcttcatgaatgtttgcaagttgagacattctgaaaatgaagctctggttaaagctaccatcctttgctttacatagaaggagaatctcaaggattcatcatggcatccattcaaacataaaggaaccaaggacaaatcaaatatgtgtctttcctgctgtctcatcccattttaagagtgtttatatccctgatttatgatttacgttgacgtcattttgactttgaaaagtgtttggtcattcatacactttctagaccactgttttaggtaaatatgtaggagtagtaacctgtgattatgtgaatgttgatacttgtatccatattccatatgttggtgcaactggttgtgagttagcagtaatattgtaatagtttgagatgattatggttataggatctggttaacgaagagtatgagcccctgaagaagcttaaagaaaaatggggagaagatgtgcataatactttaaaaataacaatcaaggatatggatgagtataatgcatgtggtaagtacccaactccagaactatggaactttaagaaaaaacttaaatcaacactgaaggaagtgattaaattccttttgaatgacatcaagagtctaaaacgccaacgaatctgtaggtgtgttatatcttttttggttgacataggtctccttatagagtttatatatctaatgtgctagtttaaaccaacataaaccccatatagttttagtgtataaggtttag

SEQ ID NO: 46 - DNA, 3608 bp, Arabidopsis thaliana
aatgtctaccgattaaatttttcaggctcgttcaaaagcaatagcacaaagtcgatgaagacggcttctagttctcctgatagatcttctgtagcaatgtattcatgctctcccgatagaggtaacaatgtaactttttaatctaattaatcatagtacttaacaaaaattacaatttttataaacttattgtcttactaacagattcagtcgaaaacgaaatgtcaatgactatacaatcagtgacaagcaatagcgcaagctcagaaacaaatatattagccacaacactcagtgacctctttcacaataggtaaagcattatcctactcctatataacaacattgctagaaatttcacatcaaaaaaaatatatatatatatctaacttttcttgtttcagctcaaatatcaattttgggatgaagattccagcgagggcacggcgagtgacgagagaaaccggagaagaagaatggtacaatgttgttttgtatatagggatagtagacacatttcaagactatggtatgaagaaacgcatagaacattgttacaaatccattcaatataactcaaactcaatctcaaccgtccatcctaagatctactcttctagattccaagactttgtctccaacatcttcctacctcacgacgatgatctctcttcgaaatattgagttgtttgttatttttgatttccaagtggaattattagagtgttaagaggtacacttcttacgacccaagttggtgttggtgtttgttgtccaaaaaatcctctcttttctgacttcattgttgatcgatcaacaaaatgtagagaaaaacatgaactattaatacacatatatcaaaaatataaaatacagaaaaagacaaaacccaaaataaaaaaaacccaacattgttcttggttcaacacaaaagaaaaaaccaatcaaaccaagtcaaccctttaattaaaactttcagttggaacatatatatctctgtttactttgttttgttaatcacaaagcagcatttagaacacttacagagattagtcttgtatgtctacattgttactctctttagatctcttagagattaggtttagccagttcaacgtttttctccttaatctctaaataattcttctgttacaacattacaacatatttaatatcttattatccttaacctaacaacttttatactaaacaaaacaaagccatttctatttgggctttacttatcttatggcccaattgacttttcttctttcttctttttcacgacgcttcttcttcctcctcgtacaacgggcttcttcttcctccattacttactcaagtatcttttctcttcatcatcttctcatctttctcttcaagtttctcttgtatgatattaagcaattaatagattccaacatagtcatgtttctgcgtttgattattgttcttggaagtataatctgaattggaaatctcttttattgcaggtttaagatgaagaagaaacaacaaaagcaggaatttgtagctgagacatcagagatgaacaacaacaacgagtgttctggacaagaccaacaaaaacgatatgtgtggccatgggttggtctagtagccaacgtaccaactgaggtggaaccatctggtcggagagtaggcaaaagcggttcaacgttacgtgatgagttcactctgaaagggtttaatccaacaagagtcaaacccatttggaataccaagggacatactggttttgctttggttgaattcgctaaagactttaaaggattcgaaagcgccatgcaattcgaaaagagttttgatttagaccgtcatgggaagagagattggaaaaaaggtaaaacattgtttttaaaagtcatttgcttttattgacattgatagagttcactttctttgtttggaaaaggtcatcgcttgagagatgataagctttatggatggcttgcgagagaggatgattataatcgaagtgatactgttgggaagaatgtcaagaagaagagggatttgaaaagtatctctcagattgtagaggaagaccagaggaaactgtatcatctatttgagaatatgtgtcaaaccattgagaagaataagcaacgtaaacaacagcttgaacagaaagttgatgagactttggagagtttggaatttcataaccttatgttaaacaatagctaccaagaaggtaaaacagaaacactttaataagctttctgtttgtgttttcatgctgacatgtgtattcttttggtttgtttgtttgttattttgatgagaagagattcagaagatggagaagaatatgcaagagttttatcaacaggttcttggtggacatgaaaagtcttttgcagaactggaggcaaagagggagaagcttgacgagcgtgcaagattgattgagcaacgggctatcaaaaacgaagaagagatggaaaagaccaggcttgaaagagaaatggtgattatgctttccttacaaattaggagaaaaatatcacaaggcaataaaatctttcttgttgttgttgttgtagattcaaaaggctatgtgtgagcagaatgaagcgaatgaggaagctatgaaacttgcagaaaagcaccaggcaagtacttctttagtgtttctttagttatgaacaagtaataactaacaacttttgcagaaagagaaggagaagcttcataaaaggataatggaaatggaagctaagctaaatgaaacgcaagagcttgagttggagatagagaagctgaaaggtactacaaatgtgatgaagcatatggtgggttgtgatggagataaagatattgtggagaagatagccaaaactcagatagagcttgacgctcgagaaacagctctccatgaaaaaatgatgactctcgcacgaaaagaacgtgcgaccaacgatgagtatcaagacgctcgtaaagagatgattaaggttcgaaaacgttctaaatatatctgttccaaactctttggcttgtccttttaacttgtggaattacttttgatgatgagcaggtatggaaggcgaatgaagagttgatgaagcaagagaagattagagtgaagataatgggggagttgaaccctgcacccttcttgcctgcagtgatgaacaaacataaggctatgatgctgtgttcagtgtgggcagcagagataggagatgtgcaatggactccatttagggtcgatgagtctgatggaacaccaaaggttaggactttaacttaggagtctacactttcataaatctcaaaagatgggtttgtagcaaaaattacatatatctcaacattccaaatgtgaaatgcagagagtggtggatgaaaatgatgagaagcttcgtatgctgaagaaccagtacggtgaagaagtttatagtgaagtggtaagagcaaagctagagatggaggaacataacgctagtggcagctatgagactgaagagctttggaactatgaggagaaccgaaaggcgactatcgaggaaataacagatgtgatgttgaagataaggtccaaacttgctgctatgaagaacaaacgaaagaggccttga

SEQ ID NO: 47 - DNA, 4488 bp, Arabidopsis thaliana
gtaaaaaaacttaaatgattttggcgtaacaacattgtggctcttgtggatgtttataattgaatacctagctttacttttgttggtgttttcaggaaactgaatgtccagtggaggtgatggagaagtttgaactcgtaaatgtgcctcggtgtttcgtatcgactcttgaacatgttgagataaaaggattgtttgactggggggaacaggatatgaaaatagcgagttactttctcgaaaactcagcagtcctcaagaaactgattctgagtttcatgggttgtcctcaacattattcggaatcagatatctacgaggaacttaataaactcacaaaacgttctccgagatgtcaaattatcattagatgctgaatgaggccatgagtatcatgtgtagaaagtctgttttctcatgaaacactgattttttaaagatcattttgttcttcttcttagttttggttggattccttgaccataaaactcggtcatagaacgaaaacattgttgtttttttaattttttcttaatctcaatctcagtttcttatgatctattggattctctgaagaaagtgatattattacactggacactggtagtaggaacattggactaaaggatctactctcatctgaaactctttgcgcttcctcctagtatattgaaaatttcggttaactcggtaatgaaaaatccaaaccaatcaaagctactgtataaacaaaatttcaattgaattccggttaaattaataattttgattggtttaattcggtttaaaatgaattgaagacgccaatcgatcgtcgtcatcttcactctttctttccagtcacggtttacgcgtctctctatctcccacctgcgattcttctccattatctttgctaattcagaaggtttcgcttcagcttcctcatctacattcttcgcttgtttcttatttacagacattttacgacatttttctgatactgtttcggtgaaattctctaatttcgtttagttttgctttacaatgttcttcattttgtgtctctcttcgttcggtttttgctctgtagagacgcaatttccattttattcttctgatcttctcttttttttttttccggttggccatatacagttagggttttcagttttcactggttttgttctcatcttcctctttaacggaaatttgtcttcttgtaattactgggtcttgttcttactcatcttcttcgtctagtttttgaaaagttgtgatttttagtaggtttctgcaattgggttagtcaatcttcaggtttagggtttaagaataagggtttatgctatgatgatcattgggactagatgaatataactcaaattttgcaatgccactctgcataactatgaaaactatctcattctctcttatttgtcctgttttttttaagctgattggatttctaaccagcttctttttgttttactatgggatgtttatgtgttgtaggttgcaatgtattccagaagagagctggaagatttggagtacagatactacagtgaaatgaaagatggtacaaggaaagtcaaaatctcagagtctctgttcaggtgtcccttttgttacatagatcgaaagcgtgattaccagtttgatgacttgcttcgacatgcttctggtattggcggtagttcccgcactaaggatgggagagataaagctagacatcttgctctggagagatatatgaggaagtatctccgccctcgagaaagaccacgtccttctccaacttcagatgtctcttctcttcctaaagaggagtttactggaaagtggaaatctactttgtcaactactgaagaaggagaattcataactactgaaaattctagttcacctcatattgtcaaagctgaaccaaagtttgtctccggagatgattctggacgtagtggtgaggaaagactaaagttttctgataaacccgaccccttttttagcaacgaagacaaatcataccctgccaaaagaccttgcctagtttctggtgcgaaagagggagatgaacctgttcaacggattggtctcagccatggtgctagctttgctccaacatatccccagaagctagtttctttgggtgctggtaatggggatcagatgtatgtgcatccctggaaaggtatcctggcgaatatgaaaagaacgtttaatgaaaaaacaaggaagtatgctggtgagagtggaagcaagataagagaagatttgatcaagaaagggtttaatccccataaagtcacgccactgtggaacggaagacttgggtttactggttttgctattgttgactttggtaaagagtgggaaggattcagaaacgcgaccatgtttgataaacactttgaagtgagtcagtgtgggaaaagagaccatgatctcacacgtgatccaggtgataagctttatggttgggtagcaaaacaagatgactactattcaagaactgctattggtgaccacctcagaaagcaaggggacttgaagagtgtttctggtaaagaggcagaagatcaaagaaagacattcacgcttgtctccaacttggaaaacacactggtaaccaaatctgataatcttcaacaaatggagagcatctacaaacaaaccagttcagtgcttgagaaaagaatgaaagagaaggatgaaatgatcaacacacataatgaaagtatgttctcttactacgaaactaatttttgcttgattgaggtgcttggtctagtatttggaaactgataagtttgcttttccatgtttagaaatgagtattatgcagcaaactgcacgtgattatttggccagtatttatgaagaacatgaaaaggcctctcagcatctggaagctcaaaggaaagaatatgaagaccgggagaattatctagataagtgtcaagctaagaataagactgagcggagaaagcttcaatggcaaaagcataaggtaacattcacatgcttcgtacaaccttacccttaaactatcttgttcttagcaatgattcgtggaatcttataatatctgccagaacttaatggcaacgcaagagcaaaacaaagctgatgaagacatgatgagattggcagaacagcaacaggtaagctttattgttaaaaaaaaacaaaacactttgaaagttaatgttcaagttgctgtttgatttttggtcgtacttagaaaactggctattgttttacagagggaaaaagatgaattacgtaagcaagttcgtgagctcgaggagaagatcgatgctgagcaggcattagagctagagatagagcgtatgagaggtgacttgcaggtcatgggacacatgcaagaaggtgaaggtgaagattcaaaaatcaaggagatgatagaaaagacaaaggaagaactgaaggagaaagaagaggattgggaatatcaagagtcgctctatcaaactcttgttgtaaaacatggctacactaacgatgagctacaggatgcgcgcaaggctttgattcgtgtaagcaattctcagcctctctccatctcgtcccttcttcctttgatgggttgttatttggattttctgattgatgaacatttatggtgttgacctagtgagactccatgttcttacctggtaactcatggtagaaatctcagatggtagtggaagtgatttgccatttgtgttctgatatttgcaactaaccatgcttaagctatgtgcagtcaatgcgagagttgaccacacgagcttacattggtgtgaagagaatgggagcattggatgagacaccattcaaaaaagtagctaaagagaaatatccagcagtagaagctgataaaaaagccgaagagctctgttccttgtgggaagagcacctgggagactcggcttggcatccgattaaggtcgtcgaaaaagatggaatcgcaaaggtaaacacgcttttctctcaaacaatgtttctagatgatatcttagctcctgtaatataagaacatgagagtgactataacgattttgcaggaagaactgaatgaagaagatgagaagctacaagagctgaggaaagagttgggtgaggaagtgtatgcagctgtgacacaagcgcttaaagaaaggaacgagtataatggcagtggaaggtacatagtgcctgagctttggaatttcaaacaaaacagaaaagcgagcatcaaggaaggagttgtttatctggtcaactcgtggaaacagaagaaaccaaagccgaagcgtagataaaaattaattctagaaacctctattgttgataattattaagactagatgagatttcatgattatccccactaagaatagttataaacttgagaaaaaaataaaaatagttatgaacttatgatgctgaaatcttggactgggttattcgttttgaaaagaggatttgggttttgttatttatgaatatgtttcattg

SEQ ID NO: 48 - DNA, 4698 bp, Arabidopsis thaliana
gacgacaccgtttcgaaattgggccagagacaaaactaaactggatcttaaatcagcccaagccgttaactataaatttgttacattagtcacggactcacgtgtcacgtccttcgaaaacaacgtatccgcacgtgacatcgccaccggcctttttttttttttttcacaccgcacgaggaagtttaggtttcttcaaaatcacaaaaccaaacaacaacaaccaaaaaaaaaaaactcaaaccattttctctctaacttctctgtcatttctctctctagtggcaaagtatggcggattggggacctgttgtagtcgctgtgatactgttcgtgcttttgactccgggacttctctttcagattccggcgagaggtcgtgttgttgaatttggtaatatgcagactagtggagcgtcgattctcgtccacaccatcattttcttcggtcttataaccatcttcaccatcgccattcgtctccatatctataccggttaatttcaccgtaccggattcgtaacttcccccggttgtctagttttatggtttgttttggattttgtttcttctctgtgtcttgtcaaaacgttatgaatttgtgaatctgaatatgcattaagttaatttcaaaattcgctatgtttgattctcggtttggtttaaatctggttatggcgttgatttgaatttgatggtaggcactaggcagttagccttagtttggtttattggtattcgagttcaaattggaattgagtactaaaatgctctgttactcatttctgcatcttgagttcttatggatttgcttacgaaatgttcaattttgtttggtctggttcggttcgttctgaaacgaatgtcgagagtcttttgcttgactcgaaacttgccttgtgtcagcgtgtaggggtttgtaagaataaaatgggctttaaaattaagttattaatgggccaacacatgatccaccaagaagaagtgatccggttgcatcttagattctcatgtgatgtgattgaacgttgaaagtgcacagaagtagacctgtttaaagatgtttcacactttcactgcgtactatgtaactagtggagtcagtcccgtcatgcgtatgagtaaagcgcgtcgataccacgggaacacacaaaaacatgtcaccctagtaaaaactgtgttcgttagctcattgtaaattgcagtatatggcataaacaattgtttctacaaattccaagaatgtaagaatcaagacaataaaatgtgactatatcaagaacttaactaaagtttcatccacttaaatgaaaaagttgatttggatagaacaaaagacgtaatattcgatgtgttctctctctctcccatctttacttttattgactttttattttcactttaatgtgtgatgtaaaaataaaaagtaattatttgttcaaccctaggtgaaataaaggacgacccaaaacaagtgacgagagagcagagagagcttcttcttccggacactgaacagtgagagcacccatctccaacctcttcctgtaagtttccccaactactctgtttcttaaatgttctgcgttctttaaaacaaagtatagaagatttaggttgtaagatcgatctcgtttgatttcaaactcactatctgaaactctttgattacaaacccatcttcataatctctgtaaaaatcaaacatgcaattcacttaatggtgcaaaaaccccagaagagggaaaaaggaatcaaatttagtttataaaagcagtggaattgagttgcattgttgaaatattcaaaagcaagatcagatttttgataaagaatttcacttttgattgcaacttataatcaaggaacaagatgggaagcactgtgattttaagctcagatgatgaagattcagatattagtgaatctgaaatggatgagtatggagacaaaatgtacctaaaccttaaaggtgggaagctgaaagtgagactctctcctcaagcttttatctgtccttattgtccaaacaagaagaaaactagttttcaatacaaagatcttcttcaacatgcttctggagttggtaatagcaattctgataaaagaagtgcaaaggagaaagcaagtcaccttgctcttgtcaaataccttcaacaagatcttgctgattcagcttcagaagcagagccttcatcaaagcgtcagaaaaacggaaaccctattcaagattgtgatcatgacgagaagcttgtgtatccttggaaaggtacacactttaaaggttcttacttttctccttaagattgtactgcaatgtgtgtttagtgtttgtgtatatgtggttgaaacaggtattgtggtgaatattccaactacaaaggcacaagatggtcgatctgcgggcgagagtggatcgaagctaagggatgagtatattctaagaggatttaacccgactagagttcgtcctttatggaactacttgggacattcaggaacagctattgtggagtttaacaaagattggaatggacttcacaatggtcttttgtttgacaaggcttatacagtagatggtcatgggaagaaggactggttgaagaaagacggtcccaagttaggtctttacggttggattgctcgtgctgatgattataacggtaataatattattggagaaaacttgaggaagacgggtgatctgaaaactatagctgagcttacggaagaagaggcgaggaaacaggaattgcttgtgcagaacctgagacaacttgtagaagagaagaaaaaagacatgaaggagattgaggagctttgttcagttaagtcagaggaacttaatcagttgatggaagagaaggagaagaatcagcaaaagcattaccgtgagctgaatgctatacaagaaagaacaatgagtcacattcaaaagatagttgatgatcatgagaaattgaagaggctgttggagtcagagaggaagaaactcgaaatcaaatgtaatgagttggcaaagcgcgaagtgcacaatggaaccgagagaatgaaattgtctgaagatcttgaacaggtatccatttactctctgtatctctcttttcaagatatatgttcaagaaataattggtttttttctcttatcagaatgcatctaagaatagctctcttgaactagctgccatggaacaacaaaaggcagacgaggaagttaaaaaacttgctgaagaccaaagggttagtgactttcttcttctttgtaaaaatggttgggcttattttcgtgattactgagaaaattctgtacctaacagaggcaaaaggaggagcttcatgagaaaatcataagactagaaagacagagagatcagaaacaagcgattgagctagaagttgagcagttgaaaggacagctcaatgtgatgaagcacatggcatcagatggcgatgctgaagttgtgaaagaggtggacatcatcttcaaagatttaggtgagaaggaagcacaactcgcagatctcgataaatttaaccaaactcttatccttagagagcgcaggaccaacgatgagcttcaagaagctcataaagaattggtaaacgtatgtatcattcaaagtgttgttcttttcaatcacatcgaaaagctatgagaaagcttgacattttactaaaatcttggttttgtttgtttcatgtgccttcatagattatgaaagaatggaacacaaatatcggtgttaagagaatgggagagctcgtgacgaaaccattcgtggatgcaatgcagcagaagtattgtcagcaagatgtggaggaccgagcagttgaagttctccaactttgggaacactatctcaaagattcagattggcatccattcaagcgggtcaagctcgaaaatgaagatagagaagtggtaagaccgccttcttgactctgtttgttatgttgaatctctctgaaagattaaaaagcttttttggtgttgttgttaattgtgtttaggaagtgatagatgatagagacgaaaagctgagggagctaaaggcagatttgggagatggtccttacaatgcggtcacgaaagctttgttggagataaacgagtataacccgagtggaaggtatattacaacagagctatggaacttcaaagcagataagaaggctacacttgaagaaggtgtcacttgtttacttgatcaatgggaaaaggcgaaacgcaagcgtggaatggcttagaggtttaaccatttttgataaccgaacaaaaatatgttttcatttgcaattgttatttgctaatataggatttcgattgatggtttgcagctgcaagatgatggacatgggactgaataaaaagccgatgcggtttttagttgcagagaaatgtgtttggtttgaccaaactttggtggattctgtttgtttttcttctcagaacttagtgaataattgacacaactttgatgtcttgcatcggttcttttcattgtaacatttgtaggagtttggccgctttggacaataagaaataaaaatatcattgtaatataattcacatgtaaaacaactagatttggcctctcttctgtctcatatcttaagcatgtcatttagaaccttttattgtaaaaacaaactttgtcatgagttactttttgtagtcaaatttgatattgacccctt

SEQ ID NO: 49 - DNA, 5258 bp, Arabidopsis thaliana
aacatctttaaacttcgcatacttaagttaatgaacaaaattgacttgtgttgtaggcaacaattgacgtgggaggtacacaactgtctgctctagatatcgaaggatccatcttgcagagtccatgcgaacctagggaatctgtaagtactcatatatatcatcctgtgaagttgtaataactgatctttaaaatgtttcttttatccgaataaaaaggtttcagccggtgaaagcgaagtgagaatacagacacgctacggattcagatgcgtagagccaaacctaatgttcgtgctttgtcgtggagattggtcttcacctgcagtaagttcactcaatttcttcaaatatgataagtgttgcttcaacggtagtaactaacaaagcatctttgttcatgatcacctatatacatgatacagttgagagtttatacagcagaagatgtggtgaacgaactaatcaaagcaagaacagagtatctagaagcttccatcggtgtctcgggaaggaaaaagattgtgattccgcgattcttgcataaacgtctacgggatttcgctgaggatgaaggctcgttaattgaatggatatgcagccaattaccaccagcccaacgttgctttcagctcaaggaaacagcgatggaggggttgaacaagaaaagtgaatctcaattgaaaaaactgatagaagtgaggtctcacgaatacgagtttcgttatctcttggcattgtaaaatctaatccttcaaatttctagtatttggagccttgaaaagacgattgtcctatatatgtgtgtgtgttttaagagaatgaagttacacagtgaattttgattaataatggaaacaaacaaaatagtaactacaaagtgtacaatacattcatattgtgatacatataaaagtgcttcatttaactatataaaaccttgatttaaatctagattggattcaaatcagtagattacaaatcccgatcaaaataattaagtatgctatattattgttgtaaatgtataatctgtagatattaactaacacttaggatgaggaacacgacaagcaattagaagtctgggcaagagcacagggttcttgataaaatacttgcaggcacatggttgtggctttaccattcttccacaacagtaactcggcaatttggtgcctttatcaatggcaactaaacaatttgcaatctcatgcatgcatctgcccatcatctcatcaccattaactttgatcggagccgccgacaagagtatgacgacgaaggcaatgagcatcaatggaacaatcttcatgtctaattattttagtaactagtgaacaaaaagataaataattttgcagaaaattaaactggttcatgccttctttgttttgttctaggtaaattttaaataggaattggaagcactgcttgaacaattgactttttcagaagtcacccatcataaaagcctttcctaaaccgaaccgaataatcacaattttttatctccggttaacaaattctttctcgcgacgacttcaacgcgcgacaatggcgcgtgtaagacaaacagaggtttcttggaatatctctccaagtacttttgctgcttctctatcaaaatgggaacaaacttagaaaaaaccaaaagaaatcgaaattacttggaaacaaaacatctgacgatctccagactcagctgaagtttcgagctgaatctcttcttctctacacgcgatttctctggtacagttcttaaacgtctgctttgctttgacattcatcgtttctctcccaatttgcttcttggttttggggatgcgcgttttgatgccgacttttttcttcagttttgaaatttcgtaagacattagaccccaattattcataattttttcagaaatcagacatgcatgtttcatacaacatagagagtgtgttaagtagaggagtcaacattttttccggatctatctaatcaagctgaatcatagacttactattcagaatgtttcatactcactttgtcttagatccaagtatgtaaggtttcaagtgttttttgtttcctgtggagataatgatggctaaattcatttacttacaatgtagttagattatgcagctcgtagatgtaaaacaataacgcgaggcggtgatgaacaacaaattgagtgattttgagaaaaatctgtacaaaaaactcaagagtggaaagctcgaggtgaaagtctcataccggactttcctgtgtccttattgtcccgataataagaagaaggttggtttgtatgttgacattcttcagcatgcttctggagttggtaatagccaatccaagaaaagaagtttgactgagaaggctagtcaccgtgctcttgccaaataccttattaaagatcttgctcattacgctacttctactatatctaagcgcttaaaagccagaacatcattcattcctgctgaaaccggcgatgctcctataatttatgatgatgctcagttcgagaaacttgtgtggccttggaaaggtaatgatgatgacgcatactcctatgtcattacaagtatcgtagtattagcactatttggatttatagcctctctactaaccgaagttgtatctgtggtgtggctgggataggagttttggttaatattcccacgacgagtacagaagatggtcggtcttgtactggagagagtggaccaaaacttaaggatgaattaatccgaagaggattcaacccaattagagttcgtactgtgtgggaccgtttcggtcattcgggaaccggaatagtggaatttaacagagactggaatggacttcaagatgctttggtgtttaagaaggcttatgaaggagatgggcatgggaaaaaggattggctttgtggtgctactgactcgagcctttatgcatggcttgccaatgctgatgattactacagggctaacattttaggagaaaacttgcggaagatgggtgacctcaaaagtatttataggtttgcagaagaagaggcaaggaaagaccaaaagcttttgcagcgtctgaactttatggttgagaacaaacaatatcggttgaagaaattacagataaaatattcacaggattcagttaaacttaagtatgagactgaagaaaaagaaaagattctccgtgcttacagtgaaggtgagatttgtccttctagtttcaagattcatatccccttagaaaaagtattgttgcatcacccagctatacatatttctgtagattgtgtttatatccgcgttacattttccgttttgcatctgaagatctgacaggaagacaacaaaaatcgactgatcatttcaataggatctttgctgatcatgaaaagcaaaaggtgcagctggagtctcagataaaggaacttgaaattagaaagttggagttggcaaaacgtgaggcagagaatgaaacgcagaggaaaatagtggcaaaagaacttgaacaggtatatgctaacaagctcatttcttaaactgatttctggattgcctctttcgtcttctaaaattcaatgacattattttcagaatgctgctataaatagttatgttcaactatctgccttggaacaacaaaagaccagagagaaagcgcaaagattggctgtagatcacaaggtctgggaatgcttccttctttaaaaaggttggctctttaactttatgtgacagggtcctaccgtgtttttaaccttagatgcaaaaggaaaagcttcataagagaattgctgcactagaaaggcagcttgatcagaagcaggagcttgaactggaggtccagcaactgaaaagtcagctgagcgtgatgagactcgtggaattggacagtggttctgaaattgtgaacaaggtggagaccttcctcagagaccttagtgagacagaaggagagcttgcacacttaaatcaattcaatcaagatcttgttgttcaagagcggaagagcaatgatgaacttcaagaagctcgaagagcattgataagcgtacgtatattcaaacaattttctttgaactttcgtctcatagaggagctaggtgactctttgcatgtactgagtgataaactcgaatataactgacatggtaggctagagtggttggatgcattaacaacagaaaagacactacttgaattttcctctaatttttttcttaactttgattgcatgtatagaatttgagagacatgggattgcatattggtgttaagagaatgggggagcttgacaccaaaccgtttatgaaagcaatgagaataaagtactgtcaagaagatctagaggattgggcagttgaagttatccagctttgggaggaatatcttaaggacccagattggcatccttttaaacggataaagcttgagactgcagaaacaatagtggtattccttctcctgtatatcactaattcaatgttttttatttctcatcctaaataatatgtttcgtaagtgttactagcagaagacctccattcaagtgcatgcgtacaactaccagctgcatatgcagatttgtttatgcatgttatggtgtttgatatgtagaaccctgaagctgttgatatctatgtcaggaagtaattgatgaggatgacgagaagttaagaaccctgaagaatgaactgggggatgatgcgtaccaagcagtggcaaatgcattgctggagataaacgagtataatccgagtggaaggtacatctcctcagagctatggaacttcagagaagacaggaaggctacgcttgaggaaggtgttaattctctactggagcaatggaatcaagcgaagcatctcaagtcataaaggtttatatttgcatttacccggtacactcaaaaatcccagctctttggaagtttgcctctttgcttacatagttgtattttcgaattttgctaatctgaggtctgtactttgcaagttgcaggagatggaaaataagtttagcgtgtaaaggatgtcaaaatgcaaggttcaacaattgtctctcgtctttgatgcaatatatgggtcttagaattgcgaagtaggtgtaaattagaggaggatggcgtcacattgggactcgaagttgaaactatgtttctacacttgacggttcaacattgtaggaaactaagtaacaaacattgttagatgattctaaaccttagagaagtttatgaatttgtgaagaaatgaacactttggctt

SEQ ID NO: 50 - DNA, 5257 bp, Arabidopsis thaliana
aacatctttaaacttcgcatacttaagttaatgaacaaaattgacttgtgttgtaggcaacaattgacgtgggaggtacacaactgtctgctctagatatcgaaggatccatcttgcagagtccatgcgaacctagggaatctgtaagtactcatatatatcatcctgtgaagttgtaataactgatctttaaaatgtttcttttatccgaataaaaaggtttcagccggtgaaagcgaagtgagaatacagacacgctacggattcagatgcgtagagccaaacctaatgttcgtgctttgtcgtggagattggtcttcacctgcagtaagttcactcaatttcttcaaatatgataagtgttgcttcaacggtagtaactaacaaagcatctttgttcatgatcacctatatacatgatacagttgagagtttatacagcagaagatgtggtgaacgaactaatcaaagcaagaacagagtatctagaagcttccatcggtgtctcgggaaggaaaaagattgtgattccgcgattcttgcataaacgtctacgggatttcgctgaggatgaaggctcgttaattgaatggatatgcagccaattaccaccagcccaacgttgctttcagctcaaggaaacagcgatggaggggttgaacaagaaaagtgaatctcaattgaaaaaactgatagaagtgaggtctcacgaatacgagtttcgttatctcttggcattgtaaaatctaatccttcaaatttctagtatttggagccttgaaaagacgattgtcctatatatgtgtgtgtgttttaagagaatgaagttacacagtgaattttgattaataatggaaacaaacaaaatagtaactacaaagtgtacaatacattcatattgtgatacatataaaagtgcttcatttaactatataaaaccttgatttaaatctagattggattcaaatcagtagattacaaatcccgatcaaaataattaagtatgctatattattgttgtaaatgtataatctgtagatattaactaacacttaggatgaggaacacgacaagcaattagaagtctgggcaagagcacagggttcttgataaaatacttgcaggcacatggttgtggctttaccattcttccacaacagtaactcggcaatttggtgcctttatcaatggcaactaaacaatttgcaatctcatgcatgcatctgcccatcatctcatcaccattaactttgatcggagccgccgacaagagtatgacgacgaaggcaatgagcatcaatggaacaatcttcatgtctaattattttagtaactagtgaacaaaaagataaataattttgcagaaaattaaactggttcatgccttctttgttttgttctaggtaaattttaaataggaattggaagcactgcttgaacaattgactttttcagaagtcacccatcataaaagcctttcctaaaccgaaccgaataatcacaattttttatctccggttaacaaattctttctcgcgacgacttcaacgcgcgacaatggcgcgtgtaagacaaacagaggtttcttggaatatctctccaagtacttttgctgcttctctatcaaaatgggaacaaacttagaaaaaaccaaaagaaatcgaaattacttggaaacaaaacatctgacgatctccagactcagctgaagtttcgagctgaatctcttcttctctacacgcgatttctctggtacagttcttaaacgtctgctttgctttgacattcatcgtttctctcccaatttgcttcttggttttggggatgcgcgttttgatgccgacttttttcttcagttttgaaatttcgtaagacattagaccccaattattcataattttttcagaaatcagacatgcatgtttcatacaacatagagagtgtgttaagtagaggagtcaacattttttccggatctatctaatcaagctgaatcatagacttactattcagaatgtttcatactcactttgtcttagatccaagtatgtaaggtttcaagtgttttttgtttcctgtggagataatgatggctaaattcatttacttacaatgtagttagattatgcagctcgtagatgtaaaacaataacgcgaggcggtgatgaacaacaaattgagtgattttgagaaaaatctgtacaaaaaactcaagagtggaaagctcgaggtgaaagtctcataccggactttcctgtgtccttattgtcccgataataagaagaaggttggtttgtatgttgacattcttcagcatgcttctggagttggtaatagccaatccaagaaaagaagtttgactgagaaggctagtcaccgtgctcttgccaaataccttattaaagatcttgctcattacgctacttctactatatctaagcgcttaaaagccagaacatcattcattcctgctgaaaccggcgatgctcctataatttatgatgatgctcagttcgagaaacttgtgtggccttggaaaggtaatgatgatgacgcatactcctatgtcattacaagtatcgtagtattagcactatttggatttatagcctctctactaaccgaagttgtatctgtggtgtggctgggataggagttttggttaatattcccacgacgagtacagaagatggtcggtcttgtactggagagagtggaccaaaacttaaggatgaattaatccgaagaggattcaacccaattagagttcgtactgtgtgggaccgtttcggtcattcgggaaccggaatagtggaatttaacagagactggaatggacttcaagatgctttggtgtttaagaaggcttatgaaggagatgggcatgggaaaaaggattggctttgtggtgctactgactcgagcctttatgcatggcttgccaatgctgatgattactacagggctaacattttaggagaaaacttgcggaagatgggtgacctcaaaagtatttataggtttgcagaagaagaggcaaggaaagaccaaaagcttttgcagcgtctgaactttatggttgagaacaaacaatatcggttgaagaaattacagataaaatattcacaggattcagttaaacttaagtatgagactgaagaaaaagaaaagattctccgtgcttacagtgaaggtgagatttgtccttctagtttcaagattcatatccccttagaaaaagtattgttgcatcacccagctatacatatttctgtagattgtgtttatatccgcgttacattttccgttttgcatctgaagatctgacaggaagacaacaaaaatcgactgatcatttcaataggatctttgctgatcatgaaaagcaaaaggtgcagctggagtctcagataaaggaacttgaaattagaaagttggagttggcaaaacgtgaggcagagaatgaaacgcagaggaaaatagtggcaaaagaacttgaacaggtatatgctaacaagctcatttcttaaactgatttctggattgcctctttcgtcttctaaaattcaatgacattattttcagaatgctgctataaatagttatgttcaactatctgccttggaacaacaaaagaccagagagaaagcgcaaagattggctgtagatcacaaggtctgggaatgcttccttctttaaaaaggttggctctttaactttatgtgacagggtcctaccgtgtttttaaccttagatgcaaaaggaaaagcttcataagagaattgctgcactagaaaggcagcttgatcagaagcaggagcttgaactggaggtccagcaactgaaaagtcagctgagcgtgatgagactcgtggaattggacagtggttctgaaattgtgaacaaggtggagaccttcctcagagaccttagtgagacagaaggagagcttgcacacttaaatcaattcaatcaagatcttgttgttcaagagcggaagagcaatgatgaacttcaagaagctcgaagagcattgataagcgtacgtatattcaaacaattttctttgaactttcgtctcatagaggagctaggtgactctttgcatgtactgagtgataaactcgaatataactgacatggtaggctagagtggttggatgcattaacaacagaaaagacactacttgaattttcctctaatttttttcttaactttgattgcatgtatagaatttgagagacatgggattgcatattggtgttaagagaatgggggagcttgacaccaaaccgtttatgaaagcaatgagaataaagtactgtcaagaagatctagaggattgggcagttgaagttatccagctttgggaggaatatcttaaggacccagattggcatccttttaaacggataaagcttgagactgcagaaacaatagtggtattccttctcctgtatatcactaattcaatgttttttatttctcatcctaaataatatgtttcgtaagtgttactagcagaagacctccattcaagtgcatgcgtacaactaccagctgcatatgcagatttgtttatgcatgttatggtgtttgatatgtagaaccctgaagctgttgatatctatgtcaggaagtaattgatgaggatgacgagaagttaagaaccctgaagaatgaactgggggatgatgcgtaccaagcagtggcaaatgcattgctggagataaacgagtataatccgagtggaaggtacatctcctcagagctatggaacttcagagaagacaggaaggctacgcttgaggaaggtgttaattctctactggagcaatggaatcaagcgaagcatctcaagtcataaaggtttatatttgcatttacccggtacactcaaaaatcccagctctttggaagtttgcctctttgcttacatagttgtattttcgaattttgctaatctgaggtctgtactttgcaagttgcaggagatggaaaataagtttagcgtgtaaaggatgtcaaaatgcaaggttcaacaattgtctctcgtctttgatgcaatatatgggtcttagaattgcgaagtaggtgtaaattagaggaggatggcgtcacattgggactcgaagttgaaactatgtttctacacttgacggttcaacattgtaggaaactaagtaacaaacattgttagatgattctaaaccttagagaagtttatgaatttgtgaagaaatgaacactttggct

SEQ ID NO: 51 - DNA, 3718 bp, Arabidopsis thaliana
cactgcgtttacctttatcacaagccgaaaccctagtaaagtgtcggcttgaagactatgatgacctggtggcgatttttgggttgttgcatctatggtaagatacacagatatgttagggttacttaattggataattcttgtttagtcttcattcatcaatcatcaagttatgtgtactataatttttgtagcggtttttggaagaatatgataaggggatatgcatctttgtgtttgcttttggaacgtgataaccattcgacttttgactgatgaaattgaagacactgtcgtagtaacaaagctattcttcttagacattttgatactgaactattctgtgttccaaagtcttttactttgtgtttaggaaaagatcttgttctttgtgaaaccagtgtcgtaattcaagaactaatgcttgacatgtctcacctgctcaggttatctaaatctaatggataagaagaaacatcaacaatactgcactgatacaagacaagaagcgtctgtagtccaacggttaggataattgccttccaagcaatagacccgggttcgactcccggcagacgcaattatatttttcccaaacataattttagattttgttaaccaaacaatttgtggggttcgaatgtaactggttgtagcacatttaatatctgcaataaattatcaaaaaggccattggaactctcccaacccatcgtctaatttagtaatttttggtcttgtaaccttctaggtgtaccagaggcttccttattagtcttgtatcccaagcttttgaaaaaaagtgaaacgaaaaggttttaagttttgttggcttttgactatcatttcccctctctgtttattaaaatttacagtattgccactgagtttgctgcgacggtctgtctcttcaaaaagcaattttggggaggaagagaaaaccttaagagtcaaacggaaaaaaaacacacactatttttgtgattcaccaagcagaagaaaattgagaaaaaaaaaaggtctctgctttttattttccatggcttagactctcatttttattgggaatttggatggtctaaagtcaggatttgctttattttgcttgcaaggttttgtaaaagaacactttttctcggttcttcatccgtacacgtaacaaatccatttcttatgtgttttttcgatttctagaatctgtaaaacccacaaaaaagaggtttttttttttgtttctgggttctttgaagaagcagagagaagataagctctttacagttttcttcataacaagtgatttccttttgttttcttattcgatttccagtttctatatgttacataaatttgatttttaactctgaatcatatacattactcaaaaccttaaaaaggtttcttttttgtttgtctaggttgttcaaaacttgatctttcagtagctaaatatatggatcctctataatctcatttgtaaagctcttttattgcagctttaagatggagaaaaatcaacaaaagcaggaatttctagctgagacctcagagatgaagaacaccaaaaacaacgacgactgttctgtacaacaacaacaacgatttgtgtggccatgggttggtctagtagccaacataccaacggaggtggaaccatcgggtcggagagtaggcaaaagcggttcaacgttacgtgatgagttcactatgaaagggtttaatccaacaagagtccaacccatttgggatttcaagggtcattctggttttgctttggttgaattcgctaaagactttgaaggattcgaaagcgccatgaatttcgaaaggagttttaatttagaccgtcatgggaagagagattgggaaaaaggtaaaacattgtttcagagtttttaaagtcatttgctttcttgacattgatgagttcactttctttgtaaaaggtcatcgcttgagagacaataagctctatggatgggttgccagagaggatgattataatcgaagtgatactgttgggaagaacgtcaagaagaagagagatttgaaaagtatctctcagattgtggaggaagacgagaggaaaatggttcatcttgttgagaatatgtctcaaaccattgagaagaagaagcaaagtaaacaagagcttgaacagaaagttgatgagacttctcgtttcttggagagtttggaattgcataacgttctgttaaacaaaaactaccaagaaggtaaaatagaagcacttgaataagctttaaaaacataatctgttttgtgtttcatgctgacatgtatagtccttttggtttgtttgtgtgttattgtgatgagaagggtttcagaagatgcagatgaagatggaagagttgtatcaacaggttctggatggacatgaaaagtctttggcagaactggaggcaaagagggagaagcttgacgagcgtgcaagactgatcgagcaacgggctatcataaacgaagaagagatggaaaagtccagacttgaaagagaaatggtgattatgctttccttacaaagtaggagaaaaagatcacaaggcaataaaatctttgttgttgttgttgttgtagaatcaaaaggctatgtgtgagcagaatgaagcgaatgaggaagctatgaagcttgcagaaaagcaccaggcaagtagttcgttagtgtttctgtatatattcatgaacaagtaataactaagcttccatttccaacttttgagttcctgaactatgacaacttttgcagaaagagaaggagaagcttcataaaaggataatggaaatggaagctaagctaaatgaaacgcaagagctggagttggagatagagaagctgaaaggtactacaaatgtgatgaagcatatggtggggagtgatggagataaagatattgtggagaagatagccaaaactcagattcagcttgacgctcaagaaacggctctccatgaaaaaatgatgactctggcacgaaaagaacgtgcaaccaacgacgagtatcaagacgttcttaaagagatgattcaggttcgaaaacgttctaaatctatctgttccaaactctttggcttgtccttttaacttgtgtaattactttgatgaacaggtatggaacgccaatgaagagttgatgaagcaagagaagattagagtgaagagaatggggcaattaaaccctgcacccttcttgcctgcagtgatgaagaaacataaagttacacaatcaaaggcagagaataaggctatgaagctgtgttcagtgtgggaagcaaacataggagatgtgcaatggactccatttagagtcgatgagtctgatggaacaccaaaggttaggactttaatttaggagtctactttcaattctcaaaagatggggttttagcaaaaaaagacctctgcttttacatattatatcatccacattccaaatgtgaaatgcagagagttgtggatgaaaacgacgagaagcttcgtacgctgaagaaccagtacggtgaagaagtttataatgaagtggtaagaacaaaactagagattgaggaacataacgctagtggcagctatgtgattttagagctttggaactatgaggaaaaccgaaaggcgacgatggaggaagcaacagatgtgatgttgaagataaggtccaaacttgctgctatgaagaacaaacgaaagaggcttgaggtctaa

SEQ ID NO: 52 - DNA, 7640 bp, Arabidopsis thaliana
ctaaaaagagtattcaaaaacccaaacattaatttaatatccaaaatattaattatatgatattattttatttgattttaaatatatagtaaactgcgagttgtatatgttttcttgatattatttatattgtttagtgtttaaaattatacacttgtattttgattgttaattttagagtttcacctgtagtataccatcttatattaatatcgatttaaacccgtcaattctaggattttccagcttgtattaaaaattgaatcacatcatacacataaaaaaatctaatatgttattaattattgttgtatataagattataaattcttaaaataatatgcatgaaattgaatataaatatttaaattatgacccagtacttagtaataaatttttttaaatctatttttgacccgttataatatttttttatgtattgaacagtttatattcgtttttaaaagtttaaattatggcatatgcgaaaaaactctaattatttttttataacgatgatattattttttcgcaaaaatagaatcatataaagatgagaggtgaactataataattaataaaaaattaatatgataatttagatattaaatctaatttgttgattttaattggttaattttttggaaattaataatgtatttcattttttaatgaaatttaattaattaaattagtatttgactttttaatttttaaagagatgaattactttactctttaaattttatttctaatggcatacatatgtaattacttacaaaaagtaaggttacatttaaaatgtacttcccaaataatatagtaggatcatggtaaaatgttagttctcgaaagaaaaaatattgttataaatcataaacctaacgagctaactaaaatagcggcatcctaccaatttgagatttttcgtatatatattaaaattatccatttgataaacacttcatgataaagtattagttttgaaaataaaaatattgttcttgttataagaaaaaacacacacataaaagtattattggaggatctcattgttaagttgttaaccctcaacatttcgtctaaaaatcagacttttttctatcaaaaaaatatctatactttgtagtcaaataaaaatcttaatcaaaataatactcgtatactttgactgttgactgatggaaagatattagaatataaacattagagatagaaacaaatctgtaaaaatcttaaaattaggattatttatacggaatattccccaaaagataaaatcattgaatcataaaaagccatttatggtagccctaaatattcaggcgcggctttttttcttatttcgttttcattttaaaaaagtttttagcgccgtttattgccgcgcgtcgttttcgctcctcgtctcgtctccttttattattaccccctctctctctctcccactcttcctctcaaatcacacatcactgctttcttcaacctctctatctctcagaccaattagggtttcgcaatcttccagtagatttcgcttctcaacgtaagtttttctctataatctgtgtcgatttcagtctaactacagtgattgttaaaccctagactcggaaattttcctgggctttgttattatttgcgtcggtttagtcaatgcgatgtagtgaacgcttcgattacatagatttgtgtgaaaattttatagtccaattgcgttatagtgatgattttgttggtaattttgattttgaaactagggattttgaaaatggtggaaaatggggctaaagctgcgaagcgaaagaagagaccacttccagagattcaagaggtagaagatgtacctaggacgaggagaccaaggcgtgctgcagcgtgtaccagtttcaaggagaaatctattcgagtctgtgagaaatctgctactattgaagtaaagaaacagcagattgtggaggaagagtttctcgcgttacggttaacggctctggaaactgatgttgaagatcgtccaaccaggagactgaatgattttgttttgtttgattcagatggagttccacaacctctggagatgttggagattcatgacatattcgtttcaggtgctatcttaccttcagatgtgtgtactgataaggagaaagagaagggtgtgaggtgtacatcgtttggacgggttgagcattggagtatctctggttatgaagatggttcccctgttatttggatctcaacggaattggcggattatgattgtcgtaaacctgctgctagctacaggaaggtttatgattacttctatgagaaagctcgtgcttcagtggctgtgtataagaaattgtccaagtcatctggtggggatcctgatataggtcttgaggagttacttgcggcggttgtcagatcaatgagcagtggaagcaagtacttttctagtggtgcggcaatcatcgattttgttatatcccagggagattttatatataaccaactcgctggtttggatgagacagccaagaaacatgaatcaagctatgttgagattcctgttcttgtagctctcagagagaagagtagtaagattgacaagcctctgcagagggaaagaaacccatctaatggtgtgaggattaaagaagtttctcaagttgcggagagcgaggccttgacatctgatcaactggttgatggtactgatgatgacagaagatatgctatactcttacaagacgaagagaataggaaatctatgcaacagcccagaaaaaacagcagctcaggttctgcttcaaatatgttctacattaagataaatgaagatgagattgccaatgattatcctctcccatcgtactataagacctccgaagaagaaacagatgaacttatactttatgatgcttcctatgaggttcaatctgaacacctgcctcacaggatgcttcacaactgggctctttataactctgatttacgattcatatcactggaacttctaccgatgaaacaatgtgatgatattgatgtcaacatttttgggtcaggtgtggtgactgatgataatggaagttggatttctttaaacgatcctgacagcggttctcagtcacacgatcctgatgggatgtgcatattcctcagtcaaattaaagaatggatgattgagtttgggagcgatgatattatctccatttctatacgaacagatgtggcctggtaagcttactatcctagtattttgtactcgcatgtttctacgtctgttttttcttctgttgctgatgtataaggtatatacaggtaccgtcttgggaaaccatcaaaactttatgccccttggtggaaacctgttctgaaaacagcaagggttgggataagcattcttacttttcttagggtggaaagtagggttgctaggctttcatttgcagatgtcacaaaaagactgtctgggttacaggcgaatgataaagcttacatttcttctgaccccttggctgttgagagatatttggtcgtccatgggcaaattattttacagctttttgcagtttatccggacgacaatgtcaaaaggtgtccatttgttgttggtcttgcaagcaaattggaggataggcaccacacaaaatggatcatcaagaagaagaaaatttcgctgaaggaactgaatctgaatccaagggcaggcatggcaccagtagcatcgaagaggaaagctatgcaagcaacaacaactcgcctggtcaacagaatttggggagagttttactccaattactctccagaggatccattgcaggcgactgctgcagaaaatggggaggatgaggtggaagaggaaggcggaaatggggaggaagaggttgaagaggaaggtgaaaatggtctcacagaggacactgtaccagaacctgttgaggttcagaagcctcatactcctaagaaaatccgaggcagttctggaaaaagggaaataaaatgggatggtgagagtctaggaaaaacttctgctggcgagcctctctatcaacaagcccttgttggaggggaaatggtggctgtaggtggcgctgtcaccttggaagttgatgatccagatgaaatgccggccatctattttgtggagtacatgttcgaaagtacagatcactgcaaaatgttacatggtagattcttacaaagaggatctatgactgttctggggaatgctgctaacgagagggaactattcctgactaatgaatgcatgactacacagctcaaggacattaaaggagtagccagttttgagattcgatcaaggccatgggggcatcagtataggaaaaagaacatcactgcggataagcttgactgggctagagcattagaaagaaaagtaaaagatttgccaacagagtattactgcaaaagcttgtactcacctgagagagggggattctttagtcttccactaagtgatattggtcgcagttctgggttctgcacttcatgtaagataagggaggatgaagagaagaggtctacaattaaactaaatgtttcaaagacaggctttttcatcaatgggattgagtattctgttgaggattttgtctatgtcaaccctgactctattggtgggttgaaggagggtagtaaaacttcttttaagtctgggcgaaacattgggttaagagcgtatgttgtttgccaattgctggaaattgttccaaaggaatctagaaaggctgatttgggttcctttgatgttaaagtgagaaggttttataggcctgaggatgtttctgcagagaaggcctatgcttcagacatccaagaagtaagaactattttttatatctggtaatgtgttcagtggtgaggtttcttcataagtttatctgacaatcttttttctttctttttgcaatttcttaagttgtatttcagccaggacacagttgttctccctccaggtgctctagagggaaaatgtgaagtaagaaagaaaagtgatatgcccttatcccgtgaatatccaatatcagaccatattttcttctgtgatcttttctttgacacctccaaaggttctctcaagcaggtatatacctctcttcacttcgtatttgtcaattatttgtgtacctagtttcttaaggaattcatatagttgtgtctaggatttatatgttatgattattgttgttctgatacaaagttgaactttttctctatactgtcttgtaacagctgcccgccaatatgaagccaaagttctctactattaaggacgacacacttttaagaaagaaaaagggaaagggagtagagagtgaaattgagtctgagattgtcaagcctgttgagccacctaaagagattcgtctggctactctagatatttttgctggttgtggtggcctgtctcatggactgaaaaaggcgggtatgtattatatccagtcaactcttaatcttccaaaatgcttgaataagttgtattaatattcatgctatatgtaaaaggtgtatctgatgcaaagtgggcgattgagtatgaagagccagctgggcaggcttttaaacaaaaccatcctgagtcaacagtttttgttgacaactgcaatgtgattcttaggtaaatagccaacaagttatcgcttactcttttagtgtggctattttttgcattgtgatcagttgttgtgattaattgcagggctataatggagaaaggtggagatcaagatgattgtgtctctactacagaggcaaatgaattagcagctaaactaactgaggagcagaagagtactctgccactgcctggtcaagtggacttcatcaatggtggacctccatgtcaggtatatatttcagattgtggctatacttgtgtaaatttttcgttgaataagtgaaaagcccttaacctgtgcaatttggcagggattttctggtatgaacaggttcaaccaaagctcttggagtaaagttcagtgtgaaatgatattagcattcttgtcctttgctgactatttccggccaaggtattttcttctggagaacgtgaggacctttgtgtcattcaataaagggcagacatttcagcttactttggcttcccttctcgaaatgggttaccaggtaaagtcctaacgcttttgttaaattgatttctctttagtagaagttggcatgctctgtgaagaatggtttgcgaagtacaaaaattgacttaaatctcttaaatatgatgtttctatgatgtttcccaggtgagatttggaatcctggaggccggtgcatatggagtatcccaatctcgtaaacgagctttcatttgggctgctgcaccagaagaagttctccctgaatggcctgagccgatgcatgtctttggtgttccaaagttgaaaatctcactatctcaaggtttacattatgctgctgttcgtagtactgcacttggtgcccctttccgtccaatcaccgtgagagacacaattggtgatcttccatcagtagaaaacggagactctaggacaaacaaagaggtatgataacacatctggagaaaatatctatacatacatatttgctaaacacaaatgacgtgaacccattaatttattaatttatgtgggggaaattcttgtttcttgcagtataaagaggttgcagtctcgtggttccaaaaggagataagaggaaacacgattgctctcactgatcatatctgcaaggctatgaatgagcttaacctcattcgatgcaaattaatcccaactaggcctggggctgattggcatgacttgccaaagagaaaggtcagtcttatacatcctacctcaggaatacctttgtcaggttgactacggtcaaaagaattgcttttgaaactagaaatcaacccaaatcgctttgttttaatatcacaggttacgttatctgatgggcgcgtagaagaaatgattcctttttgtctcccaaacacagctgagcgccacaacggttggaagggactatatgggagattagattggcaaggaaactttccgacttccgtcacggatcctcagcccatgggtaaggttggaatgtgctttcatcctgaacagcacagaatccttacagtccgtgaatgcgcccgatctcaggtaagaaaaactcttctgttcccagtcagtcctatagcatcagttacagacttagagattgcaaagcactgaatggttttgggagatagagtagtaatgttagctttatcgatatggccttttaagcgaaattgttgttaatgaaaactgcaggggtttccggatagctacgagtttgcagggaacataaatcacaagcacaggcagattgggaatgcagtccctccaccattggcatttgctctaggtcgtaagctcaaagaagccctacatctcaagaagtctcctcaacaccaaccctagataaccacccaaatttggcatttcctttttcaataatattagtcattatgatccttgtcttgaatgaaactcattggtgctgatacttttgataaagaaagcctacgaagagtttttgtatattccgtattcggattgaaaaatctcattatacaagcaagcaatgatgtctatagactatga

SEQ ID NO: 53 - DNA, 9048 bp, Arabidopsis thaliana
ttactgggacatttttaagtctagtttattctactacatgtttttcaaaacaaatactcattttgttttaatttaattatcattttagcacttaaatttaatctcacaataattatcgtttttagttttttaatgcaaatgtttaataaaaatgtgagtattaatgtcttgaccaataatttttttagaaactatattgaacaagggtaaagtagaaaatttaattgtttttttttattttcactgcaaaaaatcttaaacgacaaataattttaaacaaaactattttaataactaaccactaaactaactatataactgttttacaaacgaaagcgtgaacttcacgtaaacaaaaattcaatttcacgccgccgacaaaaaaccttaaacgacaactaattttaaatagaaggagtatattttagtaataattatatgttaaactgttttaataaataaccactaaactaactatgtaactgttttacaaacgaaagcgtgaacttcacgtaaacaagaatctaatttcacgtcgccgacaagaaaaactgatttcacttatatatcttgatttattaatggacattcacatactctcaaataagattctagatcttataaattttaatctatttttgtctcaattaatttagttatttatcacatttcgcctcttataaaattatatgataattgtctaagcagctaactaattgtaattgtttttcaaacaaaaaatatattttaattacacataatttttttatcgaacaaaaatatattttaacgaaatataaatgtttcgaatcaaagataacaaatttatagcctcaactatacgtaaaacaaaattttattttacatatcatactttgattgatactaacacaaacttcacaaataaattcgtataattatgtaattttagattatttagagattataactagtatttagaaaaatcgcaaaatcatataagaaaagaaatggaatttgtttttggttcaaattatatttttttttcccgctattcatattatagttatgaaccaaaaatcaagctagaaataaaaaccactaggattttttttttttgctaagatgaaaatttagttatacacttatttttatttatttaaatattacattaaactaataaaaagtattaattattctaataactttttgtcagttttaaaattaggccaaaagtaaaaaactaatacagctaatataatatacttaaggaaggatatttcaactttttcttttcttcccagtttcagagtttatacaaataaggtaaaattcgcagaaacagaaaatcataaagtaattaaaataatacaaccgaggaagtaaaaagatttccaaaaggtaaaaggtgtactcgtaaagtaggtaaatagaggtacaggtcaaggggtagtttcggtatttacactctttcttcttcttttttttttttttttggtgtctcacattccaaagtccccattggacttagagaagagtttttttttcgttttctctgctttctcactttttcccgtttcctttgggaatacaaacggcggcttctcaaaagcctccgatttcgatttttttttcctctctttttttttgttctttctttagagtctcttcttcaacttcttctccggcatcttccgtcggagctaaggatcagaagtttttgtctgtgcactgtttcaattggatcattacatagtgaggattctctgttcgacgaaacgagtaagtaactacattgttgttcttcctcaattctcttctggtttttctttcgtttttttttttaaaacctttttcggtaattttctttttatctctttgaaacaatttgagttctttttttttttgattgatcactgtgtctgattccttatcacggttcttttgtttaaatttgatcgatcgttgtctttgaactccgattttgtttctatgaactttgtttactttggatgattgtgaaaagttaagtactttggtttatgcatgttcttatgagaaatcgatttctttcgtttagagatcatcttaaggcggcgaatgtttttgcactaagggtttgtgtgagtcctttagaagaacatttggaaaatttgtccttttttttttttggtcagtgaatttttttttttttaatccatgaatagtgtatgttcaaagattgaacctttttgtgtgtatgttctgcagttttttttctttcttctttttctgaacatgtattctcttatttttttgggttcatgctagattctattagtaaattcaatttcgaatctataacttgtttttgataggccagtcacagaggaagattgtggtaacacttttgtcccttaacaaaagtgtctgtttctctttggtcaattttttgatcagagagagtttgctttggtttttgtgttctggtcaatgaaatgctaaagattggtttttgtttcatattctgctgcacattagatttgatgatagagggtacagatagaaactgatcttttcgacgatttatccgtgagttttagctctgttttatgttacagaagtaagtgttaattttcaataatgtgtgttcaaagtttgaactattttgtgtgttcgtcaaatatttttgagctagaatcttcttccctgaacatgttctctcttttctttggatatatgctagattctaagtggccactcacagagatagtttgtgaagttgtctgtttctcagtggttagtattggtcagagcgagttttttggttttgtctgtctaaatgctaaatattggttttgtttcatattctgcacattggaattggtcactaaaacttgcttataaaaactgatgtttttacttacgtatctaaattttccttactgatggttttttttcttgtaggaaactcttcaacatggaagacgattgtgaggagcttcaggttcccgtgggaactctaacctcgataggttttagcatttcaaacaacaatgatcgagtaagtgttgtccttatttattcttcttgatttgtttatgagtagatggagcaaatatttaatgtaatggtactttattataggataaaatgtctgtgctagaggttgaagcaccgaatcaggtgactgattctcggctaggattaccgaatccggattctgtctgcagaacctgtggcagcaaagatcgaaaagtttgcgaaggtatcataaagaatctggttttggcaaatattgttccaatcttttagctcattttatgattagttccctgagtttgctacttttctctctgttttagggcatttcggggttataaacttcgcgtactcgataataaacccgtatttcctcaaggaggtagctgcgttgttaaacaaaatctgtccggggtgtaaatacattcgaaaaaagcagtttcaggttcactagtctttccaaatcctttgttggtttgtgtgttttggaactacatatactaatgtcatttttgcttgatatagattaccgaagaccagcctgagagatgtagatactgcactgtaagaatatatgattgcaactaattttctcagtttaaaactttgttccaacactaattttcggtttttgttgttgttatatatcagttgaataccggttatcctctaatgaagtttagggtaactactaaagaagtcttcaggcgatccggaatcgttgttgaagtaaacgaagagagtctgatgaaactcaagaaacggggagtgttaacattgcctcctgactattggagttttttgccgcaagactctaatatcgacgagagctgtttgaaaccaacaaggcgaataataacgcatgcacaggtatagaagagtgaaatgtaccatctccatgacttcttactatatatagttttctgaaaatttcacctttttgcaggtttatgctctgttattagggattgatcagaggctcatcaagaaggatatccctatgttcaactctcttggtctgacatcttttcctgttacaccaaatggttaccgtgtaaccgaaatagttcatcagttcaacggagctcggctaatatttgtaagctaaaaacgcttgtttatataatttgttatcatatactatggtatttctcttatcttttcgagtttctgtcacatttttgaaggatgaacggactcggatctacaagaaactagtcggctttgagggaaacacacttgaattgagttctcgtgtgatggaatgcatgcaatattccagagtaagttagtggttcctgatagatttaaactcttctttctgttctgtgaaggttagtagtatttcttgttttttgcacagctcttttcggaaactgtgtcttcgagtaaagattccgcaaatccgtaccagaagaagtctgatacaccaaaactttgcggtctaaggttcatgaaagacgtgctgctcggtaaaagaagtgatcatacattccggacagtagttgttggtgatccgtccttgaagctcaacgagattggcatacccgagagtatcgcaaaaaggcttcaagtatcagagcatctcaaccagtgcaataaagaaaggcttgtcacttcctttgtccccacactgttggacaataaagagatgcatgtgagaagaggagatagattggtggctattcaagtcaatgacctccaaaccggagacaaaatattccggagtttaatggatggagacactgtgctgatgaacagaccgccttcgattcatcagcattcgcttattgcaatgacagttagaatcctcccaacgacttctgttgtctccttgaacccgatctgctgtttgccgttccgtggtgattttgatggagattgtctccacggttacgttcctcagtccattcaagcaaaggtcgagcttgatgagcttgttgctttggataagcagcttatcaacagacagaatggtcggaacttgctttctttaggacaagatagcttgacggcggcttatctggtcaatgttgagaagaactgttatcttaatcgagctcagatgcagcagcttcaaatgtattgcccatttcagcttcctccgcctgcaattatcaaagcttctccttcgagcactgagcctcaatggacgggaatgcagctattcggaatgctgtttcctcccgggtttgactacacttatcctctgaataatgtagttgtgagtaacggcgagcttttgtctttctctgaaggatctgcttggctcagagatggagaagggaatttcatcgagagattgctcaaacacgacaaagggaaagttcttgatatcatctattccgctcaagaaatgctatctcagtggttgctgatgcgcggtttgagtgtgtccttggcggatttgtacctttcctctgatctgcagtctcgaaaaaacttgactgaagagatatcatacgggttgcgggaagctgagcaagtttgcaacaagcaacagctaatggttgaatcttggagagatttccttgcagttaatggggaggataaggaagaggattcagtatcggatttggcccgattctgctatgagagacaaaaatccgctacattaagcgaacttgcagtcagtgcttttaaggatgcttacagagatgttcaggcactagcatataggtatggtgatcaatccaactcttttttgatcatgtcgaaagccggcagcaaagggaatatcgggaagctggttcagcacagcatgtgtatcggtctgcagaattcagcagtttctttgtcctttgggtttccgcgtgaactgacttgcgctgcttggaatgacccgaacagtccacttcgtggcgcaaagggaaaagacagtaccactactgagtcatatgttccttatggagtcattgagaactcgtttctaacgggtctgaatccattggaatcttttgttcattcagttacaagtcgtgacagttcattcagtggtaatgctgatctcccggggacactgagcagaagattaatgttcttcatgcgggacatatacgctgcttatgatggcactgtgagaaattctttcggaaaccagttagtccagtttacttatgagactgatggtcccgttgaagatatcacaggtgaggcacttggctcactttctgcttgtgcattatctgaggcagcttacagcgcgctggaccagccaatcagccttcttgaaacttcgccgcttctgaatcttaaggtcttcctcttcttattcttcgcttcttgatttattgaatcatttccacttaagtcgtttgcatttctctaactagattttatctctttctacagaatgtattggagtgtggatcaaagaaaggtcaacgagaacagacaatgtctttgtatttgtctgaatacctttcaaagaaaaagcacgggttcgaatacgggtcacttgagatcaagaaccacttggagaaacttagtttctcagagatcgtttcaacatctatgataatgttggtaacttttaactgtctatatgaatctttttggttaagggcttctcttaacaaatgtttattgtcttcttggttcatagattctctccaagttctaacacgaaagtaccgttaagcccgtgggtttgccattttcatatctctgaggtataaactcatacccatataaagccacaaacatatatatatatgtgtacagattctaatgaacctcttctttaatttcacagaaagtactgaagcggaaacaactgagcgcagaatccgttgtttcatctttaaacgagcagtacaagagcaggaacagagaactgaagcttgatatagttgacttagatatacaaaacacgtaagaacattcttgaatttgtagcagacatgttttgtttcgcttttatgtctattagaaactgatttgttatacatttatgtgttgtggattagaaaccactgctcttcagacgatcaggcaatgaaggatgataacgtttgcatcacggtgactgtagttgaagcctcaaagcactcggttttggaactggatgctattcgtctcgttttgatcccttttcttcttgactctcctgtcaaaggtaaaaccggatgaaaaataaagacgagcaagctgaacagatcgttgttttgttattatcgttcttatgagttctatcatctgtttttgcaggtgatcaagggatcaaaaaggtgaatattttgtggactgaccgaccaaaagcgccaaaaaggaatgggaatcatttggcgggtgagctgtacttgaaggttacaatgtatggagatcggggcaaaagaaactgttggaccgctcttttagaaacctgccttcccatcatggatatgattgactggggccgaagccatcctgataatatccgacaatgctgctcagtttatggaatagatgctggacgcagcattttcgtagcagtcagtatcggtttctttaacattttcttggtctctctcgcagcttctaaagtttgaagttttttttttgtgaccgcagaatttggagtccgcggtgtcagatactggtaaggagatactaagagagcatctgcttctcgtagctgatagtctctctgttacgggagagtttgtggcattaaacgccaaaggttggagtaaacaaagacaggtcgagtccacgcctgcaccttttactcaagcatgcttctcagtatgtaacaaaatcccatttcttttggttatacaaagcttatataggatttcatttgatacttagtgcttgcttaatctctgcagagcccaagtcaatgctttctcaaagctgctaaggaaggtgtcagagacgatcttcaagggtctatcgacgctttagcttggggaaaagttcctggtttcggaactggagatcagttcgaaatcatcatttcgccaaaggtaaattaactttacatcttttgatccgtttagaccacataacttcagtggtctaatttgtgtctttatgcatgccatcaggttcacgggtttactacaccggtagatgtgtatgaccttttgagtagtacaaagacgatgcgtagaacaaactctgcgcctaaatcagacaaagccacggtccagccttttggcttgctacattccgcattcctgaaagatatcaaggtactcgatgggaaagggattcctatgtcactgcttagaacgatctttacatggaaaaacatcgagttgctttcccagtcattgaaacgcattctccacaggtaagattctactgttcaaaaaaccgtaaagattctttcttccttttggctgatgcaaattacaatggcttaatctttgttagttacgagatcaatgaactgttgaatgagagggacgaaggacttgtgaagatggttctgcagttgcaccccaacagtgttgagaaaattggaccaggcgtcaaaggaatccgggtaaatcaaggctcatatgtttcagaatccttaaagacataaagatcctgaccatgtttcttttataggtcgctaaatcgaagcacggagattcttgttgcttcgaggttgtaagaatagacgggacattcgaagacttctcataccacaagtgtgtcttgggagcaacaaagataattgccccaaagaaaatgaacttctacaagtcaaagtatcttaaaaatggtacactcgagtccggtggtttctccgaaaacccgtgaacagccaagtaagagtaaaaaaaaagactggctcttctgcggtataatatcgaacaatgtatgaagttgtgtgtaattttgtttaaaaagtgattagatagatataggggaaaagccttttggctttgctctaagcttctttttgctcctttcactatgtaataccttttgccttccacctaaaggcttaaaggttaattacttagtggaagcagcaacgagaagctggcaaaggaggcttctgttctgtttctgtttctgtatgtaaaccatgcaaattccggtttgactatgaaatatccggttatgttt

SEQ ID NO: 54 - DNA, 9303 bp, Arabidopsis thaliana
tatcattttagcacttaaatttaatctcacaataattatcgtttttagttttttaatgcaaatgtttaataaaaatgtgagtattaatgtcttgaccaataatttttttagaaactatattgaacaagggtaaagtagaaaatttaattgtttttttttattttcactgcaaaaaatcttaaacgacaaataattttaaacaaaactattttaataactaaccactaaactaactatataactgttttacaaacgaaagcgtgaacttcacgtaaacaaaaattcaatttcacgccgccgacaaaaaaccttaaacgacaactaattttaaatagaaggagtatattttagtaataattatatgttaaactgttttaataaataaccactaaactaactatgtaactgttttacaaacgaaagcgtgaacttcacgtaaacaagaatctaatttcacgtcgccgacaagaaaaactgatttcacttatatatcttgatttattaatggacattcacatactctcaaataagattctagatcttataaattttaatctatttttgtctcaattaatttagttatttatcacatttcgcctcttataaaattatatgataattgtctaagcagctaactaattgtaattgtttttcaaacaaaaaatatattttaattacacataatttttttatcgaacaaaaatatattttaacgaaatataaatgtttcgaatcaaagataacaaatttatagcctcaactatacgtaaaacaaaattttattttacatatcatactttgattgatactaacacaaacttcacaaataaattcgtataattatgtaattttagattatttagagattataactagtatttagaaaaatcgcaaaatcatataagaaaagaaatggaatttgtttttggttcaaattatatttttttttcccgctattcatattatagttatgaaccaaaaatcaagctagaaataaaaaccactaggattttttttttttgctaagatgaaaatttagttatacacttatttttatttatttaaatattacattaaactaataaaaagtattaattattctaataactttttgtcagttttaaaattaggccaaaagtaaaaaactaatacagctaatataatatacttaaggaaggatatttcaactttttcttttcttcccagtttcagagtttatacaaataaggtaaaattcgcagaaacagaaaatcataaagtaattaaaataatacaaccgaggaagtaaaaagatttccaaaaggtaaaaggtgtactcgtaaagtaggtaaatagaggtacaggtcaaggggtagtttcggtatttacactctttcttcttcttttttttttttttttggtgtctcacattccaaagtccccattggacttagagaagagtttttttttcgttttctctgctttctcactttttcccgtttcctttgggaatacaaacggcggcttctcaaaagcctccgatttcgatttttttttcctctctttttttttgttctttctttagagtctcttcttcaacttcttctccggcatcttccgtcggagctaaggatcagaagtttttgtctgtgcactgtttcaattggatcattacatagtgaggattctctgttcgacgaaacgagtaagtaactacattgttgttcttcctcaattctcttctggtttttctttcgtttttttttttaaaacctttttcggtaattttctttttatctctttgaaacaatttgagttctttttttttttgattgatcactgtgtctgattccttatcacggttcttttgtttaaatttgatcgatcgttgtctttgaactccgattttgtttctatgaactttgtttactttggatgattgtgaaaagttaagtactttggtttatgcatgttcttatgagaaatcgatttctttcgtttagagatcatcttaaggcggcgaatgtttttgcactaagggtttgtgtgagtcctttagaagaacatttggaaaatttgtccttttttttttttggtcagtgaatttttttttttttaatccatgaatagtgtatgttcaaagattgaacctttttgtgtgtatgttctgcagttttttttctttcttctttttctgaacatgtattctcttatttttttgggttcatgctagattctattagtaaattcaatttcgaatctataacttgtttttgataggccagtcacagaggaagattgtggtaacacttttgtcccttaacaaaagtgtctgtttctctttggtcaattttttgatcagagagagtttgctttggtttttgtgttctggtcaatgaaatgctaaagattggtttttgtttcatattctgctgcacattagatttgatgatagagggtacagatagaaactgatcttttcgacgatttatccgtgagttttagctctgttttatgttacagaagtaagtgttaattttcaataatgtgtgttcaaagtttgaactattttgtgtgttcgtcaaatatttttgagctagaatcttcttccctgaacatgttctctcttttctttggatatatgctagattctaagtggccactcacagagatagtttgtgaagttgtctgtttctcagtggttagtattggtcagagcgagttttttggttttgtctgtctaaatgctaaatattggttttgtttcatattctgcacattggaattggtcactaaaacttgcttataaaaactgatgtttttacttacgtatctaaattttccttactgatggttttttttcttgtaggaaactcttcaacatggaagacgattgtgaggagcttcaggttcccgtgggaactctaacctcgataggttttagcatttcaaacaacaatgatcgagtaagtgttgtccttatttattcttcttgatttgtttatgagtagatggagcaaatatttaatgtaatggtactttattataggataaaatgtctgtgctagaggttgaagcaccgaatcaggtgactgattctcggctaggattaccgaatccggattctgtctgcagaacctgtggcagcaaagatcgaaaagtttgcgaaggtatcataaagaatctggttttggcaaatattgttccaatcttttagctcattttatgattagttccctgagtttgctacttttctctctgttttagggcatttcggggttataaacttcgcgtactcgataataaacccgtatttcctcaaggaggtagctgcgttgttaaacaaaatctgtccggggtgtaaatacattcgaaaaaagcagtttcaggttcactagtctttccaaatcctttgttggtttgtgtgttttggaactacatatactaatgtcatttttgcttgatatagattaccgaagaccagcctgagagatgtagatactgcactgtaagaatatatgattgcaactaattttctcagtttaaaactttgttccaacactaattttcggtttttgttgttgttatatatcagttgaataccggttatcctctaatgaagtttagggtaactactaaagaagtcttcaggcgatccggaatcgttgttgaagtaaacgaagagagtctgatgaaactcaagaaacggggagtgttaacattgcctcctgactattggagttttttgccgcaagactctaatatcgacgagagctgtttgaaaccaacaaggcgaataataacgcatgcacaggtatagaagagtgaaatgtaccatctccatgacttcttactatatatagttttctgaaaatttcacctttttgcaggtttatgctctgttattagggattgatcagaggctcatcaagaaggatatccctatgttcaactctcttggtctgacatcttttcctgttacaccaaatggttaccgtgtaaccgaaatagttcatcagttcaacggagctcggctaatatttgtaagctaaaaacgcttgtttatataatttgttatcatatactatggtatttctcttatcttttcgagtttctgtcacatttttgaaggatgaacggactcggatctacaagaaactagtcggctttgagggaaacacacttgaattgagttctcgtgtgatggaatgcatgcaatattccagagtaagttagtggttcctgatagatttaaactcttctttctgttctgtgaaggttagtagtatttcttgttttttgcacagctcttttcggaaactgtgtcttcgagtaaagattccgcaaatccgtaccagaagaagtctgatacaccaaaactttgcggtctaaggttcatgaaagacgtgctgctcggtaaaagaagtgatcatacattccggacagtagttgttggtgatccgtccttgaagctcaacgagattggcatacccgagagtatcgcaaaaaggcttcaagtatcagagcatctcaaccagtgcaataaagaaaggcttgtcacttcctttgtccccacactgttggacaataaagagatgcatgtgagaagaggagatagattggtggctattcaagtcaatgacctccaaaccggagacaaaatattccggagtttaatggatggagacactgtgctgatgaacagaccgccttcgattcatcagcattcgcttattgcaatgacagttagaatcctcccaacgacttctgttgtctccttgaacccgatctgctgtttgccgttccgtggtgattttgatggagattgtctccacggttacgttcctcagtccattcaagcaaaggtcgagcttgatgagcttgttgctttggataagcagcttatcaacagacagaatggtcggaacttgctttctttaggacaagatagcttgacggcggcttatctggtcaatgttgagaagaactgttatcttaatcgagctcagatgcagcagcttcaaatgtattgcccatttcagcttcctccgcctgcaattatcaaagcttctccttcgagcactgagcctcaatggacgggaatgcagctattcggaatgctgtttcctcccgggtttgactacacttatcctctgaataatgtagttgtgagtaacggcgagcttttgtctttctctgaaggatctgcttggctcagagatggagaagggaatttcatcgagagattgctcaaacacgacaaagggaaagttcttgatatcatctattccgctcaagaaatgctatctcagtggttgctgatgcgcggtttgagtgtgtccttggcggatttgtacctttcctctgatctgcagtctcgaaaaaacttgactgaagagatatcatacgggttgcgggaagctgagcaagtttgcaacaagcaacagctaatggttgaatcttggagagatttccttgcagttaatggggaggataaggaagaggattcagtatcggatttggcccgattctgctatgagagacaaaaatccgctacattaagcgaacttgcagtcagtgcttttaaggatgcttacagagatgttcaggcactagcatataggtatggtgatcaatccaactcttttttgatcatgtcgaaagccggcagcaaagggaatatcgggaagctggttcagcacagcatgtgtatcggtctgcagaattcagcagtttctttgtcctttgggtttccgcgtgaactgacttgcgctgcttggaatgacccgaacagtccacttcgtggcgcaaagggaaaagacagtaccactactgagtcatatgttccttatggagtcattgagaactcgtttctaacgggtctgaatccattggaatcttttgttcattcagttacaagtcgtgacagttcattcagtggtaatgctgatctcccggggacactgagcagaagattaatgttcttcatgcgggacatatacgctgcttatgatggcactgtgagaaattctttcggaaaccagttagtccagtttacttatgagactgatggtcccgttgaagatatcacaggtgaggcacttggctcactttctgcttgtgcattatctgaggcagcttacagcgcgctggaccagccaatcagccttcttgaaacttcgccgcttctgaatcttaaggtcttcctcttcttattcttcgcttcttgatttattgaatcatttccacttaagtcgtttgcatttctctaactagattttatctctttctacagaatgtattggagtgtggatcaaagaaaggtcaacgagaacagacaatgtctttgtatttgtctgaatacctttcaaagaaaaagcacgggttcgaatacgggtcacttgagatcaagaaccacttggagaaacttagtttctcagagatcgtttcaacatctatgataatgttggtaacttttaactgtctatatgaatctttttggttaagggcttctcttaacaaatgtttattgtcttcttggttcatagattctctccaagttctaacacgaaagtaccgttaagcccgtgggtttgccattttcatatctctgaggtataaactcatacccatataaagccacaaacatatatatatatgtgtacagattctaatgaacctcttctttaatttcacagaaagtactgaagcggaaacaactgagcgcagaatccgttgtttcatctttaaacgagcagtacaagagcaggaacagagaactgaagcttgatatagttgacttagatatacaaaacacgtaagaacattcttgaatttgtagcagacatgttttgtttcgcttttatgtctattagaaactgatttgttatacatttatgtgttgtggattagaaaccactgctcttcagacgatcaggcaatgaaggatgataacgtttgcatcacggtgactgtagttgaagcctcaaagcactcggttttggaactggatgctattcgtctcgttttgatcccttttcttcttgactctcctgtcaaaggtaaaaccggatgaaaaataaagacgagcaagctgaacagatcgttgttttgttattatcgttcttatgagttctatcatctgtttttgcaggtgatcaagggatcaaaaaggtgaatattttgtggactgaccgaccaaaagcgccaaaaaggaatgggaatcatttggcgggtgagctgtacttgaaggttacaatgtatggagatcggggcaaaagaaactgttggaccgctcttttagaaacctgccttcccatcatggatatgattgactggggccgaagccatcctgataatatccgacaatgctgctcagtttatggaatagatgctggacgcagcattttcgtagcagtcagtatcggtttctttaacattttcttggtctctctcgcagcttctaaagtttgaagttttttttttgtgaccgcagaatttggagtccgcggtgtcagatactggtaaggagatactaagagagcatctgcttctcgtagctgatagtctctctgttacgggagagtttgtggcattaaacgccaaaggttggagtaaacaaagacaggtcgagtccacgcctgcaccttttactcaagcatgcttctcagtatgtaacaaaatcccatttcttttggttatacaaagcttatataggatttcatttgatacttagtgcttgcttaatctctgcagagcccaagtcaatgctttctcaaagctgctaaggaaggtgtcagagacgatcttcaagggtctatcgacgctttagcttggggaaaagttcctggtttcggaactggagatcagttcgaaatcatcatttcgccaaaggtaaattaactttacatcttttgatccgtttagaccacataacttcagtggtctaatttgtgtctttatgcatgccatcaggttcacgggtttactacaccggtagatgtgtatgaccttttgagtagtacaaagacgatgcgtagaacaaactctgcgcctaaatcagacaaagccacggtccagccttttggcttgctacattccgcattcctgaaagatatcaaggtactcgatgggaaagggattcctatgtcactgcttagaacgatctttacatggaaaaacatcgagttgctttcccagtcattgaaacgcattctccacaggtaagattctactgttcaaaaaaccgtaaagattctttcttccttttggctgatgcaaattacaatggcttaatctttgttagttacgagatcaatgaactgttgaatgagagggacgaaggacttgtgaagatggttctgcagttgcaccccaacagtgttgagaaaattggaccaggcgtcaaaggaatccgggtaaatcaaggctcatatgtttcagaatccttaaagacataaagatcctgaccatgtttcttttataggtcgctaaatcgaagcacggagattcttgttgcttcgaggttgtaagaatagacgggacattcgaagacttctcataccacaagtgtgtcttgggagcaacaaagataattgccccaaagaaaatgaacttctacaagtcaaagtatcttaaaaatggtacactcgagtccggtggtttctccgaaaacccgtgaacagccaagtaagagtaaaaaaaaagactggctcttctgcggtataatatcgaacaatgtatgaagttgtgtgtaattttgtttaaaaagtgattagatagatataggggaaaagccttttggctttgctctaagcttctttttgctcctttcactatgtaataccttttgccttccacctaaaggcttaaaggttaattacttagtggaagcagcaacgagaagctggcaaaggaggcttctgttctgtttctgtttctgtatgtaaaccatgcaaattccggtttgactatgaaatatccggttatgtttctgttctttaccttgtttatatccgtcttcatgcaattgcaaatgatccttattacatcttcggttttccttatgagaagtgaaacttagttctcttggttatgctctgttttttcctggtttagatcggttctcaatagcatacagtttgttctttctcttaaccggtttagattagttttcttgcaatttgcttatgattcttataagtaaccaaagcctttaagtaatactaatctaaatatctccacatattatcttcaaatgtattgatcagagaaaatccccaacactatcatcacccctcaagaaaatacaggaaacattttcga

SEQ ID NO: 55 - DNA, 10590 bp, Arabidopsis thaliana
tgtgatggagtagagaaagcagatagtctttatcagtagttgtatgagtcatacaatagtacccgaacccacttatccaaagatcaatgtcgaaagtggaaaccaaatccctctaaagtaaattgaatagccagtctaaaagttagaccaaatctgaaagtcggtttaattgcaattataccttctaaatgcaagaaccaatatcaaccggtacttcatattcttttgatttttgatttgtacatataaacttttttttgtacatataaacttaaatgcaagtatagcttgacttgtattttacacatcagcggaaaagtttgagagaggaagcatattgtatttcgtttggttacaacttttgctaacttttacaataaatggaatgaaatttttttccacttaattcctcctgaatagaaagaaattgatgcaattttgttccctttttaaatccatgagccaataagtgcatctccaattatattccaaatttcactctaaatactaatttagaaaaaatccttttaataccactatattctcaactctaaaagggagtgatgaatatggtatgatatcatctgtcacttcattttggagttaccctttactttttatttacaaaatattttcctaaatttatactcatgttcttcatttatgtgtaaacaaaattatataaatgaagaaaaagagttattgttaaccttctccatgttttcattataaattgatatgagcattggttaccgttctttcggataaaaacgaagtttatctcttgaaaacattgttcctttcatattcatatcgcatcaatatataattgaaaagttcatttatggtgatcgatcaaatatataacaaaataaaatgaaaaaatactttaacattttatatataatttttgaagacaaaagagctgtttttttgtctttaattgattggtcaactgtttacatattcatttttttggtatgaactatttacaaattcatgaatacaaaaaatatctcaaatttttttttacaagtcgatccacttagttcttaccgtttttttggtataaccattattttataaaacatcgttcccgctagatttttatcgcatcaaacatagcgtactacaaacggaaacggtcatctatggcgatcgatcaaatatacaacaccaaaatcgaatccaaaaaatagtttacttgaagtatttatatgttttgcttcactgctaattctatggttttgaaatcctttattcttctcaaaaaaaaaaaaagtttgtcaatggttgttgacatggtcttgcataatatgtggataaatatttgttttaatcattttcatcatcattgcatattcccaagtgttatcaattgtttgacaaataaagaaaaattaaaattgatacctttttattttagttaattaataacgaaactgaaaatatttctccctttgcatgcaatgtgggttttaaagacggaagctgaagagtgaagaagaacaaaagatttttgagagagaaaagtagagtcactccaaaattgttctctcgcaatcttctttctcggtttcctcttttaagaaaaagtccgccattttcactctcactcagatttcttccctcttctcacctgcaaaaacccttgtttcccgctgtttcgtttcttctccggttgaggaaccaaaacgggtcaaatacgcagctgaatcatcgaattcttaggtattttcgtcttacccaactcttatctttagatgtttttccgggaaaagagctcgatcatgactccgccgtgtttttttttgggggggggggggtttctccgaaatgggtttcaaatgtaggttactctaggtttgaaagttcggattttttggttcactgtgtgttactacagcttcgattttgtgtaaacgagtataaaaattgtatcttttacagatttgagaacttgttcttcaaagacttgatttttctttgtatcaagttagtgagctcaaatgtctttgtttctctgtttgtttacatctgataagagctaactcggtctcgctggtgtgtgattttcgctcgttagggttttttcatggaggaagaatctacatcagagattcttgacggagagattgttggaatcacatttgctcttgctagtcaccatgaaatagtaagttataagagttatactctctggaattgatccatcttgttctgcatcaatgtttatcatgggttttacataactgaaggatttcgaatagctaaaacctctatgttttggttatctttggcactaaattcactataattgtactcaagctctgtgtgatgctaagtgctacacttttgcatataaatgttgttctgcgatatatcctctgtcactattccatttctcactggactgtaattctttcttgcagtgtattcaatcgattagtgaatccgcaattaatcatcccagtcaactcactaacgcattcttggggttacctcttgaatttggtaaatgtgaatcttgcggtgcgacagaaccagataaatgtgaaggtaatccagttccgtagttgctatatttttgttcttacatcatttgttggaatacttcttcagatatcggtatttgtttctacattttcaggtcattttggttatattcagcttccagtgccaatataccatcctgctcatgttaatgagttgaaacaaatgctgagccttctgtgcttgaaatgtctgaagataaagaaggcaaaggtattacctcattgagttttcttaaattccatgtgatccacacataaataaaccatataaaatctcgactaatctttttcacctttctgagtacagggcacaagtggtggtctggcggatcgcttgttgggtgtctgttgtgaggtgagtaatggcatatacattctgattgtttccttttaagttttacctgaaagcaagttgatagatgtttcttatgtgaacctggttcagcatttagttagtttttctaagttttccttcaactagttgcatgttagaaaacttgctaattcaaatctaaatagtatttgtgcttcttttgatccattcagtgaaagtaacattaatcaatgcttgtgaagcagtagctattggtattttcgtggcatcatgaaacattcactgctttatgttattttggatgttattattgctgaacgtcttggatttttaactactatattactttattaggaagcttcgcaaatctcaatcaaagatagagcatcagatggtgcctcatatctagaactgaagctcccatctaggtcaagactgcagcctggttgctggaatttcctggaaagatatggttatcgctatggaagcgattacacgcgtcccctgctggcaagagaggtttttactttcttctgtgtgtttatgtttctgtttatgtaggattttatggtgacgttctttttgttcatttggaatcattctctatctttaagatcttttctttctggaaactgatgattatgtactttccgtgtccttttccatatggtgggaaaacaaataggttaaggaaattctaagacggatccccgaagaatcaagaaagaaactcacggcaaagggacatattcctcaagaaggatacatactagagtatcttcctgtcccgcctaactgtttgtcagtgccagaggcttctgatggtttcagcaccatgtcagtggtaagttgaaactaaattactatgttgagttgaatgctttggcttgtgttgtaacccctggatttgtgtcattcttattttcaggatccttccagaattgagctaaaggacgttctgaagaaagtcatagccataaaaagctctaggtctggcgagacaaactttgagtcgcataaggctgaagccagtgagatgtttagagtggtggatacctatctccaggtgaggggtactgcaaaagcggcaagaaacattgatatgagatacggggtgtctaagatctcggatagttcatcttcaaaagcttggacagaaaaaatgagaacacttttcatccgtaagggttcaggtttctcttcccgtagcgtcatcactggagatgcttaccgacatgtgaatgaggtagggatcccaatagaaattgcgcagagaatcacatttgaggaaagggttagtgtccacaatagaggttatctacaaaagttggtagacgacaagttgtgtttgagttatactcaaggttctacgacctattctttaagggatggatccaaggggcacactgagcttaaacccgggcaggttgttcatcgcagggtcatggatggggatgttgtgtttatcaacagacccccgacaacacataaacattctcttcaagcgcttcgggtgtatgttcatgaagacaacaccgtgaagattaaccctctgatgtgtagccccctcagtgctgattttgatggtgattgtgtccatttgttctaccctcagtctcttagtgctaaggcagaggttatggagctcttctctgtggagaagcaactgcttagctcacatactggacagctgattttgcagatgggtagtgattctttactgtctttgagggtaatgctggagcgggtatttctggacaaggcaactgctcaacagttagctatgtatggctctctgtccctgccaccaccagcactaaggaagtccagtaaatctggcccagcttggacagttttccagattctacagcttgcctttccagaacgtctgagttgcaaaggagacagattcctggttgatggaagtgatttgctgaagtttgatttcggggttgacgcgatggggtccatcatcaatgaaattgtaacttcaatcttcctggagaagggtccaaaggagacacttggattctttgattcgctgcagcctctattgatggaaagtctgtttgctgagggatttagtctaagtttggaagacttatccatgtctagggcagacatggatgtaattcacaacctaataatccgagagatttcacctatggtgtctcgcttgagattatcatatagagatgaattgcagctagagaacagcatccacaaagtgaaggaagtggctgctaactttatgctgaagtcatattccattcggaacttgattgatatcaagagtaactcagcaatcaccaagctggtgcagcagacaggcttcttgggtcttcagctttctgacaagaagaagttttacacgaagactctggtagaggacatggctatcttttgtaagagaaagtatggcaggatttcttcatctggtgattttggaatagtgaagggctgcttctttcatgggctggatccgtatgaagagatggctcattcaattgcagctagggaggtaattgttcgctcttcaaggggattagctgagcctggaaccctctttaagaacctgatggctgttcttcgggatatcgtgattacaaacgatggaactgtaagaaacacctgtagtaactcagtcatccagttcaaatatggagttgattctgaacgtggacatcaaggtctgtttgaagctggagaacctgttggagtattggcagctactgccatgtcaaatcctgcatataaggcagtgcttgattcctctccaaatagtaattcatcatgggagctaatgaaggtatagcaatatcaaatctgccttctgaatacagctttgttcatctgtattgttgtgtaattgttttctgtatttgttcttttcccaggaagttctgctctgcaaagtcaatttccaaaacactactaatgatcggcgcgtaatcctttatttaaacgaatgccattgtggaaaaaggttttgccaggaaaatgctgcttgcacagtcaggaacaagctgaataaagttagtcttaaagatactgcagtggaattcctagtcgagtaagaattgggttttagtaacttcagtcgctctttttagtgtttgtgttattttttttttatggttttactaaacctctttgcaatctgctttctctttacttgcatgaagatatagaaagcaaccaactatatcagaaatttttggaattgattcatgcctacatggccatattcatcttaataaggtttgaatctggttcctttactgttgaatctttctggaagcctctacctgtcatagaaacactttcctattatccttttcttgctgtgtaattggtgtttttggtttactagacattgctgcaagattggaacatcagtatgcaggatatacatcaaaagtgtgaggatgtaattaactcactaggacaaaagaaaaagaagaaagctactgatgatttcaagagaacaagtttgtctgtcaggtttgtacaatgatttgcttttcctctggatgtcgtctctggttgaatgttatgcataatttgtccagaaagcaagtctgatgttgatttctagttttccagttatcttctttccatcatttttgttcttcatagcataatgtctagctttggtttctacctgattatgattgatttattctccaatgaacagtgagtgctgctctttccgagatccttgtgggagcaaaggttcggatatgccttgtttgacgttctcctacaatgccaccgatcccgatctagaacgaactcttgatgttctttgcaatacagtttacccagttctgctggaaatagtgatcaaaggtatttgaataaaacttttcatttttgtatatttcgcttgtttccctacacttcgatttcttctttgatgggggagcagtgtatctgatagagtcttcctttcaaaattttgtagttacatggcttacgaaattttgttttttgccagaagtttaatgaaccaaaatattttctcaactagtctgattgaattttcctccaagttgtgatcgatattctgtgctactataaaagaaagcctatgttttagtaagatttctagatacatgtttttgatgatactcctgtatctaaactgagcaggtgattcacggatttgctcagcaaatataatctggaatagttcagacatgacaacgtggatccggaatcgtcatgcatcccgccgaggggaatgggttttggatgtcactgttgaaaaatctgctgtcaagcaaagtggtgatgcatggagggttgtgatagactcatgtctttcagtgcttcatctaatagacacaaaacggtcaatcccttattctgtaaaacaagtgcaagaattgcttgggttatcctgtgcttttgagcaagcagtacaggtacttactaacttaaaacgtgatccgttcctggatcttacacttaagtcatgatacttcttacatatttcatgtttggtatcacatttgctcattgtttgtgtaaggattttaaacgtaagatgttgatttgatttgcagcgtctatcagcttcagtgagaatggtctccaagggagttttgaaagaacacatcattctcctagcaaacaacatgacttgttcagggactatgttgggtttcaattctggaggttacaaagctttgacccgatccttaaacatcaaggctccattcacagaagcaactctgattgttagtagttcaatcctttagtctaatacaaattattttcttagactatatactggccgtcatgttaacaggaattactttttgtgcctttaggcaccaagaaaatgttttgagaaagcggctgagaaatgtcatacagattcactatcaacagtcgttgggtcttgttcttggggaaaacgcgtggatgttggtacaggctcacagtttgagctcctatggaaccaaaaagaggtagacattctcactggaaatcataccaattgactgaggttttctcatataagtttgttatgtaattttatgtcatttgttgtcaacctatttgcagactggtctagatgataaagaagaaacagatgtgtacagcttccttcaaatggtcatatccacgacaaacgcagatgcatttgtttcttcccctggttttgatgttacagaggaagaaatggctgaatgggctgaatcgcccgagcgagactctgctcttggagagcccaagtttgaggacagtgccgacttccaaaatttacatgacgaaggcaagccatcaggagccaactgggagaaaagctcttcgtgggacaatggttgcagtggtggttcagagtggggagtctcaaaaagtacaggtggtgaggcaaacccggagtctaattgggaaaagactacaaatgttgagaaggaagatgcttggtctagttggaacactagaaaagatgctcaagaatcttccaagtcagattcagggggtgcttggggtataaagacaaaggatgctgatgcagatacaacaccaaactgggaaacaagtccagctccgaaggattccattgtcccagaaaataatgagccgacttctgacgtttggggacacaaatctgtttcagacaaatcgtgggacaaaaagaactggggaactgaatcagctcctgctgcatggggttctacagatgctgctgtttggggttctagtgataaaaagaactcggaaacagaatcagatgctgctgcttggggttccagggacaaaaataattctgacgttgggtcaggtgctggtgttttaggtccctggaacaagaagagctcggaaactgagtcaaatggtgctacttggggttctagtgacaaaaccaaatcaggtgctgctgcatggaattcttgggacaaaaagaacatagaaactgactcagaacctgctgcttggggttctcagggaaaaaagaattctgaaactgagtcaggtcctgctgcttggggtgcttgggacaaaaagaaatcggaaactgaaccaggtcctgctggttggggtatgggggacaaaaagaattctgaaactgaattaggccctgctgctatgggtaattgggacaaaaagaaatcggatacgaaatcaggtccagctgcttggggatctacagatgctgctgcttggggttctagtgacaaaaacaactcggaaactgaatcagatgctgctgcttggggttctaggaacaaaaagacttctgaaattgaatcaggtgctggcgcttggggttcgtggggacagccaagtcccactgcagaagacaaggataccaatgaggatgatagaaatccgtgggtttccttgaaggagaccaaaagtagagagaaggatgataaagagagaagccagtggggaaatccagccaagaaatttccatctagtggtggctggtccaatggtggtggtgcagactggaaaggaaataggaaccatactcctaggccacctagatctgaggataatttggctcccatgtttacagcaacgagacagcgcttggactcattcacctctgaggagcaagagctgctctcagatgttgagccagtcatgaggactctcaggaaaattatgcatccgtctgcgtatgcctttctagttcttacgctctgtttatacaatttccagttctatgtataattaattatgctgtttcacatgccatatacttgttatgcttcatctatctaaaactatcttctttcgatgaaggtaccctgatggagacccaatttctgatgatgacaagacgtttgtcctggagaagattttgaacttccatccccaaaaagagacaaagcttggttctggcgttgacttcatcacggtaaacaacatttctccttaacaaacttagcttctcttctaaagcttacttagccttatgcctgatgtgaaattcttggttgaacaacgatgtaggttgataagcacaccatcttctcagacagcaggtgcttctttgttgtctcaactgatggggccaaacaggacttttcataccgaaaatccctcaacaactatttgatgaagaaataccctgaccgtgctgaagaattcattgacaagtactttacgaaacctcggcctagcggaaacagagacaggaacaaccaagatgccacaccacctggggaagaacagtctcagcctccgaatcagtctataggtaatggaggtgacgactttcagacacagactcagtctcagtctccatctcagactcgggctcagtctccatctcaggctcaggctcagtctccatctcagacgcagtctcagtctcagtctcagtctcagtctcagtctcagtctcagtctcagtctcagtctcagtctcagtctcagtctcagtctcagtctcagtctcagtctccatcccagactcagactcagtctccgtctcagactcaggctcaggctcagtctccatcatctcagtctccgtcccagacgcagacataaactcttgagaaccaaagaagatttggttcgtttaggtaaaccattcagtctccactgttttgttttgatgtacataaagagtggagagaatggcggtttttatcattaaaagactctgatgtgaagtgcaaaacaatgtgtaaatgcagttctctagtttcagatcgtttgtcctaa

SEQ ID NO: 56 - DNA, 7960 bp, Arabidopsis thaliana
aatgaaccataaggtaaacttacaagaaccctataaaagcctttcaggatcaagctgtttaaaccctggtcatcagaagcaattcagctttcataagacaagtatcctaaactaataagactcagaagtcagagccactcgttgtctattttggtgcaacagctaaacttgaaccttccccaaagtcaattcatttctttagattacttacttcaaaaatcaaagtgaaaggagcaattttttaagtccacaaaccaaaaaggaactcgccttggattcgcagcgaactcgaaatcccctgcgtgaagttctgcagccaaaagccttgtaaccaaacaccaatctcatcccagaaacttgaaattcaggagctgaggagcagtgagaaacgagaatcgaagctccgagagacgttgaagccatggctgaggagataagaggttatcgtgatgaagttgcttgcatagagagaatatatgagaggagaaagagagaaagatgaagaagcaaagaaaggtagaaagaaagagacgagaaagtaggtcgatgtcatgattacgatttttcacaggaaagatcagttccaagttggttggcaccgctacagaagcatggcttcttcagactctcagagataataaaacaaaaaacagagctcaatacttacacttatataataactttttatttacttatatattatatttctataattagatcagatttaacctaataaatcaaactacccataattatgatgtcccaaatttggtaactatttgatgattatttctaaactgtaggagcaaccccaactttgtatcttagctaatttttaggtataaaagtgattaaatttaatgaaaccaataaactttagctaagataaacatctttattaagcctctccgtcactcaccaaaaaaaaaaacatctttattttattttttttggttaaacaaaaacatctttattaagatattttcttaaaactaagaaaagcatatgtgttgtgttttgagtgggtagacattgtgttgaaatagtttgttgtttcttaaaattctaatcgttcttaaccattgaagtagaaattggttaaacttcttcctaacttttcttaacttagtaaaaacaacattttaatttaaaataagcttaagatccaaaattaaaaattaattgattttaaaccattgggattgctctgagcttttttagtgaattatgtgttgttttttttctttgtgttttggtcaaaattaagttatatatgaaatttattaaaccaaacaaccaaatcgaattagatgtaaaaaccaaaatgtagatgttacaaattttggaaaaaaaaaaagatgttacaaattttatgtcatgtgaacttctaaatatatttccttttcactttaaaataaaaataaaataaaacttaaacataaaaatatagataccaaagagcaaaatttaataatattgtctactagtactagtgacgtcaatttcttcacttctctttgactgcttcgcttaaccactgaaaaagtgtgccaagggttttctacgtcgaatctctccgcattctcagcgattttccggcgacgtttactctgcactcctccgacaccgccgttttactccatcgtgccagctttaagcaatcaaggtacctattttaggtaatacgctttgattctgcttttaagcatcggagaatatgttatggagaatgattcggttctaagggaaagttgttgatttcgtgtttgtattcgcatgattgcattttcgtggttcatgattttcacagctttttaatcaatttctctgtctttgtttagggtttttgttcgtacagtgtgttttgaggtatgccagatatggacattgatgtgaaggatcttgaagagttcgaggctactactggggagatcaatctatctgagctaggagaaggttttctgcagagtttctgcaaaaaagctgcaacttctttctttgataagtatggacttataagtcatcagctcaactcctacaactacttcattgaacacgggcttcagaatgtgtttcaatcctttggtgagatgcttgtggaaccgtcttttgatgttgtaaagaagaaggataatgattggagatacgcaacggtgaagttcggagaagtcactgtggagaagcctactttcttttcggatgacaaggagcttgagtttctcccatggcatgctaggcttcagaacatgacatactctgcaaggatcaaagtcaatgtccaagttgaggtaacagaaattctttgtcgaaattaagtaaccttgtctggatttgatgaatgataaagaacacatggtataagcttatttcttgatgtttctactagactctttctgacacatatatgaagatgttgacatacactgaggttcctgtcatagatttctcaatttaacttgccatcaaataatttactaagggttaaggaacatatttgtctgaaactggtttcactctttttggctttacaagttttctgtaattggatttggttccttatttgcattcgctggatttcttacctgagcaaaatatctagtaaaagagatttattacagttacatgttcgtgtgaagtagaggtgtatttcaagcttggttgtgtttaagattgatgattttgtctgctcccaatctttagatgtttcttgtttaaaatttgaattgtgattacttttccttgtagtggtgggtattcaaacgaaataagctttagtttgtttcattttaaagtttggatgcaataaaagaaaaacatcttcagcttttttttttatttagttcttccccactgcctcactgtgctttagtttgagtgttttatgcttgtgtgcaatgactcttgtactgtcaaacttttgatgatgtttctgttttgctgtccatgtatcttattcttataaatgtagtttattgtctaactgcttcttcactctataaattgactaggtgttcaagaatactgttgttaaaagcgacaaattcaagacaggacaagacaactatgtcgagaagaagatactggatgtcaaaaagcaggacattctaattggtagcattcctgtcatggtgaaatctatcctttgcaaaacaagcgagaaagggaaagaaaactgcaaaaagggggattgtgcctttgatcagggtggatatttcgtgataaagggggctgagaaggtgagtttaactaatacatacatatatgcatattgccattcaatacgtacaataactttattttctatgccaaaacggattttgtttgtcagcaatccataaaacggattatagttacaattttctatcatcagataatagtgtttatcagcaaaaagatgttacaaattagacaataacctatttggttcattttattttcctaatggagatgaagtaagaaattaagaaacttaacttatttatgactttgtatacttcgttagcatcaaagatataaactttttctttcctttctggcttgaccatgaggccatgagtattcaaatcttacaggaagcgttctttgcaatcttaggctctgggacagatgatttgactctaatatattctggaaaaaatattttcaagttgttatacttctccctaacgttattatattgttttgcaggtgtttatagctcaagaacagatgtgcacaaagagactgtggatttctaattcaccatggacagtctccttcaggtccgaaaataaaagaaatagattcattgtgcgcctctcggagaatgagaaagcagaagactataagagaagggagaaagtactgacagtgtacttcttgtcgactgagattccagtctggctcctcttctttgcgctaggtgtttcgtcagacaaagaagccatggatctaattgcttttgatggtgatgatgcaagcattaccaacagtctcatagcttctatccatgtagctgatgcagtttgtgaagcttttcgctgtgggaacaatgctttaacatatgttgaacagcagatcaaaagcaccaaattccctcctgctgaaagtgtggatgagtgcctccatctgtatttgtttccaggcctccaaagtttgaagaagaaagctcgattcctgggctatatggtgaagtgccttctgaactcgtatgcgggaaaaagaaaatgcgaaaacagggacagtttccggaataagcgaattgagctcgctggagaactattggagagggagataagggtgcatctggcacatgctagaagaaagatgaccagggccatgcagaaacacctctcaggcgatggtgatttgaagcctattgagcattatttggatgcttctgttatcacaaatgggcttagtagagccttctctactggagcatggtctcatcctttcaggaagatggaaagggtttcaggtgttgtggctaatttgggtcgtgcaaatccattgcagactctgattgatctgaggagaacgcgacagcaagtcttatataccggcaaggttggagatgctagatatccgtaagtgaattccacctcctctggtatatttaaatatatctcacgtattttaacttactggtctggtctgcatttactccattttacatgtcttcagactgttttaaagatattcgtaataactttaattcaatgtagtatatgatgccgatcactgtttctgcagtctcttgtctgtgtataatacttattttgtatagatgttactgctattaaaaaactctgatactgtctttcttgtttctttctcccttggtcaatctatctgttgaactcttgagattatccattttggttccttttcaatgtgagcggttagacaattaaatcgtgttgggaaactgaactatagctgcattgtttgtaatgttggccacaggcacccctctcactggggcagagtatgctttttgtcaactccagacggtgaaaattgtggtcttgtgaagaacatgtctcttctgggacttgtgagcacccaaagtttggagtctgtggtggaaaagctcttcgcttgtggaatggaagagctgatggatgatacatgcacaccattgtttggcaaacataaagttcttctcaatggagactgggttggattatgtgcagattctgaatcctttgtcgcggagttaaaaagcaggcggcgccaaagtgaattacctcgtgaggtatcttctgtttcagcaaatctcttgctatattttgatattcttgtgttacttggtatttgctttggatttttctgcttcagatgtgtctatgtcgaatattgtttatatatatgaaacgttctctgcagatggaaatcaagcgagataaagatgacaatgaggtaagaattttcactgatgctggtagactactccgacctctcttggttgtggaaaatctccaaaagttgaagcaagaaaaaccttcacagtatccttttgaccatcttcttgaccatgggattctcgagctgatcgggattgaggaagaagaagactgtaatacagcatggggaatcaaacagcttctgaaggaaccaaagatatacacacattgcgaattggacctgtcattcttgttgggtgtgagctgtgcagttgtcccatttgcaaatcacgaccatgggagaagagttctctaccagtcccagaagcactgccaacaagccattggattctcatcaacgaaccctaacatccgctgcgatacgctgtcccagcagctgttctatcctcagaagccactgttcaagacattggcgtcggagtgtcttaaaaaagaagtgctgttcaatggccagaacgcaattgttgctgtgaatgttcatctcgggtacaaccaagaggattccattgtgatgaacaaggcttcattggaacgtggtatgttccgttcagagcagattagaagctacaaagcagaggttgatgctaaagactcagagaagaggaagaagatggatgagcttgttcagtttggaaagacacacagcaaaatcggcaaagtagacagccttgaagatgacgggtttcctttcattggtgctaacatgagtactggcgatattgtcattggcagatgcaccgagtctggggctgatcacagtataaagctcaagcacactgagagaggaattgtgcaaaaagtggtattatcatctaatgatgaagggaagaattttgctgcggtttctctgagacaggtaagttccagatcatactaaatcgagctgttttttcagagaatgcattcctatgtatgaatcgaatgttccattgattggcttttacatcttacaggttcgttctccatgccttggagataagttttccagtatgcatggccagaagggtgttttaggctacctagaggaacagcagaattttcctttcacgatccaaggcatagttcctgatattgtgataaacccgcacgctttcccttctaggcaaacaccaggtcaactcttggaggctgctctctccaaaggaatcgcttgtcctatacaaaaggagggtagctctgctgcatacaccaaattgacacgtcatgccactcctttctccactccgggtgtcactgaaatcaccgagcagcttcacaggtacattcttcacattgtctcttggttttagctcgtaaaacagaatataaaattatatgctataacagatttacatttgcttcctatacaaatagatgatatcattaagggcaggaacatattattgataatatttcctcgttgaagatgtttaaacttggagactttggctacagaatttccaaaagttgattgagctaatatactgcacaaggcactaagctagatttgagcaccttacttgaaacatgtcatagtggatctttattttgttttctaggagtactagaagtgagcatgagttatctgtctctgtaagactaaaaaactaagaagttcaatgttctatggttgattaatttcttgtattgtgcctgaaaaacgtctagagaatacagaaaaataggctcaagagtcatgtaccagtatataattagttagaggattgatgctgtgagccttgtgatctatgtataattcatttaacctttcttagattattgttgattcttgagtcctgattcattaccaatggtaaatatttgtgattagggccggcttttcaagatggggaaacgaaagggtctacaacggtagatcaggtgagatgatgcgttctatgatattcatgggcccaactttctaccagcgacttgtccacatgtcagaggacaaagtcaagttcaggaacactggaccagtccacccgctcacacgccagccagttgcagacaggaagagatttggcgggataaaatttggagaaatggagcgagactgcctaatagctcacggtgcatcagctaatctgcatgagcgtctcttcactctaagtgactcttctcagatgcacatctgcagaaaatgtaagacctatgcgaatgtgatcgagaggactccaagcagtggaagaaagattagagggccatattgtagagtctgcgtatcctcagaccatgtggttagggtctatgttccgtatggagctaagcttctgtgtcaggagctgttcagcatgggcatcactctcaacttcgacaccaagctatgctgattccccctctttattatgtaaatggcttattgccttaagaccatgttatgtgtagtttgcttcagtcccggttctggttagtagtataggttttggtttggttgattcggtaagggttatccgaaccgaagaaatcgtaaaaccgagccactgatgactgaactaacccgtaagtgttgcttttgtgagatttgactctttaaccgttaataattctcggatctaaagtaaagttttagg

SEQ ID NO: 57 - DNA, 7985 bp, Arabidopsis thaliana
tgttacatataattcaggaaatgaaccataaggtaaacttacaagaaccctataaaagcctttcaggatcaagctgtttaaaccctggtcatcagaagcaattcagctttcataagacaagtatcctaaactaataagactcagaagtcagagccactcgttgtctattttggtgcaacagctaaacttgaaccttccccaaagtcaattcatttctttagattacttacttcaaaaatcaaagtgaaaggagcaattttttaagtccacaaaccaaaaaggaactcgccttggattcgcagcgaactcgaaatcccctgcgtgaagttctgcagccaaaagccttgtaaccaaacaccaatctcatcccagaaacttgaaattcaggagctgaggagcagtgagaaacgagaatcgaagctccgagagacgttgaagccatggctgaggagataagaggttatcgtgatgaagttgcttgcatagagagaatatatgagaggagaaagagagaaagatgaagaagcaaagaaaggtagaaagaaagagacgagaaagtaggtcgatgtcatgattacgatttttcacaggaaagatcagttccaagttggttggcaccgctacagaagcatggcttcttcagactctcagagataataaaacaaaaaacagagctcaatacttacacttatataataactttttatttacttatatattatatttctataattagatcagatttaacctaataaatcaaactacccataattatgatgtcccaaatttggtaactatttgatgattatttctaaactgtaggagcaaccccaactttgtatcttagctaatttttaggtataaaagtgattaaatttaatgaaaccaataaactttagctaagataaacatctttattaagcctctccgtcactcaccaaaaaaaaaaacatctttattttattttttttggttaaacaaaaacatctttattaagatattttcttaaaactaagaaaagcatatgtgttgtgttttgagtgggtagacattgtgttgaaatagtttgttgtttcttaaaattctaatcgttcttaaccattgaagtagaaattggttaaacttcttcctaacttttcttaacttagtaaaaacaacattttaatttaaaataagcttaagatccaaaattaaaaattaattgattttaaaccattgggattgctctgagcttttttagtgaattatgtgttgttttttttctttgtgttttggtcaaaattaagttatatatgaaatttattaaaccaaacaaccaaatcgaattagatgtaaaaaccaaaatgtagatgttacaaattttggaaaaaaaaaaagatgttacaaattttatgtcatgtgaacttctaaatatatttccttttcactttaaaataaaaataaaataaaacttaaacataaaaatatagataccaaagagcaaaatttaataatattgtctactagtactagtgacgtcaatttcttcacttctctttgactgcttcgcttaaccactgaaaaagtgtgccaagggttttctacgtcgaatctctccgcattctcagcgattttccggcgacgtttactctgcactcctccgacaccgccgttttactccatcgtgccagctttaagcaatcaaggtacctattttaggtaatacgctttgattctgcttttaagcatcggagaatatgttatggagaatgattcggttctaagggaaagttgttgatttcgtgtttgtattcgcatgattgcattttcgtggttcatgattttcacagctttttaatcaatttctctgtctttgtttagggtttttgttcgtacagtgtgttttgaggtatgccagatatggacattgatgtgaaggatcttgaagagttcgaggctactactggggagatcaatctatctgagctaggagaaggttttctgcagagtttctgcaaaaaagctgcaacttctttctttgataagtatggacttataagtcatcagctcaactcctacaactacttcattgaacacgggcttcagaatgtgtttcaatcctttggtgagatgcttgtggaaccgtcttttgatgttgtaaagaagaaggataatgattggagatacgcaacggtgaagttcggagaagtcactgtggagaagcctactttcttttcggatgacaaggagcttgagtttctcccatggcatgctaggcttcagaacatgacatactctgcaaggatcaaagtcaatgtccaagttgaggtaacagaaattctttgtcgaaattaagtaaccttgtctggatttgatgaatgataaagaacacatggtataagcttatttcttgatgtttctactagactctttctgacacatatatgaagatgttgacatacactgaggttcctgtcatagatttctcaatttaacttgccatcaaataatttactaagggttaaggaacatatttgtctgaaactggtttcactctttttggctttacaagttttctgtaattggatttggttccttatttgcattcgctggatttcttacctgagcaaaatatctagtaaaagagatttattacagttacatgttcgtgtgaagtagaggtgtatttcaagcttggttgtgtttaagattgatgattttgtctgctcccaatctttagatgtttcttgtttaaaatttgaattgtgattacttttccttgtagtggtgggtattcaaacgaaataagctttagtttgtttcattttaaagtttggatgcaataaaagaaaaacatcttcagcttttttttttatttagttcttccccactgcctcactgtgctttagtttgagtgttttatgcttgtgtgcaatgactcttgtactgtcaaacttttgatgatgtttctgttttgctgtccatgtatcttattcttataaatgtagtttattgtctaactgcttcttcactctataaattgactaggtgttcaagaatactgttgttaaaagcgacaaattcaagacaggacaagacaactatgtcgagaagaagatactggatgtcaaaaagcaggacattctaattggtagcattcctgtcatggtgaaatctatcctttgcaaaacaagcgagaaagggaaagaaaactgcaaaaagggggattgtgcctttgatcagggtggatatttcgtgataaagggggctgagaaggtgagtttaactaatacatacatatatgcatattgccattcaatacgtacaataactttattttctatgccaaaacggattttgtttgtcagcaatccataaaacggattatagttacaattttctatcatcagataatagtgtttatcagcaaaaagatgttacaaattagacaataacctatttggttcattttattttcctaatggagatgaagtaagaaattaagaaacttaacttatttatgactttgtatacttcgttagcatcaaagatataaactttttctttcctttctggcttgaccatgaggccatgagtattcaaatcttacaggaagcgttctttgcaatcttaggctctgggacagatgatttgactctaatatattctggaaaaaatattttcaagttgttatacttctccctaacgttattatattgttttgcaggtgtttatagctcaagaacagatgtgcacaaagagactgtggatttctaattcaccatggacagtctccttcaggtccgaaaataaaagaaatagattcattgtgcgcctctcggagaatgagaaagcagaagactataagagaagggagaaagtactgacagtgtacttcttgtcgactgagattccagtctggctcctcttctttgcgctaggtgtttcgtcagacaaagaagccatggatctaattgcttttgatggtgatgatgcaagcattaccaacagtctcatagcttctatccatgtagctgatgcagtttgtgaagcttttcgctgtgggaacaatgctttaacatatgttgaacagcagatcaaaagcaccaaattccctcctgctgaaagtgtggatgagtgcctccatctgtatttgtttccaggcctccaaagtttgaagaagaaagctcgattcctgggctatatggtgaagtgccttctgaactcgtatgcgggaaaaagaaaatgcgaaaacagggacagtttccggaataagcgaattgagctcgctggagaactattggagagggagataagggtgcatctggcacatgctagaagaaagatgaccagggccatgcagaaacacctctcaggcgatggtgatttgaagcctattgagcattatttggatgcttctgttatcacaaatgggcttagtagagccttctctactggagcatggtctcatcctttcaggaagatggaaagggtttcaggtgttgtggctaatttgggtcgtgcaaatccattgcagactctgattgatctgaggagaacgcgacagcaagtcttatataccggcaaggttggagatgctagatatccgtaagtgaattccacctcctctggtatatttaaatatatctcacgtattttaacttactggtctggtctgcatttactccattttacatgtcttcagactgttttaaagatattcgtaataactttaattcaatgtagtatatgatgccgatcactgtttctgcagtctcttgtctgtgtataatacttattttgtatagatgttactgctattaaaaaactctgatactgtctttcttgtttctttctcccttggtcaatctatctgttgaactcttgagattatccattttggttccttttcaatgtgagcggttagacaattaaatcgtgttgggaaactgaactatagctgcattgtttgtaatgttggccacaggcacccctctcactggggcagagtatgctttttgtcaactccagacggtgaaaattgtggtcttgtgaagaacatgtctcttctgggacttgtgagcacccaaagtttggagtctgtggtggaaaagctcttcgcttgtggaatggaagagctgatggatgatacatgcacaccattgtttggcaaacataaagttcttctcaatggagactgggttggattatgtgcagattctgaatcctttgtcgcggagttaaaaagcaggcggcgccaaagtgaattacctcgtgaggtatcttctgtttcagcaaatctcttgctatattttgatattcttgtgttacttggtatttgctttggatttttctgcttcagatgtgtctatgtcgaatattgtttatatatatgaaacgttctctgcagatggaaatcaagcgagataaagatgacaatgaggtaagaattttcactgatgctggtagactactccgacctctcttggttgtggaaaatctccaaaagttgaagcaagaaaaaccttcacagtatccttttgaccatcttcttgaccatgggattctcgagctgatcgggattgaggaagaagaagactgtaatacagcatggggaatcaaacagcttctgaaggaaccaaagatatacacacattgcgaattggacctgtcattcttgttgggtgtgagctgtgcagttgtcccatttgcaaatcacgaccatgggagaagagttctctaccagtcccagaagcactgccaacaagccattggattctcatcaacgaaccctaacatccgctgcgatacgctgtcccagcagctgttctatcctcagaagccactgttcaagacattggcgtcggagtgtcttaaaaaagaagtgctgttcaatggccagaacgcaattgttgctgtgaatgttcatctcgggtacaaccaagaggattccattgtgatgaacaaggcttcattggaacgtggtatgttccgttcagagcagattagaagctacaaagcagaggttgatgctaaagactcagagaagaggaagaagatggatgagcttgttcagtttggaaagacacacagcaaaatcggcaaagtagacagccttgaagatgacgggtttcctttcattggtgctaacatgagtactggcgatattgtcattggcagatgcaccgagtctggggctgatcacagtataaagctcaagcacactgagagaggaattgtgcaaaaagtggtattatcatctaatgatgaagggaagaattttgctgcggtttctctgagacaggtaagttccagatcatactaaatcgagctgttttttcagagaatgcattcctatgtatgaatcgaatgttccattgattggcttttacatcttacaggttcgttctccatgccttggagataagttttccagtatgcatggccagaagggtgttttaggctacctagaggaacagcagaattttcctttcacgatccaaggcatagttcctgatattgtgataaacccgcacgctttcccttctaggcaaacaccaggtcaactcttggaggctgctctctccaaaggaatcgcttgtcctatacaaaaggagggtagctctgctgcatacaccaaattgacacgtcatgccactcctttctccactccgggtgtcactgaaatcaccgagcagcttcacaggtacattcttcacattgtctcttggttttagctcgtaaaacagaatataaaattatatgctataacagatttacatttgcttcctatacaaatagatgatatcattaagggcaggaacatattattgataatatttcctcgttgaagatgtttaaacttggagactttggctacagaatttccaaaagttgattgagctaatatactgcacaaggcactaagctagatttgagcaccttacttgaaacatgtcatagtggatctttattttgttttctaggagtactagaagtgagcatgagttatctgtctctgtaagactaaaaaactaagaagttcaatgttctatggttgattaatttcttgtattgtgcctgaaaaacgtctagagaatacagaaaaataggctcaagagtcatgtaccagtatataattagttagaggattgatgctgtgagccttgtgatctatgtataattcatttaacctttcttagattattgttgattcttgagtcctgattcattaccaatggtaaatatttgtgattagggccggcttttcaagatggggaaacgaaagggtctacaacggtagatcaggtgagatgatgcgttctatgatattcatgggcccaactttctaccagcgacttgtccacatgtcagaggacaaagtcaagttcaggaacactggaccagtccacccgctcacacgccagccagttgcagacaggaagagatttggcgggataaaatttggagaaatggagcgagactgcctaatagctcacggtgcatcagctaatctgcatgagcgtctcttcactctaagtgactcttctcagatgcacatctgcagaaaatgtaagacctatgcgaatgtgatcgagaggactccaagcagtggaagaaagattagagggccatattgtagagtctgcgtatcctcagaccatgtggttagggtctatgttccgtatggagctaagcttctgtgtcaggagctgttcagcatgggcatcactctcaacttcgacaccaagctatgctgattccccctctttattatgtaaatggcttattgccttaagaccatgttatgtgtagtttgcttcagtcccggttctggttagtagtataggttttggtttggttgattcggtaagggttatccgaaccgaagaaatcgtaaaaccgagccactgatgactgaactaacccgtaagtgttgcttttgtgagatttgactctttaaccgttaataattctcggatctaaagtaaagttttaggaaaact

SEQ ID NO: 58 - DNA, 7174 bp, Arabidopsis thaliana
gtcttggtgagcttatagaatatcttttgttttcgggtcatgcttgaaggtttattcacccattagtatatggagagtatccaaagacaatgcagaacattgtgaaagagaggcttccaaagttcacggagaaagaagtgaaaatggtgaaaggttccatagattttgtgggaataaaccaatacacgacttattacatgtccgaaccacatcccaccaccaaacctaaggatttgggttatcaacaagattggaatgtggaatttggctgtaagttattggaagattcataacgatatgtagattttggattttgtttacagtctttagattttgatcgtgacaattattaacttgcagttgctaagttggggaagccaataggtccaagggtgagatatacacttgattatatgtttttttttttccctaagcaatatatatacaagtgtctaagttattaaataaaccacttatcttataggcttactcgtcttggttatacaacgtaccatggggaatgtacaaggccttgatgtatatgaaggaacgttacggcaaccctactatgatcctctctgaaaacggtattaaagaaacaaattaaaatcttcaatcaagtttctttttgttttgttatatttctataagattattataaattttagagctttttataaatgtttgaacatattttataggtatggatgacccgggaaacgttactctagctcaaggactacatgacaccacgagaatcaagtattacaaagattacttaaccaaccttaagaaagctagggatgatggagccaatgtggttggatattttgcgtggtcattgctagataatttcgaatggttatcaggatatacttcaaggtacttaaaaatttataccaaatgtatgatatgtagaataaatcaaggttataattaatatctgtttttgtttattgtataggtttgggatcgtttatgttgattacaaaacattgaagaggtaccccaagatgtctgctcagtggtttaagcaacttctgaaacgaaacaacaaatgatctcaatgtatcaatgccgggtggatttagtttttaaaaaggttggaattgatgattgaagaaataatggggccggtttagtcactttgtttattataaggggggtgaattgtaacttgaactctctccttcttcagttctttgacttttcaacacaaataaaataaaagtttaagaataaatttgcactatgaaatatgaactcttgtccttttcaattttgtgagtttatatgcatttagaacataacggtctttgaacattatagatttataaagttgcaatttgcaagcataaagttggtaatcgaattgatgtaattacccttctttactttgtactaaacaaagcgcacttagccacttaacgctaaaacatcgtaaggacatacctgtcatttccacaagtgccactcgatttcgccactcctacagtcctactcgtcgactgctcgcttaaccattgaaaaagtgagccaagggttttgattattttcgacgtctacggcgaatctctccgcatcttcatcgatttcccggcgacgtttactaccgccgttttactcaatcgtgccagcttaagcaatcgaggtacccattttaggtgttacgctttgattctgcttttaagcattggacaattccggagaatatgctttagtttcctctcttttggagaatgattcggttctaggggaaagattgttgatttcgtgtttgtattcatcattgattgaaacatgcatgatgcattttcgtggttcatggtttttcacggcttcttatcattttctctgtcttttttttttttttttttttttttttttttgtttcagtgtgtattgaggtataccagagatagacataaatgagatggatgttgacgagatcgagtctgctgggcagatcaatatttctgagctaggagaaagttttctccagactttctgcaaaaaagctgcgacatctttctttgaagagtttggacttataagtcatcagcttaactcctacaacttcttcattgaacacgggcttcagaatgtgtttgagtcctttggtgacattcttgtggaaccgtcttttgatgtaataaagaagaaggatggcgattggagatacgcaacggtgaaatttggaaaagtcactttggagaagcctacattcttttcggatgacaaggagcttgagtttctcccatggcatgcaggcttcagaacatgacatactcagcaaggatcaaagtcaatgcccaagttgaggtaactaaactaacaaaatctttgtcgaaattaagtaagcttgtctggatttgatgaatgatttcccttgcttgaaaactcagaaaggccagttaactatcactttctagttcaacattatgcaatatgtctatgtagtcgagagtggaataccacatggtatgaaatataaaagaaaaacatcttaagctttttatttatttagttcttccccattccctcactgttctttaattgagtgtttcatgcttgtgtgcaatgactcttgtacagtcaaagttttgatgatgtttctgttttgctgtccatgtatcttattcttgtaaatgtagtttattgtctaactgcatcttcactttataaattactaggtgttcaaaaaaattgttattaaacacgacaaattcaagactggacaagatgaatatgtcgagaaggagatactggatgtcaaaaaacaggacattctaattggtagcatacctgtcatggtgaaatctgtcctttgcaaaactagcgagaaaggaaaagaaaactgcaaaaaggggaattgtgcctttgatcagggtggatattttgtgataaagggggctgagaaggtgagttaaaccattttgggatctttttgcatatccactatcatgggatttctattttgaactattttagtgtatagcttagtggaaattagttctctttttctaatatatactggaaaaaatattttcaagttgttatacaacttcctaacgtgattataatctgtcttgcaggtgtttatagctcaagaacagatgtgcacaaagagattgtggatttctaattcaccatggacagtctccttcaggtccgaaactaaaagaaataggttcattgtgcgcctctcggagaatgagaaagcagaagactataagataatggagaaagtactgacagtgtacttcttgtcgactgagattccagtctggctcctgttctttgcgttgggtgtttcatcagacaaagaagccatggatctaattgctttcgatggtgatgatgcaagcattaccaacagtctcatagcttctatccatgaagctgatgcagtgtgtgaagcttttcgctgtgggaacaatgccctaacatatgttgaacatcagatcaaaagcaccaaattccctcctgctgaaagtgtggatgattgcctccgtctgtatttgtttccatgcctccaaggtttgaagaagaaagcccgattcctgggctatatggtgaagtgccttttgagcgcgtatgcgggaaaacgaaaatgtgaaaacagggacagtttccggaataaacgaattgagctcgctggagaactgttggagagggagataagggtgcatcttgcacatgctagaagaaagatgaccagggccatgcagaaacaactctcaggcgatggcgatttgaagcctatagagcattatttggatgcttccgttatcaccaatgggcttaatagagccttctccactggagcatggtctcatcctttcaggaagatggaaagggtctcaggtgttgtagctaatttgggtcgtgcaaatccattgcagactctgattgatctgaggagaacgcgacagcaagtcctttataccggcaaggttggagatgctagacatccgtaagtgaaaatttccacctcccctggtatattgaaatatatcccacgtactttaactaactgatatggttgcatttactcaatgttacatgtcttcagactgttttaaagatattcatattaacctatttagtatacgatggcgatcacagtttctgcagagtctcgtcggtttataatattgagtttgtatagatgttgctgctattaagaaactttgatactgtctttcttgtttctttgtcccttggtcaatctatctgttgtcctgatgcatgtattgagattatccattttggttccttttcaatgtgagcggttacacaattaaatcgtgctgggaaactgaactatggctgcattgtttttaatgttggccacaggcatccttctcactggggcagagtatgctttttgtcaactccagatggtgaaaattgtggtcttgtgaagaacatgtctcttcttggacttgttagcactcaaggtttggagtctgtggtggaaatgctctttacttgcggaatggaagagctgatgaatgataccagcacaccattgtgtggcaaacacaaagttcttctcaatggagactgggttggattatgtgcagattctgaatcctttgtcggggagttaaaaagcaggcggcgccaaagtgaattacctctcgaggtatcttctgtttcagcaaatgttttgctatattttgatattcttgtgctacttgattatttgctttggatttttctgcttcagaaagtatcctatgtcgaatattatttacatatatgtatcacaacgttatctgcagatggaaatcaagcgagataaagatgacaatgaggtgagaattttcactgacgctggtagactactccgacctctcttggttgtggaaaatctccacaagttgaagcaagacaaacctacacagtatccttttaagcatcttcttgaccaagggattctcgagctgatcgggattgaggaagaagaagactgtactacagcatggggaatcaaacagcttctgaaggaaccaaagaattacacgcattgcgaattggacctatcattcctgttgggtgtgagctgtgcaattgtcccatttgcaaatcacgatcatgggaaaagagttctttaccagtctcagaagcattgccaacaagccatcggattctcatcaacgaaccctaacatccgctgcgatacgctgtcccagcagctgttctatccccaaaagccacttttcaagacattggcgtcagagtgtcttgaaaaagaagttctatttaatggccagaacgcaattgttgctgtgaatgttcatctcgggtacaaccaagaggactccattgtgatgaacaaggcttcattggaacgtggtatgttccgttcagagcagattagaagctacaaagcagaggttgatactaaagactcggagaagaggaagaagatggatgagcttgttcagtttggaaagacatacagcaaaatcggcaaagtagacagccttgaagatgacgggtttcctttcattggtgctaacatgagtactggcgatattgtcattggcagatgcaccgagtctggggctgatcacagtataaagctcaagcacactgagagaggaattgtgcaaaaagtggtattatcttctaatgatgaagggaagaattttgcagcggtttctctgagacaggtaagttccagatcatactgaatcgagctgtttttcagagaatgcattcttatgatgaatcaaatgttccattgattggcttttacatcttgcaggttcgttctccatgccttggagataagttttccagtatgcatggccagaagggtgttttaggctatctagaggaacagcagaattttcctttcacgatccaaggcatagttcctgatattgtgataaacccgcacgctttcccttctaggcagacaccaggtcaactcttggaggctgctctctccaaaggaatcgcttgtcctatacaaaagaaggagggtagctctgctgcatacaccaaattgacacgtcatgccactcctttctccactccgggtgtcactgaaatcaccgagcagcttcacaggtacattcttcacattgtcacttggtttttagctcgtaaaacagaatattgaattatatgcaatacagattgacatttggttcctagggagtacagatggatgatatcattaagggtaggaactaattattaataatgttgcctggttggagatgtttgaactttgggactttggctcaaaagctgacatgatatgcataataccagcaaatcgagctaatatactgcacaaggcactaagctagatttgagcaccttacttgaaacatgtcatagtggatctttgttttgtttcctagtaccagaagtgagcatgatttatatgacgggcaaatatctctgtaagaccaaaaaaactaagaagttggatgttctctggttgattaaattgtgcctgcaaaacgtctagaggatacacagaatgggctcaaaagccatgtatcagtatataattagttagaggattgatgctgtgagccttgtgattatgtatgattcgttgaacctttcttagatcattgttgattgccaatggtaaatatttgtggttagggccggcttttcaagatggggaaacgaaagggtctacaatggtagatcgggtgagatgatgcgctctctgatattcatgggcccaactttctaccagcgacttgtccacatgtcagagaacaaagtcaagttcaggaacaccggaccagtccacccgctcacacgccagccagtcgcagaccggaagaggtttggcgggataagatttggagaaatggagcgagactgcctaatagctcacggtgcatccgctaatctgcacgagcggctcttcactctaagtgactcttctcagatgcacatctgcagaaaatgcaagacctatgcgaatgtgatcgagaggactccaagcagtggaagaaagatcagagggccatattgcagagtgtgcgcatcctccgaccatgtggttagggtctatgttccttatggagctaagcttctttgtcaggagctgttcagcatgggcattactctcaacttcgacaccaagctctgctgattccccgtcattattatgtaaatagcttaatgc

SEQ ID NO: 59 - DNA, 5964 bp, Arabidopsis thaliana
aaactaaaatcagttttgttcaaaagaaaacctgatgcaagaaacaaacaaaagtattgaaaagtgactaatcttgcagttgaactaaacttggaacataagaagagcacacaagtctgcctggtttccgctgggaattcggacttactccaatgttgacagatttgaagtatccatcatctccaacgatgtaagccatttggtagcgacaggtcttgatctctttactatcaaaaagcacaacaactttcttctcctcgtcaatgaagaagctcttagcttcaaagtacatcgaaaaatgatccggtaaaccattgactagtgacatatccacagtcaaaaaagagctccaggataccgcattgggttcaatcttagtcgaaatcctaatctctataatctcagctgtgacgtagtggttgtataacacagcgagcttctcatctctaacccaagatagagtcacagtttcaaaactaggacagggagggtaaaacagcagaggcaaacacggtccaaatctctctgttgtaaaatcaaaacagagtaaacaagtttcaatctctgttactttcgtcgcttgtgtcacttcttgaccgaagaagtaagtatttcccttcaaagacactccggtctgataaaacggtatatcacagtcaggattgacatcaagaaccctccatgaatcagagctaaaatcgtatacatcaatgtgagttcttcgactgctttcgttgctctcttcatcatagagaaacctcaagattttgtggttacggttgttgtcgtatccaagagcaaacctgtcatatctgtggaatgtgtttcttggtcgaatccatttcgtttgccccaaatacggattccacacaaagacattcgagttctctttggcgatgcataacaataagccatcgcaatgatagacttgagatatctcgacttgatcatcattactaggtatacttattagcttcatagatggatcaacgaagtcttctttgtcttcgttacggattccttgaagatctaatctcaaagaacaaactctagaatctagaatcatgaactctagaaattgattccttgctgctgtttttctaccaaagatctgatttttcgataaagcattccactttttacaagtagatcgcactgagattagagatgtaaatggaaccctagaaagaatatcacctaccaaatcatctgatagatcggaaattgtcgtcattcttcaaaactttctccagaaatttgtgtattgttcttctccttcagtctgttctctgttgctacctttactgtgtcaatgtcggatctctcgattgtattttcttgataacggtttggtttggcccaggttgtttaaatgggcctatgtacaataatggaaacaaataggaatatattttaaaagcccattaattagacaaatagcacgtgagcagcacaagcacttcttctccagtctattttccccctcatcagtctcagactctctttcgtttactcgccgaagtcaaataaaaacgagagatggtttcagctatggcgggttctccctttttcgcatactcactaatcctctctccagtctccgcattgcttctatttctacctcgtatccagtattagattgaaaaagatctcactgtgtaagtctccagaacctcactgtgtaagtgcttttgtatttattcccgcttgattccaaaattattcaatcaacaatgtattaggtgatcgatttcaatagtatttgtagttggaatcatcgatattgtctcttaatttgatatttatggtcttagatcttccaacggagtagcgaattagggcttttcttcaatattttctcttatcagccttatcatgtgggggttatttctgtttagtatgtttctttttcaggagaaatggggtcagagggaaatatgaagaagtcggttgtgacacaagtaagcattggtggatttggggaatccactactgcaaaacaactcacagattaccttgaagatgaagtaggaattgtttggcgttgcagattaaaaacttcgtggactcctcctgggtcttatcctaattttgaaatcgcagacacttcaaatatccccagtattgatgaatataagaaagtggagcctcatgcctttgtccatttcgcagtttttgaatcagctggtcgtgccatggatgctgcagggcaatgcaacctcatcttggatggccagccgttaaaagtcagtttgggtcctaagaatccatattcccttaatcaaagaagaagaacgactgtaccttataagttggctggtattacacttgagattgggacattggtttctcgggatgatttttttgtttcttggagagctgaaggggttgatttcctggtggatccttttgacaacacgtgcaagttttgtttcagaaagagcactgccttctctttcaaggatgcagtgatgcatgctgtgatcaattgtgattataagttggagttattggtgagagatatacaaacagtcaggcagtataaaaccttgcatggctttgtgcttattttgcagctggcttcttcaccccgtgtctggtacagaactgctgatgatgatatttacgatactgtccctggcgatctcttggatgatgatgatccttggatccgtaccactgattttactcaagttggggcaattggtcgatgtcattcatatcgagtgctcatatctccgcggtatgaaaataaactgagaacagccttagattattttaggatgcggagggtgcaagaggaacgtgtgaggtggcctccccgtatccgtaatgagccttgttttggggagcctgtgtcagatcatttcttctgcattcatcacaaggaaggaatctcttttgagatcatgtttctagtaaattcggtattgcacaggggtgtctttaaccagtttcagttgactgagcgattctttgatcttctaagaaaccaacccaaggacgtcaatatagcttctctcaagcatctctgtacctataaacgaccagtttttgatgcgtacaagaggttgaagcttgttcaggaatggattcagaaaaatccaaagcttttagggagtcatgaacaatctgaggatatctctgagatcagaagactagtaattaccccaaccagagcctattgcctacccccagaagttgagctctccaacagggtactcaggagatacaaagctgttgctgaaagatttttgcgggtaactttcatggatgaaagtatgcagaccataaattcgaatgttctctcttactttgttgctcctattgtgaaggatttgacatcaagttctttctcccagaagacctacgtttttaaaagagtgaagagcatattaaccgatgggtttaaactatgtggtagaaaatacagttttctagcattctcagccaatcaactgagagaccgctctgcatggttctttgctgaagacgggaaaacacgtgtgtcagatataaaaacatggatggggaagttcaaagacaagaatgtggcaaaatgtgctgctaggatgggcctgtgcttctcctccacatatgccactgtagatgtcatgcctcacgaggttgacactgaggttccagatattgagagaaatgggtatgttttctctgacggaattggtacaatcacacctgacctcgctgacgaagtaatggagaaacttaagttggatgtgcactacagcccttgtgcttatcagatacgttacgcaggtttcaaaggggttgttgctcgttggccatcaaaaagtgatggaatcaggctagcccttcgagacagtatgaagaagttcttttccaaacatacgatcttggagatctgttcctggacgaggtttcaacctgggttcttaaatcggcagataattacccttctatccgtactaggtgttccggatgaaatattctgggatatgcaggaatccatgctctataaactgaaccgcatccttgatgatacagatgtggcatttgaagttctcacggcatcatgtgctgaacagggaaacactgcagctatcatgcttagtgcaggtttcaaaccaaaaaccgagccgcatctacgcgggatgttgtcttcagtcagaattgcacaactctggggtctcagagaaaaatctcgtatttttgttacttcaggaaggtggctaatgggttgcctagacgaagcagggatacttgaacatggccaatgctttattcaagtctctaaaccgtctatagaaaattgtttctccaaacatgggtctcgttttaaggagacaaagacagatctggaagtagttaaaggctatgtagccattgctaagaatccttgtcttcacccaggggatgtaaggattttagaagctgttgatgtaccccagctgcatcacatgtatgactgccttattttccctcagaaaggtgataggccgcatacaaacgaagcttctggcagtgaccttgacggggacctgtactttgtggcttgggatcagaaactcatccctcccaacaggaaaagctatccggccatgcattatgatgcagctgaagagaagagtttaggccgtgctgtcaaccaccaggtcaatatctacttccccactttttttctgttagctgagatgatgacgcttaagataaaatggacaagtgattccagtataactctctgatatttctggaagtggtggaaactttgtttttggatgcttgtagtgattacttttgcttgcttctgagttcatagattgcgtggcataggttgttaacagcatactgtgttcatcctgtaggagctaagatgatgacatttaagaaaactttgtcatatattgttgattctgatttgtatttttcgcatgccttactgtgactgtgactgtttagttactatcaagggcagtatcatgatgctagtagcttctgccaatgtagttatgaattctttgttattttttcttgctgtgcttgccaagtcttgggtaattgattgcttttgttacaggacataatcgatttctttgcaagaaacttggcgaatgagcagttgggcacaatttgcaatgcacacgtcgttcatgctgatagaagtgagtatggagccatggacgaagaatgtttgctactggcagaactagctgccactgcagttgatttcccaaagacagggaaaattgtgtcaatgcccttccacctaaaaccaaaactctacccagatttcatgggaaaagaagactaccaaacttacaagtcgaacaaaatcttgggtcggctttacagacgggtaaaagaggtttatgatgaagatgcagaagcttcctcagaagaaagcacagacccaagtgccatcccttatgacgctgttcttgaaataccgggatttgaagatttgatccctgaggcatggggtcacaaatgtttgtacgacgggcaactcattggtcttcttgggcaatacaaggtgcagaaagaggaagagattgtgacgggtcacatctggtccatgcccaaatacacaagcaagaaacaaggcgaactgaaagaaagactgaagcattcttataattcccttaaaaaggagttcaggaaagtatttgaggaaacaatccctgaccatgaaaatctcagcgaggaggaaaaaaacatcttgtatgagaagaaggcttcagcttggtatcatgtaacttaccatcccgagtgggtgaagaagtctttagagctgcaagatccagatgagtccagtcatgcggcgatgctgagttttgcttggattgcagctgattatcttgcaagaatcaaaatccggtcacgggaaatgggaagtatcgactcagccaagcctgttgattctttggctaagtttcttgctcagcgtctctaaaaggttatgtttaatgccgtaaggccactctg

SEQ ID NO: 60 - DNA, 4427 bp, Arabidopsis thaliana
actccacttcctaaactctcattcatgttttggttagccattcgaaaccgtctagctacgggggacagattattaaagtggaatggcgacgcttacagggggttgtgtgctctgtcaaacggaagtagaaacaagggatcatcttttttttctcttgctcttactcctctcatgcttggtcagctcttacgagggatatgttgggttcacgttatacgactcgttgggactctcttgttgatctatctacaagttcggccttgacgcaaattcacatgtttgttttccgatatgtgtttcagctcactactcacagtctttggaaagagagaaatgggagaaggcatggcgagtcacccattccagctccttctcttgccaaaatgatcgataagaatatgcggaatcggttgagtactttggctacttcaggttcacccatctacaagagcgggctacgatattggtttagcactcattgtcgttagatcttctattcagtttgtacttgttcagtttttaaattttttggctaaacgatgcatttattgtaaaaccgtcttttttttgtgaataaattttaaatttataaagaaaagaaaaaaaaatgtgtggtagcacaaatgcacgatgttgatcttcttactcaaatgtcttctataaaattgtggacgcaaagtctcccgcccattactctgcatatagcaaaaacctgactattgtttcttaattattttatgaaaaaatgtctatgcacgttatcgtttcaagataaagatgaagatgaaaatattaagttaaaaaggatatgaagaaaggaagtgtgtatgtaaatgatatgtataaaaagataaaatggacattcttataaaagttacacaccatatttttgttagattagtttgtgaattaaaatatttttattgattatttatgcctactttcctaaaattttctcctttttttacaatttctatatcacgactttttctaataaatactttcgtaatatttatcctgaatgtgttgcgacacacttacgatataaagatattttattgtttcaaaaaaaaaagaaattagatattaaaaaaaagttattcaaggttcaataaatagaaaaaaatccgatatccagaatataccaaaagaaatttattcaaagttaaaatacagaaagatattagatatcaagaaaaattattcaagtttaaaaaatagaaagaaattatataatatatagaaagaaatttttattcaaattttaaaaaaataaaaaacttagatatttggaaaaccttatttccatattataaaattataattttactaaatatattaaaaaaattatgtttcctaaatttattaatttttttttaataatctctatactgcaatcttttctaataaaaatattttataatatttatcctgaacgtgttacgacacgtcatcgctacaaaccaaaataaacgggtgtggtgtgtttggtctggccttatacaccaaatcaaacacaccaccatttttacccagaaatttgagtaccaagagagctctttttcatcctaaagagatcttcaaatttagatttcaacacataaaaggtatgaaatttttcattttttttccggctatttttttttggaataatcgtatcataatttctcaatatcacaactttatattaaaagcaaatctaaagaaaaaacacattagattctgtaggaaaatatttgtgtaagagcttcttctccgccatggatttagcttgaaaggtgttctccaaacaaaacccatttcttcgatttctctgataaactcgtcaaacccatttcgcttctcgttgcaaaaaatgggttcttctcacattcctcttgatccgtctctaaatccgtcaccttcactgatcccaaagcttgaaccagtcactgaatcaacccaaaacttggcctttcaacttccaaacacaaacccacaagccctaatttcatcagccgtctccgatttcaacgaagccacagacttttcctcagattacaacaccgtcgccgagtcagcccggtctgctttcgctcaacggcttcaacgtcacgatgatgttgcggttcttgattccttaaccggagcaatcgtaccggttgaggagaatccggaaccggaaccgaatccttactcaaccagtgactcttcaccgtcggttgctactcaacgacctagaccgcagccacgttcgtcggagctagtgaggatcactgatgttggacctgaaagtgagagacagtttcgtgaacatgtgaggaagacgagaatgatttatgattctcttaggatgtttttgatgatggaagaagctaaacgtaatggggttggtggaagaagagctagagctgatggtaaagctggtaaagctggttcaatgatgagagattgtatgttgtggatgaatcgtgataaacgaatcgtcggttcgattcccggtgttcaagttggggatatcttcttctttaggtttgagttatgtgtcatgggcttacatggacaccctcaatctgggatcgattttcttacagggagtcttagttctaatggggagccaatagctactagtgtgattgtttctggtgggtatgaggatgatgatgatcaaggagatgtgattatgtatacaggtcagggtggacaagataggcttggaaggcaagctgaacatcagaggctggaaggtggaaaccttgcgatggaacggagtatgtattatgggattgaagtgagagttattagagggttgaagtatgagaatgaggtttctagtagagtttatgtttatgatgggttgtttaggattgttgattcttggtttgatgttgggaagtctggtttcggtgtgtttaaatatcggttggagaggattgaaggacaggctgagatgggtagttcggtgttgaagtttgctaggactcttaagactaatccattgtctgtgagaccgagaggttacatcaatttcgatatctcgaatgggaaggagaatgttcctgtctatttgtttaacgacattgacagcgatcaagaacctttgtattatgagtatcttgcgcaaacttcgtttcctcctggcttatttgttcagcaaagtggtaatgcaagtggatgtgactgtgtcaatggttgtggcagtggctgcctttgtgaagccaagaattcaggtgagattgcttatgattataatgggacgctaataagacagaaaccgttgatacatgaatgtggatcagcgtgtcagtgccctccaagctgtcgaaaccgtgtgactcaaaagggtttgaggaataggctagaagtgtttaggtcactggaaacgggttggggagttcggtctttggatgtattacatgctggtgcttttatttgtgagtatgctggggttgctttgacaagggaacaagccaacattctgaccatgaacggtgatacattggtatatcctgctcgtttctcttctgcgagatgggaagattggggagatctgtctcaggtccttgctgatttcgagcggccttcttatcctgatattcctccggttgatttcgcaatggatgtgtccaagatgaggaatgttgcttgttacataagccacagtactgatccgaatgtcattgtccagtttgtactccatgatcacaacagtctcatgttccctagagtcatgcttttcgctgctgaaaacatccctcccatgactgagctcagccttgattacggagtagttgatgattggaacgccaagcttgccatttgtaattaaaattcaaccgttaaaatcgtggttcttggccatattttccaggtaaattctaagtgaatggttaataagtttcacagtataaccctttagtatcatgttagttaactttgggaaatgcactagcaggaaatgattgcaaatctgtcttgcataggcttgtgacttgtttacaagttgtattatggtatcaatgtttaataagatagatgttaggggtcctattttggtaatttgaattagatatatattgggttcttgcagattgtaataagcacaagctgagactgaatcgtttgctgttttgttttgttttgttttgctagttggtgacatgaagaatgaaggaaaggaagtgtgcagaagctaaggtttaagagaccccactcctcccatttcgagtttttgggtatctttgaacatttgggagtgtgtgtttttgggggtaataggatacaaaacttaaaagctgtttgttttgtttgtactgttttgttcttgggtttgtctcgtactaatcaagtaaaacaaatgtctcgtactctatgactctctctttctaaattggtattagatgaaattacaccatatattttgatgaaaaacatttgcgttcaatcgt

SEQ ID NO: 61 - DNA, 4471 bp, Arabidopsis thaliana
gtccactccaacgtgtgaatggttcaagggagtatggtttcaaaactccacttcctaaactctcattcatgttttggttagccattcgaaaccgtctagctacgggggacagattattaaagtggaatggcgacgcttacagggggttgtgtgctctgtcaaacggaagtagaaacaagggatcatcttttttttctcttgctcttactcctctcatgcttggtcagctcttacgagggatatgttgggttcacgttatacgactcgttgggactctcttgttgatctatctacaagttcggccttgacgcaaattcacatgtttgttttccgatatgtgtttcagctcactactcacagtctttggaaagagagaaatgggagaaggcatggcgagtcacccattccagctccttctcttgccaaaatgatcgataagaatatgcggaatcggttgagtactttggctacttcaggttcacccatctacaagagcgggctacgatattggtttagcactcattgtcgttagatcttctattcagtttgtacttgttcagtttttaaattttttggctaaacgatgcatttattgtaaaaccgtcttttttttgtgaataaattttaaatttataaagaaaagaaaaaaaaatgtgtggtagcacaaatgcacgatgttgatcttcttactcaaatgtcttctataaaattgtggacgcaaagtctcccgcccattactctgcatatagcaaaaacctgactattgtttcttaattattttatgaaaaaatgtctatgcacgttatcgtttcaagataaagatgaagatgaaaatattaagttaaaaaggatatgaagaaaggaagtgtgtatgtaaatgatatgtataaaaagataaaatggacattcttataaaagttacacaccatatttttgttagattagtttgtgaattaaaatatttttattgattatttatgcctactttcctaaaattttctcctttttttacaatttctatatcacgactttttctaataaatactttcgtaatatttatcctgaatgtgttgcgacacacttacgatataaagatattttattgtttcaaaaaaaaaagaaattagatattaaaaaaaagttattcaaggttcaataaatagaaaaaaatccgatatccagaatataccaaaagaaatttattcaaagttaaaatacagaaagatattagatatcaagaaaaattattcaagtttaaaaaatagaaagaaattatataatatatagaaagaaatttttattcaaattttaaaaaaataaaaaacttagatatttggaaaaccttatttccatattataaaattataattttactaaatatattaaaaaaattatgtttcctaaatttattaatttttttttaataatctctatactgcaatcttttctaataaaaatattttataatatttatcctgaacgtgttacgacacgtcatcgctacaaaccaaaataaacgggtgtggtgtgtttggtctggccttatacaccaaatcaaacacaccaccatttttacccagaaatttgagtaccaagagagctctttttcatcctaaagagatcttcaaatttagatttcaacacataaaaggtatgaaatttttcattttttttccggctatttttttttggaataatcgtatcataatttctcaatatcacaactttatattaaaagcaaatctaaagaaaaaacacattagattctgtaggaaaatatttgtgtaagagcttcttctccgccatggatttagcttgaaaggtgttctccaaacaaaacccatttcttcgatttctctgataaactcgtcaaacccatttcgcttctcgttgcaaaaaatgggttcttctcacattcctcttgatccgtctctaaatccgtcaccttcactgatcccaaagcttgaaccagtcactgaatcaacccaaaacttggcctttcaacttccaaacacaaacccacaagccctaatttcatcagccgtctccgatttcaacgaagccacagacttttcctcagattacaacaccgtcgccgagtcagcccggtctgctttcgctcaacggcttcaacgtcacgatgatgttgcggttcttgattccttaaccggagcaatcgtaccggttgaggagaatccggaaccggaaccgaatccttactcaaccagtgactcttcaccgtcggttgctactcaacgacctagaccgcagccacgttcgtcggagctagtgaggatcactgatgttggacctgaaagtgagagacagtttcgtgaacatgtgaggaagacgagaatgatttatgattctcttaggatgtttttgatgatggaagaagctaaacgtaatggggttggtggaagaagagctagagctgatggtaaagctggtaaagctggttcaatgatgagagattgtatgttgtggatgaatcgtgataaacgaatcgtcggttcgattcccggtgttcaagttggggatatcttcttctttaggtttgagttatgtgtcatgggcttacatggacaccctcaatctgggatcgattttcttacagggagtcttagttctaatggggagccaatagctactagtgtgattgtttctggtgggtatgaggatgatgatgatcaaggagatgtgattatgtatacaggtcagggtggacaagataggcttggaaggcaagctgaacatcagaggctggaaggtggaaaccttgcgatggaacggagtatgtattatgggattgaagtgagagttattagagggttgaagtatgagaatgaggtttctagtagagtttatgtttatgatgggttgtttaggattgttgattcttggtttgatgttgggaagtctggtttcggtgtgtttaaatatcggttggagaggattgaaggacaggctgagatgggtagttcggtgttgaagtttgctaggactcttaagactaatccattgtctgtgagaccgagaggttacatcaatttcgatatctcgaatgggaaggagaatgttcctgtctatttgtttaacgacattgacagcgatcaagaacctttgtattatgagtatcttgcgcaaacttcgtttcctcctggcttatttgttcagcaaagtggtaatgcaagtggatgtgactgtgtcaatggttgtggcagtggctgcctttgtgaagccaagaattcaggtgagattgcttatgattataatgggacgctaataagacagaaaccgttgatacatgaatgtggatcagcgtgtcagtgccctccaagctgtcgaaaccgtgtgactcaaaagggtttgaggaataggctagaagtgtttaggtcactggaaacgggttggggagttcggtctttggatgtattacatgctggtgcttttatttgtgagtatgctggggttgctttgacaagggaacaagccaacattctgaccatgaacggtgatacattggtatatcctgctcgtttctcttctgcgagatgggaagattggggagatctgtctcaggtccttgctgatttcgagcggccttcttatcctgatattcctccggttgatttcgcaatggatgtgtccaagatgaggaatgttgcttgttacataagccacagtactgatccgaatgtcattgtccagtttgtactccatgatcacaacagtctcatgttccctagagtcatgcttttcgctgctgaaaacatccctcccatgactgagctcagccttgattacggagtagttgatgattggaacgccaagcttgccatttgtaattaaaattcaaccgttaaaatcgtggttcttggccatattttccaggtaaattctaagtgaatggttaataagtttcacagtataaccctttagtatcatgttagttaactttgggaaatgcactagcaggaaatgattgcaaatctgtcttgcataggcttgtgacttgtttacaagttgtattatggtatcaatgtttaataagatagatgttaggggtcctattttggtaatttgaattagatatatattgggttcttgcagattgtaataagcacaagctgagactgaatcgtttgctgttttgttttgttttgttttgctagttggtgacatgaagaatgaaggaaaggaagtgtgcagaagctaaggtttaagagaccccactcctcccatttcgagtttttgggtatctttgaacatttgggagtgtgtgtttttgggggtaataggatacaaaacttaaaagctgtttgttttgtttgtactgttttgttcttgggtttgtctcgtactaatcaagtaaaacaaatgtctcgtactctatgactctctctttctaaattggtattagatgaaattacaccatatattttgatgaaaaacatttgcgttcaatcgt

SEQ ID NO: 62 - DNA, 6907 bp, Arabidopsis thaliana
ttggcacgttatgttatggactgttcatatacgtaccacgttccaaactcgtttgtatctaaaaaggaaaaattatctcacattagtgatttttttttacttgcatcaactctattactatatactaatatatattaccattaccattttgaacgcgttacatagacattatttagtcattagtcaaatccctttactatataatcccatttgaaatgtaagaattttgaatgttgacagatgcaaataaggattagcatacaaaattactttgtaacccttatttacgtgataaaaaagtttagcctatcgttccactattaaaaacatgaacatgtaaaagttgaattttctatcttttcttgtatcaactatcaagtaatttgcaagtacctaagtaaaagaaaacaaataaacacaacgatctttattactatatttaaaacaaataaaagatagacaactattaatttgtttatatgcatatcagtcctttgcaacgtagataaaagcggtattatgcaaataaacttttcttttgtcaattgtcgtcatcatgcaaataaattttcaaatatcactgtcattattcaaatttcaaaccctaataaaaaagcaaattaaaaaaatggtttcgtacgacaaagggcttaacgaaagatgataagaacaaacattaataccgtagcttttgtatttctaacatcagtaaaaataaaaaaatcagacctcgtaaccaatgaagctgccataaaacctgagatggtgtagttaaagagggaattatgatttgtgtcagctatcaatatcatcataattagctgaaattatatttattctttggagtttttatttatttatatttgaacatttattatacaaacaaattatatacaaatagtcgtaactcattttatttttctcttcttcttttgttattatttgtcaaaataaatagtcctttatattcgtaattcgtaaatcagtataaattaaagcagaagtgaaaacataagccaatagtggtaaaaactgttattctatctctattctggttctgcaaaaagcatatatcaatttataaaaaagtgaacagactaatactagtagagttaaaatagactgtagttaagttaagaaaatgtacgatcaacagcccacaccgccacagatgaaattacgtggaacgtggtaaaaaagccacgacggtaaaatagtaatttaattaactcttcgattttccttttaactctgaagagggcaaaatggtcaatgataatttcgtttatttagtcataaaaaaaccgggaatgcaaagagatgagggcaaaatagtcaaattaaaaaaccgacgatcttttagattccttttaaaacctagacgtcccactctcacacaatacacacaagtaaccagttttctctctcattttctcagtttttctctctctccgtttttgaaaagatttttgtttctactttgggaagctttccgctacaatgtcaaatcgtggtggtggtggtcacggcggcgctagtcgtggtcgaggaggtggacgaaggtctgaccagagacaagatcagtcttctggtcaagttgcttggccgggtttacaacaaagctacggtggtcgtggtggttctgtttccgccggtagaggtcgtggaaacgtcggaagaggtgaaaatactggagatctgacggcgacgcaagttccggttgcttctgctgtttctggcgggagaggtcgtggtaacatcggagatccgacgttttctgttgcgtcttcgtctaagacggtgtctgttgcttcttcatctaaagaggaaagtaagaatacggaggtttctgagaccatgtcgaaccttcagattacttcgacggagacgaaacctgaaatgacgtcacttcctccggcgtcatctaaagcggttacgtttccggtacggccaggacgtggtactttggggaagaaagtcatggttcgtgcgaatcatttccttgttcaagttgctgatcgtgatctctaccattacgatgtaagtttccggccattttttctcgacgaatctgtacttgtttgtcgtttttatgtgtcgatttcaaatattgtcgtttctatttcatcaagttatagtgttttttgctttttgttgttgttcagtttttgtaaaccttgtacgtcaaaagatgaacttttttttgtcgtttgtgttcatctgaagttgttctttcagtgagatttctgactgaaaatttgttagtttctgcatcattggtttttttttttttttgctttcattcgacgaatatactgttgtttgttcctttttattgttgatctgatgtatttcacaaagttcctagagagagttttgacatgatgaatctgcggttgtgacttgttttagtcatatagagattttttggctaaaagttattgttattgtgttataggtttcgatcaatcctgaggttatatcaaagacagtgaacagaaacgtgatgaaacttctggttaagaattataaagactctcacttgggagggaagtcaccagcgtatgatggaaggaaaagcctctatactgctggtccattaccttttgactcgaaagagtttgttgtgaatctggcggagaaaagagctgacggttcctctgggtaatgtcttgttttaactctttgtgaatgtgtttgtatcgccttgtttttcatagttttttttggcattgtgactccttttggcaggaaggacagaccgtttaaagttgctgtaaagaatgtgacaagcactgatctttatcagttgcaacagttccttgatcgtaagcaaagagaggctccatatgatactatccaagtgcttgatgttgttcttagggataagccctctaatgagtaagaaatctgaaatttgcataaacttcagtattgtcaaaagctatgcataaacttaacatttccctgttttgctttctgttcagttatgtctctgttgggaggtcttttttccacactagtttgggaaaggacgcaagagatggtaggggtgagcttggagatggtattgagtactggagaggttatttccaaagtctaaggctgactcagatgggtttgtctctgaacattggtaagaatatgcttaatgttatctggattggtgatgttgattaattcttatatttttatttgatttagatttgaataattctactttatggttttaactgcagatgattttgattcattatagccgtgttgttttcttatgatgcagacgtttcagcaagatcattttatgaaccgattgttgtcactgactttattagcaagtttctgaatataagggacttaaacaggccacttagagactcagatcgacttaaggtatatatctgacttatattccaccattttaattattaatattattcaagatgatgtcttatatatgattcttatcttgaaaatcatatgttggtatttaggtgaagaaagttttgaggacactgaaagttaagttgcttcactggaacggcacaaaaagtgccaaaattagtgggatttctagtctacccatcagggagctaaggtgaagatgcttactttagcagggtgcataatcgttgaactttgttttcttgcttttcttggaagaggtttctgatctttggttataaatttgctgatgttgcctatgttctaatcatttcaggttcactctggaggacaaatcagagaagacggttgttcaatattttgctgaaaaatataattatagagtgaaataccaggctctacctgctattcaaacagggagtgacacaagacccgtctacctaccaatggaggtatatttttaataacatctacttttttacctccatcgttttcttggattcattttgtatccttaaagatctggttattcctggttcttgcagctctgccaaattgacgaagggcaaagatacaccaaaaggctcaatgagaagcaagtgactgcattgctaaaagctacctgccaacgaccccctgatagagagaactcgatcaaaaacgtaggtttagtcctctttacattacatatacagtagttcctccatcggaaaaatagtctttaattttgcacctctgttttgactaacatcacgtttgttgtttatattattagttggttgtgaaaaataattacaatgatgatctgagcaaggagtttgggatgtcagtgactacccaactagcctcgattgaagctcgtgtacttcccccaccgatggtgattttctttctccatttttgttattaatttgctttattatcatgcattttcttgtcaatgttgctcatcacgatgttctttctgttaacagttgaagtaccatgacagtggtaaagagaaaatggtaaatccaaggctaggacagtggaacatgattgacaaggtaaaactgtaattgactatcataatctttttgctctctgtaggcacttgaaactaaataagaaatatgcttctatttctcttataatgataaattatactatactttactgctttgcgtgtggatgcggaagaaatagttagtgatgaagatttgtgtttaatgcttctattgtggtttaatgtgtgttaccaaattttggggctcttacctccttttggctgtgatatggtccagaaaatggttaatggagcaaaagtcacttcttggacttgcgtaagtttctctactcggattgaccgtggtttaccccaagagttctgcaaacagttgattgggatgtgtgtcagcaaaggaatggtctgtcttgtctcatgcttattgatacttgtcacaatttcataccaaaaaatttactaactcttttttttgttttaattctttgtgccaggaatttaagcctcaacctgctattccgttcatctcttgtccccctgaacatattgaggaagctcttctcgatatccacaaaagggcacctggtctccaactgttgattgtaatattgcctgatgtgactggatcatatggtaagtctgtgctaatgattggtaatatttggtgcaaagtttattccgacaatctgttcatgaagtactctttctgtctgcaggaaaaataaaaaggatctgtgaaacagaattggggattgtctctcagtgttgccaacctagacaagttaataaactcaacaagcagtacatggaaaatgttgccttgaagatcaatgtcaaggtctagtcatctgtgcttcttattgttttttatgatggtgtaaaacgggtatttgtattacagactgggggaaggaacactgttcttaatgatgctattagaagaaacatacctcttattactgatcgtccaaccatcatcatgggtgctgatgtgactcacccacagcctggagaggactcaagtccttctattgctgctgtatgtatatcttattttacttgtatctcattatactactgtttcatcataaaaggtaattctcttatttcaactacaggttgtggcctctatggactggcctgagataaacaaataccgaggattggtttctgctcaagctcatagggaagaaattattcaggacctgtataagctggttcaggatccacaacgtgggctagtccactctggtttgataaggtaagagcaaaacatctacaacttcttgtgttctttgatttttcacaagaataaatataatggacactgtttgtgattgcagggaacatttcatagcattcaggagagctacaggccagatacctcaaaggatcatcttctatcggtaagtggttctcacattccatgcttaaacatttcatagcatgagcaggtttggctaattgctttctctttatacagtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtttctcactctctgctcttctctatcaacttaattcctttaatgatccagatttcaagtaacatatttgtatttccttatcaggtactgtcgtggacactaaaatctgtcaccctaatgaattcgacttctatttgaacagccatgctggtattcaggtattgcttccagaatctagaccaatttatgacctgttttgtctcagcagaattacaacttcctttgaatgtttgaatggtaatagggaacaagcaggccggcacattaccatgtacttctcgatgagaacggtttcaccgctgatcagttgcaaatgctcacaaacaacctctgctacacgtaagagacaacaacattgtacattttccttatgacatgttttaactctctgaaactaacaaaacatataataaaatgcatatgcaggtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaatgattcacttcttctcttgccagttttaaaagccgttaataattatgaaaactatattcggctctcggttatctcttttgggtttggctgttaatattttgaaggatctggccaacttttgcgccttaggacttatgttatgcgttttggtttcagatgatgactacttttatcgtttgtga

SEQ ID NO: 63 - DNA, 5572 bp, Arabidopsis thaliana
tgtgtttgggggtgatgggagatgatgattttatagtagtttaaaggaagatctataggaggtttttgcttttctccagttacagtttcgatttgagatattaaaagtatgaattaaattgcaagtagtggaattttgtaggaattaagccatgtatttaagtaccttttagtaaataactgttgatgtttgagcttctggggaagaaaaatacggaaagctccatggggcatgttggagatggattgcacccctcattttagctcggcccaaatcaagaataaactaatcaacatcaagcccaaaaagcccataaaagttggtccatgatcctatcaccagcttagtttttctataaatagagaggcatctcaaggaaaaaaggaggaaaaaatccatattaaaacgtcttcaagctcctcagctcgttctctagctcctctgctcgccctcaagctcctcagctcgtcctcaagctccttagctcgttctcaagctcctctgctcgtcctctagctcctctgctcgtcctcaagcttctcagctcgtcctcaagctcctcagctcgtcctcaagttccccagctcgtcctcaagctcctgagctcgtcctcaagctcctcagctcgtctttaagctctccagctcgtcttcaagctccacatcactcaacgaccatctcctcgcctagctataaaactaataaactatgtttatcgcaagaacgacctaactcccgaccttcaacgcgatgagaatgtttttcccttatcaaagaacttagaaatatactttgttgaaattcgtgcatcaacagggcagtgactgaaacactctttttctctttcgtcgtcctctgaattgcgtcgatcgaataggagaaaatgaaatcaagggtttgcaattttaactgggttttcttaggtcatttcggttcataggttttttgactaaatcttggcccgataaacatcactaagtctatttggttctttggctcatgggctttttgaccaaatcgtggccccataaacattactaaatctatttcacgcataaaaaaaaatgtgaaggcgagtaaaaacatgtgggctccacattaaaaagatgtagtgacgtggacacttttagaagagagaaaactctgctattatatatatgatttgtttattttccatcaatatacgaatatctctacttccttttttaaagactctttaaatcttaatcaatcgttcataatatatctccagttgcattcattatccttctaaatcctctcttattagtctttaatcataaataaaaaataatacatcaatgagagttctttccaccgtccgatcaaactctggtatattgacgtcagcaatcggacgtaaacatgtcgaagttaacttgctacgcgaaacagaggattaatctctcagccaataagagacctgagaagacgagaagaaaaaagaagactttggtccttggacttgggtctttctttctctttttctttcgataattattgtacttggttctttgttctcagtgtaaatgaaagtgagaatccaaaggctatcatcggaaactgagggaacagagatcattcatcgccgcggtaagttatctgtcatcgtatatctttaagccctctgtttcttcttgtttgagtagtgatcttagattcttcaaaaaatattgtttaggttgatatagagaaagatggggaagacaattcaagtgtttggattccctaatggtgtgagcgcagaagaagttaagaagtttcttgaaagactcactggttcaggcactgtttacgcaatcaaagttagacaaccaaagaaaggtggtccaagagtctatgccattgttcaattcacatctgagagacatacgaggctgatcatcactgcggcagcagaacgtctttactatggaagatcttatctcaaggcttttgaagttgaacaagacattgttccaaagccaagagcttcattacacaccatctctggtttaaagatgttctttggatgtcaagtctcgactaagaagtttttaactctatggagtgctcaagatgtttgtgtctcgtttggaattgggatgaggaaactgcatttttcgttttcttggtatcaaaaggattatcgtcttgagctttcgtatgagaatatatggcagattgatttgcattctccgcaaggacgatcatcgaagtttcttgtgattcaggtgattggtgctcctaaaatatttgagaaagaggatcaacctatcaatcttttgtttggaataatggatttttacagtgatgggtctgatgagcaatggattagaactacagatttcacttcatcttcttgtattggtcaatcaacagcgttttgtttagagcttcctgttcatcttaatgttcctgatttcagagagaattttgccaactatgcagagcacagagccagctcttttctcattgaatctggttctagctattcatctaatgctaacacacttgttcctgttgttgatcctcctccagggtttagtttgccttttgagatcttgtttaaacttaacacattggtgcagaacgcgtgtctctccgggccagctcttgatcttgacttttatcggttgcttaatcagaaaaaatatgatagagctctcatagatcactgtcttgaaaaactctttcaccttggagaatgttgctatgagcctgctcattggcttcgcgatgagtacaagaagtggatatcgaaaggaaagcttccactgtctcctacaatatctcttgatgatggacttgtttatatgtatcgcgttcaagttacaccagcaagagtctatttctctggaccggaggtgaatgtttctaatcgtgtgcttcgacattactccaagtatatcaacaacttcctcagggtctcatttgttgatgaagatcttgaaaaggttcgttccatggatctatctccacgctcttctactcaaagaagaaccaagttatacgacaggatatattctgttcttcgcgatgggattgtcataggcgataagaagtttgagtttctcgccttttcttccagccagttgcgggagaactctgcttggatgtttgcaccaatagatcggattacagcagcacatatcagagcttggatgggtgattttgaccatataagaaatgtagctaaatatgctgcaaggcttggtcaatcttttagctcttcaagagagacacttaatgttaggagtgatgagattgaagtgattcctgatgttgagattatatctttagggacacgctatgtgttttccgatggaataggaaagatatcagctgaatttgctagaaaggtagcgaggaaatgtggtcttacagagttttctccatctgcttttcaaatccgttatggcggttataaaggagtggtggctgttgatccaaactcatcaaagaaactgtctctgaggaagagtatgagcaaattcgaatcggagaacaccaagcttgatgttctggcgtggagcaagtaccaaccttgttatatgaacagacaactgattacacttttgtctactcttggagttacggacagtgtgtttgagaagaaacaaagggaagttgtggatcgtctcgacgcaatcttgactcatcctttggaagctcacgaggctcttggtttaatggctccaggggaaaacacaaatattctcaaggcattgatcttgtgtggctataaacctgacgctgaacctttcctttcaatgatgcttcagaatttcagggcatctaagttgttggaactacggacaaaaacaaggattttcatttctggtggaagatctatgatgggatgcctagacgagaccagaacactggagtatggtcaggtagtagtgcagtattcagatcccatgaggccgggaaggcgattcatcatcaccggacctgttgttgttgccaaaaacccatgcctgcatcctggtgacgtgcgtgttcttcaagctgtcaatgtcccagctttaaatcatatggtggactgcgttgtgttcccgcaaaagggcttgaggtaaacatttttctatgcttgattcgtgtttttttcgagcttttattgttttaagtctcgaacttttcattggaatcttgtgttcttttgtgcataggccacacccaaatgaatgttctgggagtgatttagatggagatatttactttgtatgttgggatcaagaattggttccgccaagaacgtctgaaccaatggactacactcctgaaccaactcaaatcttggatcatgatgtcacaattgaggttataataaaatttgatcactttggttatatttttgtttttttggcgttaggagattgattggctaccttggtttccaggaagttgaagagtactttgcgaactacattgtgaatgatagtttagggatcatcgcgaatgctcataccgcctttgcggataaggaaccactcaaggcgtttagtgacccatgcattgagcttgcaaagaagttttcaactgcggtagatttcccaaaaactggtgttgcagctgtgataccgcaacatctttacgtgaaagagtatcctgatttcatggagaaaccggataagccaacatatgagtcgaagaacgtgattggtaagctttttagagaggtaaaagagcgagctccaccgttgatctcgatcaaatcattcacgcttgatgtggcctcaaagtcttatgataaagacatggaagttgacggatttgaggagtatgttgatgaagctttctaccagaaggcgaattatgatttcaagttaggtaatttgatggattactatgggattaagactgaggctgagattcttagtggtggtataatgaggatgtcaaagtcattcaccaagagacgagatgcagaatcgattggaagagcggttcgggcgttgaggaaagaaactttgtcgttgttcaatgcttctgaagaagaagaaaatgagtcagcaaaggcttcggcttggtatcatgtaacgtaccactcaagttactggggactttataatgagggtttgaatcgtgaccatttcttaagttttgcgtggtgcgtttatgataagcttgtgaggatcaagaagaccaatcttgggaggcgtcagcggcaggagacgctcgagcggttagaccatgttctgcgtttcggttgattttttttttttggttctgacttatgtcttatgatgtacataaatgtttggttttgtgtgcaatcagcaatttctataaatatggttggtttttagtgaaatcagaagtttctactttcttatttgatcgaattaactcaaatttgaagcttcattcattctttttttttacagtatctcgaaaacatttgtacaaaaatctctaaaattaattagtaccaaacagaaaaacttgctaccactaagagttctatgttcgacctctcaacatatgtatgtacataaacaatttctctgaatgggccaatcccattaaagcacatacacagctctatatattcacacactccaaaatc

SEQ ID NO: 64 - DNA, 11579 bp, Arabidopsis thaliana
tgtactaatattaaaaagttctcgataataatcttttttatttttaaatgcaagacttgcaccaactttctctataatggataaaaggtcgatgaatgatattttagggttgactaatttgttatacgatgatacaatcgagttttatccgattattactatggtagtaaataacgcggtcaaatgtggtcgaaccgaactggtgacgatcataacatcaaatgtggtcgaaccgagtgacgatcaaaatatcaacatatgtggtcgaacgactgaaaaccaaactagccaaaaacacacatcaacttttttcggtttggcttagttaccctagaagattaccctcaaacaaacaaaacccaaaaaaattaaaatattaattttaaaatagaagaaacatattttaagaaaaagtcatttcttttaattgttactttagttttggacactacaagctgaccgagtagtccaacattcgatatgaaagaaagtggctcactgcctatatagctctcgccactgggagaatacaaggttcgatcctagattttgatggaatgtcaaccaagattcataatttgtgcacttgttttttccccataatttcttagttaaaggtacatcaatataaattttaagtagtcaagtgtgtccaatcaacaaaaggtaaatctataaaaatttggaaatttatcaaaatgaatcaatgtaatgttgtataatatggaaaaatatgtagtttagatgtttttactttataatacttatcattgctgcatcaccactcatattaaaaatgactaaataaatactcaagtatgtgttaacctcataaaaatgaaatgaggttaaacttctgcaatttcacatatggtaaattgtttctagagctaaaagacctgcaacaaggtgattcaatcttcttcttcgacatttaacaagtcggaagttcatgctacaaatatcagtacaaaaaatcatactctatccatttcaaattaaatttagttcaagtgtatacgtaaatttaaaaaatgaacgcattttagattttcaaaatctgagatcaaatacctaatttaaccttatcaaaatcaagagtcatctagattgtaagggtataatagaaattataatgtttttaataattttttgtaaaaattttaaatgacacttaaagtaaaacggagagaagataacttaacagccacgaaatcgcgacttgagatttcaaagagataaagtattcatctatgtactttggcacatcaatactcttaaaatttaccaaaatatgtaatataacatccctaaccatcaacaacaatcaacataaattttaatatatatgtttttgtaattttcgtaaaaatgttaaaacaacacttatagtaaaacaaagagaggataacttaacagccaaagaattgagatttgagatttcgaagagataagatattcatctatatatcttgacacatcagcactctaaaaatttaccaaaagatgtattttaaaatctctaaactcaataactccacaaaaattttcagaatcaatgattgtagaaacacatgatttctggttcagaatttcacacactccacccaaaaaaatacccttaaaaagttataattgtattgattagctgataaaatcaatttattggaaagaaatcctaataataacgctgtaatagaagagaagagaagagagagggagacgtgagatcgtgaattatgcgtgacgaagttgacttgagcttgaccattccctcgaagcttttggggaagcgagacagagaacaaaaaaattgtgaagaagaaaaaaacaaaaacaaaaaagctaaaaagcagcaaaaggacccaattcttcttcacactagtgctgccactcacaagtttcttcctcctcctttgaccatgccgtacagtgaaatcggcgacgatcttcgctcactcgactttgaccacgccgatgtttcttccgaccttcacctcacttcttcttcctctgtttcttcgttttcctcttcttcgtcttctttgttctccgcggctggtacggatgatccttcaccgaaaatggagaaagaccctagaaaaatcgccaggaggttcgattttttctcgtctttgccaacacttttcatagctcgcattatcttcggttttgctttgcttccttgcttacgattttgtacggatggtattttatcgattctgttgttgtatcggattgtctttagggaaagatcgcgacgagttttttttgtttgtgtgtgttgcttgtggtgaaattcgtttttgagaaggcttaatgattttgtttcgctgtatgaaggtatcaggtggagctgtgtaagaaagcaacggaggagaacgttattgtatatttgggtacaggttgtgggaagactcacattgcagtgatgcttatatatgagcttggtcatttggttcttagtcccaagaaaagtgtttgtatttttcttgctcccaccgtggctttggtcgaacaggtgtgaggctgttcatcttgattatatgtcggtgtttaatgcggattgattagttctaactgtcttgagtttgttgttgtttacagcaagccaaggtcatagcggactctgtcaacttcaaagttgcaatacattgtggaggcaagaggattgtgaagagccactcggagtgggagagagagattgcagcgaatgaggtgatttcctgttttctcattctatttttagcctatgagactcatttaagttgattgttatttccattttacaattatgtaggaaccatcactttattatatgcgatcttctttcaattgtttgttttgttcttgggactgaattttcctgcaggttcttgttatgactccacaaatacttctgcataacttacagcactgtttcatcaagatggagtgtatctcccttctaatatttgatgagtgtcaccatgctcaacaacaaagcaaccatccttatgcagaaatcatgaaggtatcttccttcacattattggtatatcgtgcttgaaatattattaacatataatcaacttttagttgctccactttgttgcaaatgcaggttttctataaatcggaaagtttacaacggcctcgaatatttggaatgactgcatctccagttgttggcaaaggtaggcccatttttctaatggtgactatggattgctggtccattactgtccaaagattttattatgatttagcttctgcattgagttccttttgttcgttctctttcggttgtgaggtttgtcgtgatcttgataatacatgtttacttttgatcatctcgttctatagatggtccacctcttgacagctttacctacttttcagggtcttttcaatcagagaatttatcgaaaagcattaatagccttgaaaatttgctcaatgccaaggtatgctggttctgaaattcccttggttggctgttggcagatgaacttagaacacatttttggtatttaagtagcaagatatctttcctagaattgaatactgccggcttatttatattgagccctatcacgctgtgttttgggtgataccaaagtagaaataatactctgagaaagcttgaatcttttgttttttttggtattttcggcccaagcttatggtaccaaactaatcatttattggaagtctaaggcagaaatatctttctcatgtttagattcgtactaatgttcttacattcagttggtctttcgaaacaatgttctaaaatttccctttttgtctctcgtgatctgaaaggtttattcagtggaaagcaatgtccagctggatggttttgtttcatctcctttagtcaaagtatattattatcggtcagctttaagtgatgcatctcaatcgaccatcagatatgaaaacatgctggaggacatcaaacagcgggttgtctaaatgtgtctcataaatcttttgaatcactgttcctcgatatatgagcttatatttcttcctgatatgaacagtgcttggcatcacttaagctgctgattgatactcatcaaacacaaaccctcctaagtatgaaaaggcttctcaaaagatctcatgataatctcatatatactctgctgaatcttggcctctggggagcaatacaggtagaaatttcatactgaaccaatttatagatttgatatcaggttttcagtttttgctttcagatgtattgattaccttgtatttcctggtttcttcaatgttttaccaagcagctgatgcatgttttagggtacagttattaccataattgccaactatattaaacttttgcattagtagtgtactagatcgaagtcaaagactacaatgactggcaagattcacaatagctgtacaatagggaaaaagtggaaaacaaataagggtttctgttagatgcttgctgaattgtataaaaattcctagagattttttttggtaaatttatgtgcatgtttctataatttgttacaaccatctaacctcgatatgtaaacttacctctttgccaaattaaaattatgtatgttgtttcttgttggtgtcatatgtgtcttaatgcatgttgtagcgtgctaatgtttattgtcttcgttttttggaggctgctaaaatccaattgaatagtgaccataatgtacaagacgagcctgtgggaaagaatcctaagtcaaagatatgtgatacatatctttctatggctgctgaggccctctcttctggtgttgctaaaggtaagatgacatagtaccatagtgagtgtttttttcttctgaaccttaaattttcttccaatacggccatggcagaaacggaaacgtttttcattacatatatttttctggagttccaacttttaaaatatttaacaaattctgcactggatttgtttttttcatgtgaatgccctattaaactagccattgattgcctaattattttttctcatcttttctgtggttgtagatgagaatgcatctgacctcctcagcttagcggcgttgaaggaaccattattctctagaaagctagttcaattgattaagatcctttcggtattcaggttggtacttgatagaggtgacagagtcttagaatgcttttataccgaatagtccataaagcatgtgtgaagtaaataaatgattgaactgtccttagctttattgagtggctacgtaaccaaaacccgatgcgttttctcaaagttaccatttgcgcgaaaaatgacaaacttactttatgtatgaaagtctagtcctacttacctttttttcctctctactttttttatttttttcattcgtaagataggactgagaacctagaaatgaagctttatagatacacaagaaaatttgctatcgtcgatagatctctgttcaaaagtcagaatatggccttttctgagtaaacaacattcagctcatgtcctttcctagtaaacaacttccagctcttgattcaccattaaaaagacattggatatttctatatgaacatggtagttgttattgtccactgggtcttgtgaaatcttaattgcttttcaccacattgtgcttgattcacttgtcatgcattatggaagagaaaccaatggtatttcttgcagtaaacttccatttttctttttctttcaggctagagccacacatgaaatgtataatatttgtcaatcggattgtgactgcaagaacattgtcatgcatactaaataacttggaactgctacggtcttggaagtctgatttccttgttggacttagttctggactgaagagcatgtcaagaaggagtatggaaacaatacttaaacggttccaatctaaagaggtgataatttagccatctttattcctatagttagtattcggagatatctgcacttaatattcctacacccatgatatttaaacacccatttcgataaacatgtattgtctaggattaatcgtcaagccacttccatttaacttctagaggttccttttactgttccagctcaatttactggttgccactaaagttggtgaagaaggccttgatattcagacatgctgtcttgtgatccgttatgatttaccagagactgttaccagcttcatacagtccagaggtcgtgctcgaatgcctcagtctgaatatgcgtttctagtggacaggtttgcacgaatgagaaaatgataagcccataagtatgagtccttacgcgattaacaatgttttcttttatgattcagcggaaacgagaaagagatggatcttattgaaaattttaaagtaaatgaagatcgaatgaatctagaaattacttacagaagctcagaggaaacttgtcctagacttgatgaggagttatacaaagttcatgagacaggagcttgtatcagtggtggaagcagcatctcccttctctataaatattgttctaggcttccacatgatgagtaaggctttaaattttctgttgtgttctttttaaaaagagtcaccttccatagtaaatgggagcttgttcgtggcataactgaatctccctttgccacattttgattccctcagattttttcagcccaagccagagtttcaattcaagcctgttgacgaatttggtggaactatctgtcgcataactttacctgctaatgctcctataagtgaaatcgaaagttcactactaccttcgacagaagctgctaaaaaggatgcttgtctaaaggctgtgcatgagttgcacaacttgggtgtacttaacgattttctgttgccagattccaaggatgaaattgaggacgaattgtcagatgatgaatttgattttgataacatcaaaggtgcatgcgtggttcagttataaaatctaagcttttttatgctattcgtttgttgtataacgccatctattttacttcctgctaggtgaaggctgttcacgaggtgacctgtatgagatgcgtgtaccagtcttgtttaaacaaaagtgggatccatctacaagttgtgtcaatcttcattcttactatataatgtttgtgcctcatcccgctgataggatctacaaaaagtttggtttcttcatgaagtcacctcttcccgttgaggctgagactatggatatcgatcttcaccttgctcatcaaagatctgtaagtgtaaagatttttccatcaggggtcacagaattcgacaacgatgaggtactgagattttaattagataaataataaactagaatgaactcctcttatttgataatgtttatgcagataagactagctgagcttttccaggagattgccctgaaggttctttttgaacggggggagctgatcccggactttgttcccttggaactgcaagactcttctagaacaagcaaatccaccttctaccttcttcttccactctgtctgcatgatggagaaagtgttatatctgtagattgggtgactatcagaaactgcttgtcatcaccaatctttaagactccatctgttttagtggaagatatatttcctccttcgggctctcatttaaagctagcaaatggctgctggaatattgatgatgtgaagaacagcttggtttttacaacctacagtaaacaattttactttgttgctgatatctgccatggaagaaatggtttcagtcctgttaaggaatctagcaccaaaagccatgtggagagcatatataagttgtaagctactaaacttctattattcagtaattgtttgattgcgacttttctcaggggcatgtattctgtcttttctttcttgttaatgttctttttctttttctacaatccattataaaattggttgagactctagatttgaggattatatgattttctgagttaagaaccttcttatttttatgcacaaactaggtatggcgtggaactcaagcatcctgcacagccactcttgcgtgtgaaaccactttgtcatgttcggaacttgcttcacaaccgaatgcagacgaatttgggtagattttcttatctgatttttgcatatcacaattttcttgtgcatgtacatgtacacacagcacaccttttgacctttgtatactgtaattgttaattctcatgttttggttcaaatgttaataacattctcacattgccaagaacagaaccacaagaacttgacgaatacttcatagagattcctcccgaactttctcacttaaagataaaaggattatctaaagacatcggaagctcgttatccttgttaccatcaatcatgcatcgtatggagaatttactcgtggctattgaactgaaacatgtgctgtctgcttcgatccctgagatagctgaagtttctggtcacagggtatgatctcatttcacttgataacccatttacttgattttcctaaaatttgttgatgtttgatactttactgaccgagtgaattggtataggtactcgaggcgctcacaacagagaaatgtcatgagcgcctttctcttgaaaggcttgaggtgcttggtgatgcattcctcaagtttgctgttagccgacacctttttctacaccatgatagtcttgatgaaggagagttgactcggagacgctctaacgttgttaacaattccaacttgtgcaggcttgcaataaaaaaaaatctgcaggttctcatgtttcctataaatgctttgattgctggtacaatttaaatctggttttagctgtgattgctgcacacaacgcaaatacttatcatgtgcagaagcgccgtcagaccctttgcctccatacaattaatacagtctcaatgacatgttttcaaaaacaaagctttttagatagaggcagacaaaaacgtattaattttattgtttagttttgtataatattaacttgtgcgtcttcccaggtctacatccgtgatcaagcattggatcctactcagttctttgcatttggccatccatgcagagtaacctgtgacgaggtagccagtaaagaggttcattccttgaatagggatcttgggatcttggagtcaaatactggtgaaatcagatgtagcaaaggccatcattggttgtacaagaaaacaattgctgatgtggttgaggctcttgtgggagctttcttagttgacagtggcttcaaaggtgctgtgaaatttctgaagtggattggtgtaaatgttgattttgaatccttgcaagtacaagatgcttgtattgcaagcaggcgctacttgcccctcactactcgcaataatttggagacccttgaaaaccagcttgactataagttcctccacaaaggtctacttgtacaagcctttatccatccatcttacaacaggcatggaggaggctgctaccaggtatttttgtgtttccttcttatttttcatttctctcgataatatccatctatggtaaccaaatttctctaattgggggtcctcagagattggagtttcttggggatgctgttctggactacttgatgacatcctattttttcacagtcttcccgaaactgaaacctggtcaactgaccgatctaagatctctctcagtaaataatgaggcgctagcaaatgttgctgtcagtttttcgctaaagagatttctattttgcgagtccatttatcttcatgaagttatagaggattataccaatttcctggcatcttccccattggcaagtggacaatctgaaggtccaagatgcccaaaggtgcgttccgatctccctttcacatgtcatagtaaaacaatgataagattcactcgtattgatatcatcttacttacattttgagaatctcgaactatctctgttacctttctaccttaatatctttttatctatacgagatgttgagaatggaagagactatccccatctcattagttttagtttgcagtcaattaatatcttaattacataagaacatacataggtaaattagtggaagagctaatatagttattatattcttatgcaggttcttggtgacttggtagaatcctgtttgggggctcttttcctcgattgtgggttcaacttgaatcatgtctggactatgatgctatcatttctagatccggtcaaaaacttgtctaaccttcagattagtcctataaaagaactgattgaactttgccagtcttacaagtgggatcgggaaatatcagcgacgaaaaaggatggtgcttttactgttgaactaaaagtgaccaagaatggttgttgccttacagtttctgcaactggtcggaacaaaagagagggcacaaaaaaggctgcacagctgatgattacaaacctgaaggtactttctcaaaatcaaaagaaactgtagtgtaacaaatttcttcaattgatgtgatgtatatatatcttaagctatctagtgttcatatatgtaactcgttgttcaagaacttctttgtgtaattcatccgcaggctcatgagaacataacaacctcccatccgttggaggatgttctgaagaatggcatccgaaatgaagctaaattaattggctacaatgaagatcctatagatgttgtggatcttgttgggctggacgttgaaaacctaaatatcctagaaacttttggcgggaatagtgaaagaagcagctcatacgtcatcagacgaggtctcccccaagcaccatctaaaacagaagacaggcttcctcaaaaggccatcataaaagcaggtatgtggatgaattcttgtgtattttatcaggagattgtaaatttagtgcaatcttgaattatcgattctattactccacaggtggaccaagcagcaaaaccgcaaaatccctcttgcacgaaacatgtgttgctaactgttggaagccaccacacttcgaatgttgtgaagaggaaggaccaggccacctgaaatcgtaagtaacttgatcaaacacactgctaaatctctgaacttgagcgcgctagaaacttaataaacaaaatatcggtaattggaatttaatgtcatcaattgtgtgcatgaatacagattcgtctacaaggtaatcctggaagttgaagatgcgcccaatatgacattggaatgttatggtgaggctagagcaacgaagaaaggtgcagcagagcacgctgcccaagctgctatatggtgcctcaagcattctggattcctttgctgatgatctcgagcggctatatatcggttagaaatagatgttatcataggcatatataacttttaccagagctacatattagcatatatgatcgacacctacaatttctcgaaagagaaaaaaggatgtctgaaaactaaccttaaaccatagattttggagcggagagctttcggcaaaagttctcttcgattgctcttctgaatttctgaatataagtatatgtttacttgtacttgatgaacccatagcatgataggctccaaaaatatagtttactcatctctcatgcatcaaatatgttcctgtgtgatcttaattaaacaatatatgaactaagcgtta

SEQ ID NO: 65 - protein, 924 aa, Arabidopsis thaliana
MDSTNGNGADLESANGANGSGVTEALPPPPPVIPPNVEPVRVKTELAEKKGPVRVPMARKGFGTRGQKIPLLTNHFKVDVANLQGHFFHYSVALFYDDGRPVEQKGVGRKILDKVHQTYHSDLDGKEFAYDGEKTLFTYGALPSNKMDFSVVLEEVSATRANGNGSPNGNESPSDGDRKRLRRPNRSKNFRVEISYAAKIPLQALANAMRGQESENSQEAIRVLDIILRQHAARQGCLLVRQSFFHNDPTNCEPVGGNILGCRGFHSSFRTTQGGMSLNMDVTTTMIIKPGPVVDFLIANQNARDPYSIDWSKAKRTLKNLRVKVSPSGQEFKITGLSDKPCREQTFELKKRNPNENGEFETTEVTVADYFRDTRHIDLQYSADLPCINVGKPKRPTYIPLELCALVPLQRYTKALTTFQRSALVEKSRQKPQERMTVLSKALKVSNYDAEPLLRSCGISISSNFTQVEGRVLPAPKLKMGCGSETFPRNGRWNFNNKEFVEPTKIQRWVVVNFSARCNVRQVVDDLIKIGGSKGIEIASPFQVFEEGNQFRRAPPMIRVENMFKDIQSKLPGVPQFILCVLPDKKNSDLYGPWKKKNLTEFGIVTQCMAPTRQPNDQYLTNLLLKINAKLGGLNSMLSVERTPAFTVISKVPTIILGMDVSHGSPGQSDVPSIAAVVSSREWPLISKYRASVRTQPSKAEMIESLVKKNGTEDDGIIKELLVDFYTSSNKRKPEHIIIFRDGVSESQFNQVLNIELDQIIEACKLLDANWNPKFLLLVAQKNHHTKFFQPTSPENVPPGTIIDNKICHPKNNDFYLCAHAGMIGTTRPTHYHVLYDEIGFSADELQELVHSLSYVYQRSTSAISVVAPICYAHLAAAQLGTFMKFEDQSETSSSHGGITAPGPISVAQLPRLKDNVANSMFFC

SEQ ID NO: 66 - protein, 924 aa, Arabidopsis thaliana; identical to SEQ ID NO: 65

SEQ ID NO: 67 - protein, 896 aa, Arabidopsis thaliana
MDSDEPNGSGLPPPPPFVPANLVPEVEPVKKNILLPMARPRGSGSKGQKIPLLTNHFGVKFNKPSGYFFHYSVAINYEDGRPVEAKGIGRKILDKVQETYQSDLGAKYFAYDGEKTLFTVGALPSNKLDFSVVLEEIPSSRNHAGNDTNDADRKRSRRPNQTKKFMVEISYAAKIPMQAIASALQGKETENLQDALRVLDIILRQSAARQGCLLVRQSFFHNDVKNFVPIGGGVSGCRGFHSSFRTTQGGLSLNIDTSTTMIVQPGPVVDFLLANQNKKDPYGMDWNKARRVLKNLRVQITLSNREYKISGLSEHSCKDQLFTWRKPNDKGEFEEVEITVLNYYKERNIEVRYSGDFPCINVGKPKRPTYFPIEFCNLVSLQRYTKSLTNFQRAALVEKSRQKPPERMASLTKGLKDSNYNADPVLQDSGVSIITNFTQVEGRILPTPMLKVGKGENLSPIKGKWNFMRKTLAEPTTVTRWAVVNFSARCDTNTLIRDLIKCGREKGINVEPPFKDVINENPQFRNAPATVRVENMFEQIKSKLPKPPLFLLCILAERKNSDVYGPWKKKNLVDLGIVTQCIAPTRLNDQYLTNVLLKINAKLGGLNSLLAMERSPAMPKVTQVPTIIVGMDVSHGSPGQSDIPSIAAVVSSRQWPLISKYKACVRTQSRKMEMIDNLFKPVNGKDEGMFRELLLDFYYSSENRKPEHIIIFRDGVSESQFNQVLNIELDQMMQACKFLDDTWHPKFTVIVAQKNHHTKFFQSRGPDNVPPGTIIDSQICHPRNFDFYLCAHAGMIGTTRPTHYHVLYDEIGFATDDLQELVHSLSYVYQRSTTAISVVAPVCYAHLAAAQMGTVMKYEELSETSSSHGGITTPGAVPVPPMPQLHNNVSTSMFFC

SEQ ID NO: 68 - protein, 878 aa, Arabidopsis thaliana
METSSSLPLSPISIEPEQPSHRDYDITTRRGVGTTGNPIELCTNHFNVSVRQPDVVFYQYTVSITTENGDAVDGTGISRKLMDQLFKTYSSDLDGKRLAYDGEKTLYTVGPLPQNEFDFLVIVEGSFSKRDCGVSDGGSSSGTCKRSKRSFLPRSYKVQIHYAAEIPLKTVLGTQRGAYTPDKSAQDALRVLDIVLRQQAAERGCLLVRQAFFHSDGHPMKVGGGVIGIRGLHSSFRPTHGGLSLNIDVSTTMILEPGPVIEFLKANQSVETPRQIDWIKAAKMLKHMRVKATHRNMEFKIIGLSSKPCNQQLFSMKIKDGEREVPIREITVYDYFKQTYTEPISSAYFPCLDVGKPDRPNYLPLEFCNLVSLQRYTKPLSGRQRVLLVESSRQKPLERIKTLNDAMHTYCYDKDPFLAGCGISIEKEMTQVEGRVLKPPMLKFGKNEDFQPCNGRWNFNNKMLLEPRAIKSWAIVNFSFPCDSSHISRELISCGMRKGIEIDRPFALVEEDPQYKKAGPVERVEKMIATMKLKFPDPPHFILCILPERKTSDIYGPWKKICLTEEGIHTQCICPIKISDQYLTNVLLKINSKLGGINSLLGIEYSYNIPLINKIPTLILGMDVSHGPPGRADVPSVAAVVGSKCWPLISRYRAAVRTQSPRLEMIDSLFQPIENTEKGDNGIMNELFVEFYRTSRARKPKQIIIFRDGVSESQFEQVLKIEVDQIIKAYQRLGESDVPKFTVIVAQKNHHTKLFQAKGPENVPAGTVVDTKIVHPTNYDFYMCAHAGKIGTSRPAHYHVLLDEIGFSPDDLQNLIHSLSYVNQRSTTATSIVAPVRYAHLAAAQVAQFTKFEGISEDGKVPELPRLHENVEGNMFFC

SEQ ID NO: 69 - protein, 850 aa, Arabidopsis thaliana
MDTTLPPPQHMEREPLKSKSSLLPMTRRGNGSKGQKILLLTNHFRVNFRKPNSHNFFHYSVTITYEDGSPLLAKGFGRKILEKVQQTCQADLGCKHFAYDGDKNLYTVGPLPRSSLDFSVVLETAPSRRNADKRLKLPHQSKKFNVAILFAPPEIPMEAIANALQGKKTKHLLDAIRVMDCILSQNAARQGCLLVRQSFFHNDAKYFANIGEGVDCCKGFHSSFRTTQGGLSLNIDVSTAMIVKPGPVVDFLIANQGVNDPFSINWKKAKNTLKNLRVKVLPSNQEYKITGLSGLHCKDQTFTWKKRNQNREFEEVEITVSDYFTRIREIELRYSGGLPCINVGKPNRPTYFPIELCELVSLQRYTKALTKFQRSNLIKESRQNPQQRIGVLTRALKTSNYNDDPMLQECGVRIGSDFTQVEGRVLPTPKLKAGKEQDIYPINGSWNFKNKPATVTRWAVVNFSARCDPQKIIDDLTRCGKMKGINVDSPYHVVFEENPQFKDATGSVRVDKMFQHLQSILGEVPPKFLLCILEKKNSDVYEKSCSMWNCECIVPPQNLNDQYLTNLLLKINAKLGGLNSVLDMELSGTMPLVMRVPTIIIGMDVSHGSPGQSDHIPSIAAVVSSREWPLISKYRACVRTQSPKVEMIDSLFKPVSDKDDQGIMRELLLDFHSSSGKKPNHIIIFRDGVSESQFNQVLNIELDQMMQINHHTKFFQTESPNNVLPGTIIDSNICHQHNNDFYLCAHAGKIGTTRPTHYHVLYDEIGFDTDQLQELVHSLSYVYQRSTTAISLVAPICYAHLAAAQMATAMKFEDMSETSSSHGGITTAGAVPVPPMPKLNTNVASSMFFC

SEQ ID NO: 70 - protein, 839 aa, Arabidopsis thaliana
MAPKRKRPATKDDTTKSIPKPKKRAPKRAKTVKEEPVTVVEEGEKHVARFLDEPIPESEAKSTWPDRYKPIEVQPPKASSRKKTKDDEKVEIIRARCHYRRAIVDERQIYELNDDAYVQSGEGKDPFICKIIEMFEGANGKLYFTARWFYRPSDTVMKEFEILIKKKRVFFSEIQDTNELGLLEKKLNILMIPLNENTKETIPATENCDFFCDMNYFLPYDTFEAIQQETMMAISESSTISSDTDIREGAAAISEIGECSQETEGHKKATLLDLYSGCGAMSTGLCMGAQLSGLNLVTKWAVDMNAHACKSLQHNHPETNVRNMTAEDFLFLLKEWEKLCIHFSLRNSPNSEEYANLHGLNNVEDNEDVSEESENEDDGEVFTVDKIVGISFGVPKKLLKRGLYLKVRWLNYDDSHDTWEPIEGLSNCRGKIEEFVKLGYKSGILPLPGGVDVVCGGPPCQGISGHNRFRNLLDPLEDQKNKQLLVYMNIVEYLKPKFVLMENVVDMLKMAKGYLARFAVGRLLQMNYQVRNGMMAAGAYGLAQFRLRFFLWGALPSEIIPQFPLPTHDLVHRGNIVKEFQGNIVAYDEGHTVKLADKLLLKDVISDLPAVANSEKRDEITYDKDPTTPFQKFIRLRKDEASGSQSKSKSKKHVLYDHHPLNLNINDYERVCQVPKRKGANFRDFPGVIVGPGNVVKLEEGKERVKLESGKTLVPDYALTYVDGKSCKPFGRLWWDEIVPTVVTRAEPHNQVIIHPEQNRVLSIRENARLQGFPDDYKLFGPPKQKYIQVGNAVAVPVAKALGYALGTAFQGLAVGKDPLLTLPEGFAFMKPTLPSELA

SEQ ID NO: 71 - protein, 1580 aa, Arabidopsis thaliana
MHSSLEPEKMEEGGGSNSLKRKFSEIDGDQNLDSVSSPMMTDSNGSYELKVYEVAKNRNIIAVLGTGIDKSEITKRLIKAMGSSDTDKRLIIFLAPTVNLVKQQCCEIRALVNLKVEEYFGAKGVDKWTSQRWDEEFSKHDVLVMTPQILLDVLRSAFLKLEMVCLLIIDECHHTTGNHPYAKLMKEFYHESTSKPKIFGLTASAVIRKGIVSSPSNYAAQVSELERLMDSKIFNPEEREGVEKFATTVKEGPILYNPSPSCSLELKEKLETSHLKFDASLRRLQELGKDSFLNMDNKFETYQKRLSIDYREILHCLDNLGLICAHLAAEVCLEKISDTKEESETYKECSMVCKEFLEDILSTIGVYLPQDDKSLVDLQQNHLSAVISGHVSPKLKELFHLLDSFRGDKQKQCLILVERIITAKVIERFVKKEASLAYLNVLYLTENNPSTNVSAQKMQIEIPDLFQHGKVNLLFITDVVEEGFQVPDCSCMVCFDLPKTMCSYSQSQKHAKQSNSKSIMFLERGNPKQRDHLHDLMRREVLIQDPEAPNLKSCPPPVKNGHGVKEIGSMVIPDSNITVSEEAASTQTMSDPPSRNEQLPPCKKLRLDNNLLQSNGKEKVASSKSKSSSSAAGSKKRKELHGTTCANALSGTWGENIDGATFQAYKFDFCCNISGEVYSSFSLLLESTLAEDVGKVEMDLYLVRKLVKASVSPCGQIRLSQEELVKAKYFQQFFFNGMFGKLFVGSKSQGTKREFLLQTDTSSLWHPAFMFLLLPVETNDLASSATIDWSAINSCASIVEFLKKNSLLDLRDSDGNQCNTSSGQEVLLDDKMEETNLIHFANASSDKNSLEELVVIAIHTGRIYSIVEAVSDSSAMSPFEVDASSGYATYAEYFNKKYGIVLAHPNQPLMKLKQSHHAHNLLVDFNEEMVVKTEPKAGNVRKRKPNIHAHLPPELLARIDVPRAVLKSIYLLPSVMHRLESLMLASQLREEIDCSIDNFSISSTSILEAVTTLTCPESFSMERLELLGDSVLKYVASCHLFLKYPDKDEGQLSRQRQSIISNSNLHRLTTSRKLQGYIRNGAFEPRRWTAPGQFSLFPVPCKCGIDTREVPLDPKFFTENMTIKIGKSCDMGHRWVVSKSVSDCAEALIGAYYVSGGLSASLHMMKWLGIDVDFDPNLVVEAINRVSLRCYIPKEDELIELERKIQHEFSAKFLLKEAITHSSLRESYSYERLEFLGDSVLDFLITRHLFNTYEQTGPGEMTDLRSACVNNENFAQVAVKNNLHTHLQRCATVLETQINDYLMSFQKPDETGRSIPSIQGPKALGDVVESIAGALLIDTRLDLDQVWRVFEPLLSPLVTPDKLQLPPYRELNELCDSLGYFFRVKCSNDGVKAQATIQLQLDDVLLTGDGSEQTNKLALGKAASHLLTQLEKRNISRKTSLGDNQSSMDVNLACNHSDRETLTSETTEIQSIVIPFIGPINMKKGGPRGTLHEFCKKHLWPMPTFDTSEEKSRTPFEFIDGGEKRTSFSSFTSTITLRIPNREAVMYAGEARPDKKSSFDSAVVELLYELERRKIVIIQK

SEQ ID NO: 72 - protein, 1570 aa, Arabidopsis thaliana
MHSSLEPEKMEEGGGSNSLKRKFSEIDGDQNLDSVSSPMMTDSNGSYELKVYEVAKNRNIIAVLGTGIDKSEITKRLIKAMGSSDTDKRLIIFLAPTVNLVKQQCCEIRALVNLKVEEYFGAKGVDKWTSQRWDEEFSKHDVLVMTPQILLDVLRSAFLKLEMVCLLIIDECHHTTGNHPYAKLMKEFYHESTSKPKIFGLTASAVIRKAQVSELERLMDSKIFNPEEREGVEKFATTVKEGPILYNPSPSCSLELKEKLETSHLKFDASLRRLQELGKDSFLNMDNKFETYQKRLSIDYREILHCLDNLGLICAHLAAEVCLEKISDTKEESETYKECSMVCKEFLEDILSTIGVYLPQDDKSLVDLQQNHLSAVISGHVSPKLKELFHLLDSFRGDKQKQCLILVERIITAKVIERFVKKEASLAYLNVLYLTENNPSTNVSAQKMQIEIPDLFQHGKVNLLFITDVVEEGFQVPDCSCMVCFDLPKTMCSYSQSQKHAKQSNSKSIMFLERGNPKQRDHLHDLMRREVLIQDPEAPNLKSCPPPVKNGHGVKEIGSMVIPDSNITVSEEAASTQTMSDPPSRNEQLPPCKKLRLDNNLLQSNGKEKVASSKSKSSSSAAGSKKRKELHGTTCANALSGTWGENIDGATFQAYKFDFCCNISGEVYSSFSLLLESTLAEDVGKVEMDLYLVRKLVKASVSPCGQIRLSQEELVKAKYFQQFFFNGMFGKLFVGSKSQGTKREFLLQTDTSSLWHPAFMFLLLPVETNDLASSATIDWSAINSCASIVEFLKKNSLLDLRDSDGNQCNTSSGQEVLLDDKMEETNLIHFANASSDKNSLEELVVIAIHTGRIYSIVEAVSDSSAMSPFEVDASSGYATYAEYFNKKYGIVLAHPNQPLMKLKQSHHAHNLLVDFNEEMVVKTEPKAGNVRKRKPNIHAHLPPELLARIDVPRAVLKSIYLLPSVMHRLESLMLASQLREEIDCSIDNFSISSTSILEAVTTLTCPESFSMERLELLGDSVLKYVASCHLFLKYPDKDEGQLSRQRQSIISNSNLHRLTTSRKLQGYIRNGAFEPRRWTAPGQFSLFPVPCKCGIDTREVPLDPKFFTENMTIKIGKSCDMGHRWVVSKSVSDCAEALIGAYYVSGGLSASLHMMKWLGIDVDFDPNLVVEAINRVSLRCYIPKEDELIELERKIQHEFSAKFLLKEAITHSSLRESYSYERLEFLGDSVLDFLITRHLFNTYEQTGPGEMTDLRSACVNNENFAQVAVKNNLHTHLQRCATVLETQINDYLMSFQKPDETGRSIPSIQGPKALGDVVESIAGALLIDTRLDLDQVWRVFEPLLSPLVTPDKLQLPPYRELNELCDSLGYFFRVKCSNDGVKAQATIQLQLDDVLLTGDGSEQTNKLALGKAASHLLTQLEKRNISRKTSLGDNQSSMDVNLACNHSDRETLTSETTEIQSIVIPFIGPINMKKGGPRGTLHEFCKKHLWPMPTFDTSEEKSRTPFEFIDGGEKRTSFSSFTSTITLRIPNREAVMYAGEARPDKKSSFDSAVVELLYELERRKIVIIQK

SEQ ID NO: 73 - protein, 1531 aa, Arabidopsis thaliana
MHSSLEPEKMEEGGGSNSLKRKFSEIDGDQNLDSVSSPMMTDSNGSYELKVYEVAKNRNIIAVLGTGIDKSEITKRLIKAMGSSDTDKRLIIFLAPTVNLQCCEIRALVNLKVEEYFGAKGVDKWTSQRWDEEFSKHDVLVMTPQILLDVLRSAFLKLEMVCLLIIDECHHTTGNHPYAKLMKIFNPEEREGVEKFATTVKEGPILYNPSPSCSLELKEKLETSHLKFDASLRRLQELGKDSFLNMDNKFETYQKRLSIDYREILHCLDNLGLICAHLAAEVCLEKISDTKEESETYKECSMVCKEFLEDILSTIGVYLPQDDKSLVDLQQNHLSAVISGHVSPKLKELFHLLDSFRGDKQKQCLILVERIITAKVIERFVKKEASLAYLNVLYLTENNPSTNVSAQKMQIEIPDLFQHGKVNLLFITDVVEEGFQVPDCSCMVCFDLPKTMCSYSQSQKHAKQSNSKSIMFLERGNPKQRDHLHDLMRREVLIQDPEAPNLKSCPPPVKNGHGVKEIGSMVIPDSNITVSEEAASTQTMSDPPSRNEQLPPCKKLRLDNNLLQSNGKEKVASSKSKSSSSAAGSKKRKELHGTTCANALSGTWGENIDGATFQAYKFDFCCNISGEVYSSFSLLLESTLAEDVGKVEMDLYLVRKLVKASVSPCGQIRLSQEELVKAKYFQQFFFNGMFGKLFVGSKSQGTKREFLLQTDTSSLWHPAFMFLLLPVETNDLASSATIDWSAINSCASIVEFLKKNSLLDLRDSDGNQCNTSSGQEVLLDDKMEETNLIHFANASSDKNSLEELVVIAIHTGRIYSIVEAVSDSSAMSPFEVDASSGYATYAEYFNKKYGIVLAHPNQPLMKLKQSHHAHNLLVDFNEEMVVKTEPKAGNVRKRKPNIHAHLPPELLARIDVPRAVLKSIYLLPSVMHRLESLMLASQLREEIDCSIDNFSISSTSILEAVTTLTCPESFSMERLELLGDSVLKYVASCHLFLKYPDKDEGQLSRQRQSIISNSNLHRLTTSRKLQGYIRNGAFEPRRWTAPGQFSLFPVPCKCGIDTREVPLDPKFFTENMTIKIGKSCDMGHRWVVSKSVSDCAEALIGAYYVSGGLSASLHMMKWLGIDVDFDPNLVVEAINRVSLRCYIPKEDELIELERKIQHEFSAKFLLKEAITHSSLRESYSYERLEFLGDSVLDFLITRHLFNTYEQTGPGEMTDLRSACVNNENFAQVAVKNNLHTHLQRCATVLETQINDYLMSFQKPDETGRSIPSIQGPKALGDVVESIAGALLIDTRLDLDQVWRVFEPLLSPLVTPDKLQLPPYRELNELCDSLGYFFRVKCSNDGVKAQATIQLQLDDVLLTGDGSEQTNKLALGKAASHLLTQLEKRNISRKTSLGDNQSSMDVNLACNHSDRETLTSETTEIQSIVIPFIGPINMKKGGPRGTLHEFCKKHLWPMPTFDTSEEKSRTPFEFIDGGEKRTSFSSFTSTITLRIPNREAVMYAGEARPDKKSSFDSAVVELLYELERRKIVIIQK

SEQ ID NO: 74 - protein, 626 aa, Arabidopsis thaliana
MVIWNNDDDDFLEIDNFQSSPRSSPIHAMQCRVENLAGVAVTTSSLSSPTETTDLVQMGFSDEVFATLFDMGFPVEMISRAIKETGPNVETSVIIDTISKYSSDCEAGSSKSKAIDHFLAMGFDEEKVVKAIQEHGEDNMEAIANALLSCPEAKKLPAAVEEEDGIDWSSSDDDTNYTDMLNSDDEKDPNSNENGSKIRSLVKMGFSELEASLAVERCGENVDIAELTDFLCAAQMAREFSEFYTEHEEQKPRHNIKKRRFESKGEPRSSVDDEPIRLPNPMIGFGVPNEPGLITHRSLPELARGPPFFYYENVALTPKGVWETISRHLFEIPPEFVDSKYFCVAARKRGYIHNLPINNRFQIQPPPKYTIHDAFPLSKRWWPEWDKRTKLNCILTCTGSAQLTNRIRVALEPYNEEPEPPKHVQRYVIDQCKKWNLVWVGKNKAAPLEPDEMESILGFPKNHTRGGGMSRTERFKSLGNSFQVDTVAYHLSVLKPIFPHGINVLSLFTGIGGGEVALHRLQIKMKLVVSVEISKVNRNILKDFWEQTNQTGELIEFSDIQHLTNDTIEGLMEKYGGFDLVIGGSPCNNLAGGNRVSRVGLEGDQSSLFFEYCRILEVVRARMRGS

SEQ ID NO: 75 - protein, 647 aa, Arabidopsis thaliana
MGSTVILSSDDEDSDISESEMDEYGDKMYLNLKGGKLKVRLSPQAFICPYCPNKKKTSFQYKDLLQHASGVGNSNSDKRSAKEKASHLALVKYLQQDLADSASEAEPSSKRQKNGNPIQDCDHDEKLVYPWKGIVVNIPTTKAQDGRSAGESGSKLRDEYILRGFNPTRVRPLWNYLGHSGTAIVEFNKDWNGLHNGLLFDKAYTVDGHGKKDWLKKDGPKLGLYGWIARADDYNGNNIIGENLRKTGDLKTIAELTEEEARKQELLVQNLRQLVEEKKKDMKEIEELCSVKSEELNQLMEEKEKNQQKHYRELNAIQERTMSHIQKIVDDHEKLKRLLESERKKLEIKCNELAKREVHNGTERMKLSEDLEQNASKNSSLELAAMEQQKADEEVKKLAEDQRRQKEELHEKIIRLERQRDQKQAIELEVEQLKGQLNVMKHMASDGDAEVVKEVDIIFKDLGEKEAQLADLDKFNQTLILRERRTNDELQEAHKELVNIMKEWNTNIGVKRMGELVTKPFVDAMQQKYCQQDVEDRAVEVLQLWEHYLKDSDWHPFKRVKLENEDREVEVIDDRDEKLRELKADLGDGPYNAVTKALLEINEYNPSGRYITTELWNFKADKKATLEEGVTCLLDQWEKAKRKRGMA

SEQ ID NO: 76 - protein, 179 aa, Arabidopsis thaliana
MEIQELKGKFQVIKHLGDDDDNILKMKLWLKLPSFALHRRRISRIHHGIHSNIKEPRTNQICVFPAVSSHFKSDLVNEEYEPLKKLKEKWGEDVHNTLKITIKDMDEYNACGKYPTPELWNFKKKLKSTLKEVIKFLLNDIKSLKRQRICRCVISFLVDIGLLIDLNQHKPHIVLVYKV

SEQ ID NO: 77 - protein, 554 aa, Arabidopsis thaliana
MKKKQQKQEFVAETSEMNNNNECSGQDQQKRYVWPWVGLVANVPTEVEPSGRRVGKSGSTLRDEFTLKGFNPTRVKPIWNTKGHTGFALVEFAKDFKGFESAMQFEKSFDLDRHGKRDWKKGHRLRDDKLYGWLAREDDYNRSDTVGKNVKKKRDLKSISQIVEEDQRKLYHLFENMCQTIEKNKQRKQQLEQKVDETLESLEFHNLMLNNSYQEEIQKMEKNMQEFYQQVLGGHEKSFAELEAKREKLDERARLIEQRAIKNEEEMEKTRLEREMIQKAMCEQNEANEEAMKLAEKHQKEKEKLHKRIMEMEAKLNETQELELEIEKLKGTTNVMKHMVGCDGDKDIVEKIAKTQIELDARETALHEKMMTLARKERATNDEYQDARKEMIKVWKANEELMKQEKIRVKIMGELNPAPFLPAVMNKHKAMMLCSVWAAEIGDVQWTPFRVDESDGTPKQKLHISQHSKCEMQRVVDENDEKLRMLKNQYGEEVYSEVVRAKLEMEEHNASGSYETEELWNYEENRKATIEEITDVMLKIRSKLAAMKNKRKRP

SEQ ID NO: 78 - protein, 736 aa, Arabidopsis thaliana
MYSRRELEDLEYRYYSEMKDGTRKVKISESLFRCPFCYIDRKRDYQFDDLLRHASGIGGSSRTKDGRDKARHLALERYMRKYLRPRERPRPSPTSDVSSLPKEEFTGKWKSTLSTTEEGEFITTENSSSPHIVKAEPKFVSGDDSGRSGEERLKFSDKPDPFFSNEDKSYPAKRPCLVSGAKEGDEPVQRIGLSHGASFAPTYPQKLVSLGAGNGDQMYVHPWKGILANMKRTFNEKTRKYAGESGSKIREDLIKKGFNPHKVTPLWNGRLGFTGFAIVDFGKEWEGFRNATMFDKHFEVSQCGKRDHDLTRDPGDKLYGWVAKQDDYYSRTAIGDHLRKQGDLKSVSGKEAEDQRKTFTLVSNLENTLVTKSDNLQQMESIYKQTSSVLEKRMKEKDEMINTHNEKMSIMQQTARDYLASIYEEHEKASQHLEAQRKEYEDRENYLDKCQAKNKTERRKLQWQKHKNLMATQEQNKADEDMMRLAEQQQREKDELRKQVRELEEKIDAEQALELEIERMRGDLQVMGHMQEGEGEDSKIKEMIEKTKEELKEKEEDWEYQESLYQTLVVKHGYTNDELQDARKALIRSMRELTTRAYIGVKRMGALDETPFKKVAKEKYPAVEADKKAEELCSLWEEHLGDSAWHPIKVVEKDGIAKEELNEEDEKLQELRKELGEEVYAAVTQALKERNEYNGSGRYIVPELWNFKQNRKASIKEGVVYLVNSWKQKKPKPKRR

SEQ ID NO: 79 - protein, 647 aa, Arabidopsis thaliana; identical to SEQ ID NO: 75

SEQ ID NO: 80 - protein, 638 aa, Arabidopsis thaliana
MNNKLSDFEKNLYKKLKSGKLEVKVSYRTFLCPYCPDNKKKVGLYVDILQHASGVGNSQSKKRSLTEKASHRALAKYLIKDLAHYATSTISKRLKARTSFIPAETGDAPIIYDDAQFEKLVWPWKGVLVNIPTTSTEDGRSCTGESGPKLKDELIRRGFNPIRVRTVWDRFGHSGTGIVEFNRDWNGLQDALVFKKAYEGDGHGKKDWLCGATDSSLYAWLANADDYYRANILGENLRKMGDLKSIYRFAEEEARKDQKLLQRLNFMVENKQYRLKKLQIKYSQDSVKLKYETEEKEKILRAYSEDLTGRQQKSTDHFNRIFADHEKQKVQLESQIKELEIRKLELAKREAENETQRKIVAKELEQNAAINSYVQLSALEQQKTREKAQRLAVDHKMQKEKLHKRIAALERQLDQKQELELEVQQLKSQLSVMRLVELDSGSEIVNKVETFLRDLSETEGELAHLNQFNQDLVVQERKSNDELQEARRALISNLRDMGLHIGVKRMGELDTKPFMKAMRIKYCQEDLEDWAVEVIQLWEEYLKDPDWHPFKRIKLETAETIVEVIDEDDEKLRTLKNELGDDAYQAVANALLEINEYNPSGRYISSELWNFREDRKATLEEGVNSLLEQWNQAKHLKS

SEQ ID NO: 81 - protein, 638 aa, Arabidopsis thaliana; identical to SEQ ID NO: 80

SEQ ID NO: 82 - protein, 561 aa, Arabidopsis thaliana
MEKNQQKQEFLAETSEMKNTKNNDDCSVQQQQRFVWPWVGLVANIPTEVEPSGRRVGKSGSTLRDEFTMKGFNPTRVQPIWDFKGHSGFALVEFAKDFEGFESAMNFERSFNLDRHGKRDWEKGHRLRDNKLYGWVAREDDYNRSDTVGKNVKKKRDLKSISQIVEEDERKMVHLVENMSQTIEKKKQSKQELEQKVDETSRFLESLELHNVLLNKNYQEGFQKMQMKMEELYQQVLDGHEKSLAELEAKREKLDERARLIEQRAIINEEEMEKSRLEREMNQKAMCEQNEANEEAMKLAEKHQASSSLKEKEKLHKRIMEMEAKLNETQELELEIEKLKGTTNVMKHMVGSDGDKDIVEKIAKTQIQLDAQETALHEKMMTLARKERATNDEYQDVLKEMIQVWNANEELMKQEKIRVKRMGQLNPAPFLPAVMKKHKVTQSKAENKAMKLCSVWEANIGDVQWTPFRVDESDGTPKRVVDENDEKLRTLKNQYGEEVYNEVVRTKLEIEEHNASGSYVILELWNYEENRKATMEEATDVMLKIRSKLAAMKNKRKRLEV

SEQ ID NO: 83 - protein, 1534 aa, Arabidopsis thaliana
MVENGAKAAKRKKRPLPEIQEVEDVPRTRRPRRAAACTSFKEKSIRVCEKSATIEVKKQQIVEEEFLALRLTALETDVEDRPTRRLNDFVLFDSDGVPQPLEMLEIHDIFVSGAILPSDVCTDKEKEKGVRCTSFGRVEHWSISGYEDGSPVIWISTELADYDCRKPAASYRKVYDYFYEKARASVAVYKKLSKSSGGDPDIGLEELLAAVVRSMSSGSKYFSSGAAIIDFVISQGDFIYNQLAGLDETAKKHESSYVEIPVLVALREKSSKIDKPLQRERNPSNGVRIKEVSQVAESEALTSDQLVDGTDDDRRYAILLQDEENRKSMQQPRKNSSSGSASNMFYIKINEDEIANDYPLPSYYKTSEEETDELILYDASYEVQSEHLPHRMLHNWALYNSDLRFISLELLPMKQCDDIDVNIFGSGVVTDDNGSWISLNDPDSGSQSHDPDGMCIFLSQIKEWMIEFGSDDIISISIRTDVAWYRLGKPSKLYAPWWKPVLKTARVGISILTFLRVESRVARLSFADVTKRLSGLQANDKAYISSDPLAVERYLVVHGQIILQLFAVYPDDNVKRCPFVVGLASKLEDRHHTKWIIKKKKISLKELNLNPRAGMAPVASKRKAMQATTTRLVNRIWGEFYSNYSPEDPLQATAAENGEDEVEEEGGNGEEEVEEEGENGLTEDTVPEPVEVQKPHTPKKIRGSSGKREIKWDGESLGKTSAGEPLYQQALVGGEMVAVGGAVTLEVDDPDEMPAIYFVEYMFESTDHCKMLHGRFLQRGSMTVLGNAANERELFLTNECMTTQLKDIKGVASFEIRSRPWGHQYRKKNITADKLDWARALERKVKDLPTEYYCKSLYSPERGGFFSLPLSDIGRSSGFCTSCKIREDEEKRSTIKLNVSKTGFFINGIEYSVEDFVYVNPDSIGGLKEGSKTSFKSGRNIGLRAYVVCQLLEIVPKESRKADLGSFDVKVRRFYRPEDVSAEKAYASDIQELYFSQDTVVLPPGALEGKCEVRKKSDMPLSREYPISDHIFFCDLFFDTSKGSLKQLPANMKPKFSTIKDDTLLRKKKGKGVESEIESEIVKPVEPPKEIRLATLDIFAGCGGLSHGLKKAGVSDAKWAIEYEEPAGQAFKQNHPESTVFVDNCNVILRAIMEKGGDQDDCVSTTEANELAAKLTEEQKSTLPLPGQVDFINGGPPCQGFSGMNRFNQSSWSKVQCEMILAFLSFADYFRPRYFLLENVRTFVSFNKGQTFQLTLASLLEMGYQVRFGILEAGAYGVSQSRKRAFIWAAAPEEVLPEWPEPMHVFGVPKLKISLSQGLHYAAVRSTALGAPFRPITVRDTIGDLPSVENGDSRTNKEYKEVAVSWFQKEIRGNTIALTDHICKAMNELNLIRCKLIPTRPGADWHDLPKRKVTLSDGRVEEMIPFCLPNTAERHNGWKGLYGRLDWQGNFPTSVTDPQPMGKVGMCFHPEQHRILTVRECARSQGFPDSYEFAGNINHKHRQIGNAVPPPLAFALGRKLKEALHLKKSPQHQP

SEQ ID NO: 84 - protein, 1453 aa, Arabidopsis thaliana
MEDDCEELQVPVGTLTSIGFSISNNNDRDKMSVLEVEAPNQVTDSRLGLPNPDSVCRTCGSKDRKVCEGHFGVINFAYSIINPYFLKEVAALLNKICPGCKYIRKKQFQITEDQPERCRYCTLNTGYPLMKFRVTTKEVFRRSGIVVEVNEESLMKLKKRGVLTLPPDYWSFLPQDSNIDESCLKPTRRIITHAQVYALLLGIDQRLIKKDIPMFNSLGLTSFPVTPNGYRVTEIVHQFNGARLIFDERTRIYKKLVGFEGNTLELSSRVMECMQYSRLFSETVSSSKDSANPYQKKSDTPKLCGLRFMKDVLLGKRSDHTFRTVVVGDPSLKLNEIGIPESIAKRLQVSEHLNQCNKERLVTSFVPTLLDNKEMHVRRGDRLVAIQVNDLQTGDKIFRSLMDGDTVLMNRPPSIHQHSLIAMTVRILPTTSVVSLNPICCLPFRGDFDGDCLHGYVPQSIQAKVELDELVALDKQLINRQNGRNLLSLGQDSLTAAYLVNVEKNCYLNRAQMQQLQMYCPFQLPPPAIIKASPSSTEPQWTGMQLFGMLFPPGFDYTYPLNNVVVSNGELLSFSEGSAWLRDGEGNFIERLLKHDKGKVLDIIYSAQEMLSQWLLMRGLSVSLADLYLSSDLQSRKNLTEEISYGLREAEQVCNKQQLMVESWRDFLAVNGEDKEEDSVSDLARFCYERQKSATLSELAVSAFKDAYRDVQALAYRYGDQSNSFLIMSKAGSKGNIGKLVQHSMCIGLQNSAVSLSFGFPRELTCAAWNDPNSPLRGAKGKDSTTTESYVPYGVIENSFLTGLNPLESFVHSVTSRDSSFSGNADLPGTLSRRLMFFMRDIYAAYDGTVRNSFGNQLVQFTYETDGPVEDITGEALGSLSACALSEAAYSALDQPISLLETSPLLNLKNVLECGSKKGQREQTMSLYLSEYLSKKKHGFEYGSLEIKNHLEKLSFSEIVSTSMIIFSPSSNTKVPLSPWVCHFHISEKVLKRKQLSAESVVSSLNEQYKSRNRELKLDIVDLDIQNTNHCSSDDQAMKDDNVCITVTVVEASKHSVLELDAIRLVLIPFLLDSPVKGDQGIKKVNILWTDRPKAPKRNGNHLAGELYLKVTMYGDRGKRNCWTALLETCLPIMDMIDWGRSHPDNIRQCCSVYGIDAGRSIFVANLESAVSDTGKEILREHLLLVADSLSVTGEFVALNAKGWSKQRQVESTPAPFTQACFSSPSQCFLKAAKEGVRDDLQGSIDALAWGKVPGFGTGDQFEIIISPKVHGFTTPVDVYDLLSSTKTMRRTNSAPKSDKATVQPFGLLHSAFLKDIKVLDGKGIPMSLLRTIFTWKNIELLSQSLKRILHSYEINELLNERDEGLVKMVLQLHPNSVEKIGPGVKGIRVAKSKHGDSCCFEVVRIDGTFEDFSYHKCVLGATKIIAPKKMNFYKSKYLKNGTLESGGFSENP

SEQ ID NO: 85 - protein, 1453 aa, Arabidopsis thaliana; identical to SEQ ID NO: 84

SEQ ID NO: 86 - protein, 1976 aa, Arabidopsis thaliana
MEEESTSEILDGEIVGITFALASHHEICIQSISESAINHPSQLTNAFLGLPLEFGKCESCGATEPDKCEGHFGYIQLPVPIYHPAHVNELKQMLSLLCLKCLKIKKAKGTSGGLADRLLGVCCEEASQISIKDRASDGASYLELKLPSRSRLQPGCWNFLERYGYRYGSDYTRPLLAREVKEILRRIPEESRKKLTAKGHIPQEGYILEYLPVPPNCLSVPEASDGFSTMSVDPSRIELKDVLKKVIAIKSSRSGETNFESHKAEASEMFRVVDTYLQVRGTAKAARNIDMRYGVSKISDSSSSKAWTEKMRTLFIRKGSGFSSRSVITGDAYRHVNEVGIPIEIAQRITFEERVSVHNRGYLQKLVDDKLCLSYTQGSTTYSLRDGSKGHTELKPGQVVHRRVMDGDVVFINRPPTTHKHSLQALRVYVHEDNTVKINPLMCSPLSADFDGDCVHLFYPQSLSAKAEVMELFSVEKQLLSSHTGQLILQMGSDSLLSLRVMLERVFLDKATAQQLAMYGSLSLPPPALRKSSKSGPAWTVFQILQLAFPERLSCKGDRFLVDGSDLLKFDFGVDAMGSIINEIVTSIFLEKGPKETLGFFDSLQPLLMESLFAEGFSLSLEDLSMSRADMDVIHNLIIREISPMVSRLRLSYRDELQLENSIHKVKEVAANFMLKSYSIRNLIDIKSNSAITKLVQQTGFLGLQLSDKKKFYTKTLVEDMAIFCKRKYGRISSSGDFGIVKGCFFHGLDPYEEMAHSIAAREVIVRSSRGLAEPGTLFKNLMAVLRDIVITNDGTVRNTCSNSVIQFKYGVDSERGHQGLFEAGEPVGVLAATAMSNPAYKAVLDSSPNSNSSWELMKEVLLCKVNFQNTTNDRRVILYLNECHCGKRFCQENAACTVRNKLNKVSLKDTAVEFLVEYRKQPTISEIFGIDSCLHGHIHLNKTLLQDWNISMQDIHQKCEDVINSLGQKKKKKATDDFKRTSLSVSECCSFRDPCGSKGSDMPCLTFSYNATDPDLERTLDVLCNTVYPVLLEIVIKGDSRICSANIIWNSSDMTTWIRNRHASRRGEWVLDVTVEKSAVKQSGDAWRVVIDSCLSVLHLIDTKRSIPYSVKQVQELLGLSCAFEQAVQRLSASVRMVSKGVLKEHIILLANNMTCSGTMLGFNSGGYKALTRSLNIKAPFTEATLIAPRKCFEKAAEKCHTDSLSTVVGSCSWGKRVDVGTGSQFELLWNQKETGLDDKEETDVYSFLQMVISTTNADAFVSSPGFDVTEEEMAEWAESPERDSALGEPKFEDSADFQNLHDEGKPSGANWEKSSSWDNGCSGGSEWGVSKSTGGEANPESNWEKTTNVEKEDAWSSWNTRKDAQESSKSDSGGAWGIKTKDADADTTPNWETSPAPKDSIVPENNEPTSDVWGHKSVSDKSWDKKNWGTESAPAAWGSTDAAVWGSSDKKNSETESDAAAWGSRDKNNSDVGSGAGVLGPWNKKSSETESNGATWGSSDKTKSGAAAWNSWDKKNIETDSEPAAWGSQGKKNSETESGPAAWGAWDKKKSETEPGPAGWGMGDKKNSETELGPAAMGNWDKKKSDTKSGPAAWGSTDAAAWGSSDKNNSETESDAAAWGSRNKKTSEIESGAGAWGSWGQPSPTAEDKDTNEDDRNPWVSLKETKSREKDDKERSQWGNPAKKFPSSGGWSNGGGADWKGNRNHTPRPPRSEDNLAPMFTATRQRLDSFTSEEQELLSDVEPVMRTLRKIMHPSAYPDGDPISDDDKTFVLEKILNFHPQKETKLGSGVDFITVDKHTIFSDSRCFFVVSTDGAKQDFSYRKSLNNYLMKKYPDRAEEFIDKYFTKPRPSGNRDRNNQDATPPGEEQSQPPNQSIGNGGDDFQTQTQSQSPSQTRAQSPSQAQAQSPSQTQSQSQSQSQSQSQSQSQSQSQSQSQSQSQSQSQSPSQTQTQSPSQTQAQAQSPSSQSPSQTQT

SEQ ID NO: 87 - protein, 1172 aa, Arabidopsis thaliana
MPDMDIDVKDLEEFEATTGEINLSELGEGFLQSFCKKAATSFFDKYGLISHQLNSYNYFIEHGLQNVFQSFGEMLVEPSFDVVKKKDNDWRYATVKFGEVTVEKPTFFSDDKELEFLPWHARLQNMTYSARIKVNVQVEVFKNTVVKSDKFKTGQDNYVEKKILDVKKQDILIGSIPVMVKSILCKTSEKGKENCKKGDCAFDQGGYFVIKGAEKVFIAQEQMCTKRLWISNSPWTVSFRSENKRNRFIVRLSENEKAEDYKRREKVLTVYFLSTEIPVWLLFFALGVSSDKEAMDLIAFDGDDASITNSLIASIHVADAVCEAFRCGNNALTYVEQQIKSTKFPPAESVDECLHLYLFPGLQSLKKKARFLGYMVKCLLNSYAGKRKCENRDSFRNKRIELAGELLEREIRVHLAHARRKMTRAMQKHLSGDGDLKPIEHYLDASVITNGLSRAFSTGAWSHPFRKMERVSGVVANLGRANPLQTLIDLRRTRQQVLYTGKVGDARYPHPSHWGRVCFLSTPDGENCGLVKNMSLLGLVSTQSLESVVEKLFACGMEELMDDTCTPLFGKHKVLLNGDWVGLCADSESFVAELKSRRRQSELPREMEIKRDKDDNEVRIFTDAGRLLRPLLVVENLQKLKQEKPSQYPFDHLLDHGILELIGIEEEEDCNTAWGIKQLLKEPKIYTHCELDLSFLLGVSCAVVPFANHDHGRRVLYQSQKHCQQAIGFSSTNPNIRCDTLSQQLFYPQKPLFKTLASECLKKEVLFNGQNAIVAVNVHLGYNQEDSIVMNKASLERGMFRSEQIRSYKAEVDAKDSEKRKKMDELVQFGKTHSKIGKVDSLEDDGFPFIGANMSTGDIVIGRCTESGADHSIKLKHTERGIVQKVVLSSNDEGKNFAAVSLRQVRSPCLGDKFSSMHGQKGVLGYLEEQQNFPFTIQGIVPDIVINPHAFPSRQTPGQLLEAALSKGIACPIQKEGSSAAYTKLTRHATPFSTPGVTEITEQLHRAGFSRWGNERVYNGRSGEMMRSMIFMGPTFYQRLVHMSEDKVKFRNTGPVHPLTRQPVADRKRFGGIKFGEMERDCLIAHGASANLHERLFTLSDSSQMHICRKCKTYANVIERTPSSGRKIRGPYCRVCVSSDHVVRVYVPYGAKLLCQELFSMGITLNFDTKLC

SEQ ID NO: 88 - protein, 1172 aa, Arabidopsis thaliana; identical to SEQ ID NO: 87

SEQ ID NO: 89 - protein, 1055 aa, Arabidopsis thaliana
MACRLQNMTYSARIKVNAQVEVFKKIVIKHDKFKTGQDEYVEKEILDVKKQDILIGSIPVMVKSVLCKTSEKGKENCKKGNCAFDQGGYFVIKGAEKVFIAQEQMCTKRLWISNSPWTVSFRSETKRNRFIVRLSENEKAEDYKIMEKVLTVYFLSTEIPVWLLFFALGVSSDKEAMDLIAFDGDDASITNSLIASIHEADAVCEAFRCGNNALTYVEHQIKSTKFPPAESVDDCLRLYLFPCLQGLKKKARFLGYMVKCLLSAYAGKRKCENRDSFRNKRIELAGELLEREIRVHLAHARRKMTRAMQKQLSGDGDLKPIEHYLDASVITNGLNRAFSTGAWSHPFRKMERVSGVVANLGRANPLQTLIDLRRTRQQVLYTGKVGDARHPHPSHWGRVCFLSTPDGENCGLVKNMSLLGLVSTQGLESVVEMLFTCGMEELMNDTSTPLCGKHKVLLNGDWVGLCADSESFVGELKSRRRQSELPLEMEIKRDKDDNEVRIFTDAGRLLRPLLVVENLHKLKQDKPTQYPFKHLLDQGILELIGIEEEEDCTTAWGIKQLLKEPKNYTHCELDLSFLLGVSCAIVPFANHDHGKRVLYQSQKHCQQAIGFSSTNPNIRCDTLSQQLFYPQKPLFKTLASECLEKEVLFNGQNAIVAVNVHLGYNQEDSIVMNKASLERGMFRSEQIRSYKAEVDTKDSEKRKKMDELVQFGKTYSKIGKVDSLEDDGFPFIGANMSTGDIVIGRCTESGADHSIKLKHTERGIVQKVVLSSNDEGKNFAAVSLRQVRSPCLGDKFSSMHGQKGVLGYLEEQQNFPFTIQGIVPDIVINPHAFPSRQTPGQLLEAALSKGIACPIQKKEGSSAAYTKLTRHATPFSTPGVTEITEQLHRAGFSRWGNERVYNGRSGEMMRSLIFMGPTFYQRLVHMSENKVKFRNTGPVHPLTRQPVADRKRFGGIRFGEMERDCLIAHGASANLHERLFTLSDSSQMHICRKCKTYANVIERTPSSGRKIRGPYCRVCASSDHVVRVYVPYGAKLLCQELFSMGITLNFDTKLC

SEQ ID NO: 90 - protein, 1133 aa, Arabidopsis thaliana
MVSETTTNRSTVKISNVPQTIVADELLRFLELHLGEDTVFALEIPTTRDNWKPRDFARVQFTTLEVKSRAQLLSSQSKLLFKTHNLRLSEAYDDIIPRPVDPRKRLDDIVLTVGFPESDEKRFCALEKWDGVRCWILTEKRRVEFWVWESGDCYKIEVRFEDIIETLSCCVNGDASEIDAFLLKLKYGPKVFKRVTVHIATKFKSDRYRFCKEDFDFMWIRTTDFSGSKSIGTSTCFCLEVHNGSTMLDIFSGLPYYREDTLSLTYVDGKTFASAAQIVPLLNAAILGLEFPYEILFQLNALVHAQKISLFAASDMELIKILRGMSLETALVILKKLHQQSSICYDPVFFVKTQMQSVVKKMKHSPASAYKRLTEQNIMSCQRAYVTPSKIYLLGPELETANYVVKNFAEHVSDFMRVTFVEEDWSKLPANALSVNSKEGYFVKPSRTNIYNRVLSILGEGITVGPKRFEFLAFSASQLRGNSVWMFASNEKVKAEDIREWMGCFRKIRSISKCAARMGQLFSASRQTLIVRAQDVEQIPDIEVTTDGADYCFSDGIGKISLAFAKQVAQKCGLSHVPSAFQIRYGGYKGVIAVDRSSFRKLSLRDSMLKFDSNNRMLNVTRWTESMPCFLNREIICLLSTLGIEDAMFEAMQAVHLSMLGNMLEDRDAALNVLQKLSGENSKNLLVKMLLQGYAPSSEPYLSMMLRVHHESQLSELKSRCRILVPKGRILIGCMDEMGILEYGQVYVRVTLTKAELKSRDQSYFRKIDEETSVVIGKVVVTKNPCLHPGDIRVLDAIYEVHFEEKGYLDCIIFPQKGERPHPNECSGGDLDGDQFFVSWDEKIIPSEMDPPMDYAGSRPRLMDHDVTLEEIHKFFVDYMISDTLGVISTAHLVHADRDPEKARSQKCLELANLHSRAVDFAKTGAPAEMPYALKPREFPDFLERFEKPTYISESVFGKLYRAVKSSLAQRKPEAESEDTVAYDVTLEEAGFESFIETAKAHRDMYGEKLTSLMIYYGAANEEEILTGILKTKEMYLARDNRRYGDMKDRITLSVKDLHKEAMGWFEKSCEDEQQKKKLASAWYYVTYNPNHRDEKLTFLSFPWIVGDVLLDIKAENAQRQSVEEKTSGLVSI

SEQ ID NO: 91 - protein, 1196 aa, Arabidopsis thaliana
MGSEGNMKKSVVTQVSIGGFGESTTAKQLTDYLEDEVGIVWRCRLKTSWTPPGSYPNFEIADTSNIPSIDEYKKVEPHAFVHFAVFESAGRAMDAAGQCNLILDGQPLKVSLGPKNPYSLNQRRRTTVPYKLAGITLEIGTLVSRDDFFVSWRAEGVDFLVDPFDNTCKFCFRKSTAFSFKDAVMHAVINCDYKLELLVRDIQTVRQYKTLHGFVLILQLASSPRVWYRTADDDIYDTVPGDLLDDDDPWIRTTDFTQVGAIGRCHSYRVLISPRYENKLRTALDYFRMRRVQEERVRWPPRIRNEPCFGEPVSDHFFCIHHKEGISFEIMFLVNSVLHRGVFNQFQLTERFFDLLRNQPKDVNIASLKHLCTYKRPVFDAYKRLKLVQEWIQKNPKLLGSHEQSEDISEIRRLVITPTRAYCLPPEVELSNRVLRRYKAVAERFLRVTFMDESMQTINSNVLSYFVAPIVKDLTSSSFSQKTYVFKRVKSILTDGFKLCGRKYSFLAFSANQLRDRSAWFFAEDGKTRVSDIKTWMGKFKDKNVAKCAARMGLCFSSTYATVDVMPHEVDTEVPDIERNGYVFSDGIGTITPDLADEVMEKLKLDVHYSPCAYQIRYAGFKGVVARWPSKSDGIRLALRDSMKKFFSKHTILEICSWTRFQPGFLNRQIITLLSVLGVPDEIFWDMQESMLYKLNRILDDTDVAFEVLTASCAEQGNTAAIMLSAGFKPKTEPHLRGMLSSVRIAQLWGLREKSRIFVTSGRWLMGCLDEAGILEHGQCFIQVSKPSIENCFSKHGSRFKETKTDLEVVKGYVAIAKNPCLHPGDVRILEAVDVPQLHHMYDCLIFPQKGDRPHTNEASGSDLDGDLYFVAWDQKLIPPNRKSYPAMHYDAAEEKSLGRAVNHQDIIDFFARNLANEQLGTICNAHVVHADRSEYGAMDEECLLLAELAATAVDFPKTGKIVSMPFHLKPKLYPDFMGKEDYQTYKSNKILGRLYRRVKEVYDEDAEASSEESTDPSAIPYDAVLEIPGFEDLIPEAWGHKCLYDGQLIGLLGQYKVQKEEEIVTGHIWSMPKYTSKKQGELKERLKHSYNSLKKEFRKVFEETIPDHENLSEEEKNILYEKKASAWYHVTYHPEWVKKSLELQDPDESSHAAMLSFAWIAADYLARIKIRSREMGSIDSAKPVDSLAKFLAQRL

SEQ ID NO: 92 - protein, 625 aa, Arabidopsis thaliana
MSSRAGPMSKEKNVQGGYRPEVEQLVQGLAGTRLASSQDDGGEWEVISKKNKNKPGNTSGKTWVSQNSNPPRAWGGQQQGRGSNVSGRGNNVSGRGNGNGRGIQANISGRGRALSRKYDNNFVAPPPVSRPPLEGGWNWQARGGSAQHTAVQEFPDVEDDVDNASEEENDSDALDDSDDDLASDDYDSDVSQKSHGSRKQNKWFKKFFGSLDSLSIEQINEPQRQWHCPACQNGPGAIDWYNLHPLLAHARTKGARRVKLHRELAEVLEKDLQMRGASVIPCGEIYGQWKGLGEDEKDYEIVWPPMVIIMNTRLDKDDNDKWLGMGNQELLEYFDKYEALRARHSYGPQGHRGMSVLMFESSATGYLEAERLHRELAEMGLDRIAWGQKRSMFSGGVRQLYGFLATKQDLDIFNQHSQGKTRLKFELKSYQEMVVKELRQISEDNQQLNYFKNKLSKQNKHAKVLEESLEIMSEKLRRTAEDNRIVRQRTKMQHEQNREEMDAHDRFFMDSIKQIHERRDAKEENFEMLQQQERAKVVGQQQQNINPSSNDDCRKRAEEVSSFIEFQEKEMEEFVEEREMLIKDQEKKMEDMKKRHHEEIFDLEKEFDEALEQLMYKHGLHNEDD

SEQ ID NO: 93 - protein, 651 aa, Arabidopsis thaliana
MSTLLPFPDLNLMPDSQSSTAGTTAGDTVVTGKLEVKSEPIEEWQTPPSSTSDQSANTDLIAEFIRISELFRSAFKPLQVKGLDGVSVYGLDSGAIVAVPEKENRELIEPPPGFKDNRVSTVVVSPKFERPRELARIAILGHEQRKELRQVMKRTRMTYESLRIHLMAESMKNHVLGQGRRRRSDMAAAYIMRDRGLWLNYDKHIVGPVTGVEVGDIFFYRMELCVLGLHGQTQAGIDCLTAERSATGEPIATSIVVSGGYEDDEDTGDVLVYTGHGGQDHQHKQCDNQRLVGGNLGMERSMHYGIEVRVIRGIKYENSISSKVYVYDGLYKIVDWWFAVGKSGFGVFKFRLVRIEGQPMMGSAVMRFAQTLRNKPSMVRPTGYVSFDLSNKKENVPVFLYNDVDGDQEPRHYEYIAKAVFPPGIFGQGGISRTGCECKLSCTDDCLCARKNGGEFAYDDNGHLLKGKHVVFECGEFCTCGPSCKSRVTQKGLRNRLEVFRSKETGWGVRTLDLIEAGAFICEYAGVVVTRLQAEILSMNGDVMVYPGRFTDQWRNWGDLSQVYPDFVRPNYPSLPPLDFSMDVSRMRNVACYISHSKEPNVMVQFVLHDHNHLMFPRVMLFALENISPLAELSLDYGLADEVNGKLAICN

SEQ ID NO: 94 - protein, 650 aa, Arabidopsis thaliana
MGSSHIPLDPSLNPSPSLIPKLEPVTESTQNLAFQLPNTNPQALISSAVSDFNEATDFSSDYNTVAESARSAFAQRLQRHDDVAVLDSLTGAIVPVEENPEPEPNPYSTSDSSPSVATQRPRPQPRSSELVRITDVGPESERQFREHVRKTRMIYDSLRMFLMMEEAKRNGVGGRRARADGKAGKAGSMMRDCMLWMNRDKRIVGSIPGVQVGDIFFFRFELCVMGLHGHPQSGIDFLTGSLSSNGEPIATSVIVSGGYEDDDDQGDVIMYTGQGGQDRLGRQAEHQRLEGGNLAMERSMYYGIEVRVIRGLKYENEVSSRVYVYDGLFRIVDSWFDVGKSGFGVFKYRLERIEGQAEMGSSVLKFARTLKTNPLSVRPRGYINFDISNGKENVPVYLFNDIDSDQEPLYYEYLAQTSFPPGLFVQQSGNASGCDCVNGCGSGCLCEAKNSGEIAYDYNGTLIRQKPLIHECGSACQCPPSCRNRVTQKGLRNRLEVFRSLETGWGVRSLDVLHAGAFICEYAGVALTREQANILTMNGDTLVYPARFSSARWEDWGDLSQVLADFERPSYPDIPPVDFAMDVSKMRNVACYISHSTDPNVIVQFVLHDHNSLMFPRVMLFAAENIPPMTELSLDYGVVDDWNAKLAICN

SEQ ID NO: 95 - protein, 650 aa, Arabidopsis thaliana; identical to SEQ ID NO: 94

SEQ ID NO: 96 - protein, 1107 aa, Arabidopsis thaliana
MGKTIQVFGFPNGVSAEEVKKFLERLTGSGTVYAIKVRQPKKGGPRVYAIVQFTSERHTRLIITAAAERLYYGRSYLKAFEVEQDIVPKPRASLHTISGLKMFFGCQVSTKKFLTLWSAQDVCVSFGIGMRKLHFSFSWYQKDYRLELSYENIWQIDLHSPQGRSSKFLVIQVIGAPKIFEKEDQPINLLFGIMDFYSDGSDEQWIRTTDFTSSSCIGQSTAFCLELPVHLNVPDFRENFANYAEHRASSFLIESGSSYSSNANTLVPVVDPPPGFSLPFEILFKLNTLVQNACLSGPALDLDFYRLLNQKKYDRALIDHCLEKLFHLGECCYEPAHWLRDEYKKWISKGKLPLSPTISLDDGLVYMYRVQVTPARVYFSGPEVNVSNRVLRHYSKYINNFLRVSFVDEDLEKVRSMDLSPRSSTQRRTKLYDRIYSVLRDGIVIGDKKFEFLAFSSSQLRENSAWMFAPIDRITAAHIRAWMGDFDHIRNVAKYAARLGQSFSSSRETLNVRSDEIEVIPDVEIISLGTRYVFSDGIGKISAEFARKVARKCGLTEFSPSAFQIRYGGYKGVVAVDPNSSKKLSLRKSMSKFESENTKLDVLAWSKYQPCYMNRQLITLLSTLGVTDSVFEKKQREVVDRLDAILTHPLEAHEALGLMAPGENTNILKALILCGYKPDAEPFLSMMLQNFRASKLLELRTKTRIFISGGRSMMGCLDETRTLEYGQVVVQYSDPMRPGRRFIITGPVVVAKNPCLHPGDVRVLQAVNVPALNHMVDCVVFPQKGLRPHPNECSGSDLDGDIYFVCWDQELVPPRTSEPMDYTPEPTQILDHDVTIEEVEEYFANYIVNDSLGIIANAHTAFADKEPLKAFSDPCIELAKKFSTAVDFPKTGVAAVIPQHLYVKEYPDFMEKPDKPTYESKNVIGKLFREVKERAPPLISIKSFTLDVASKSYDKDMEVDGFEEYVDEAFYQKANYDFKLGNLMDYYGIKTEAEILSGGIMRMSKSFTKRRDAESIGRAVRALRKETLSLFNASEEEENESAKASAWYHVTYHSSYWGLYNEGLNRDHFLSFAWCVYDKLVRIKKTNLGRRQRQETLERLDHVLRFG

SEQ ID NO: 97 - protein, 1702 aa, Arabidopsis thaliana
MRDEVDLSLTIPSKLLGKRDREQKNCEEEKNKNKKAKKQQKDPILLHTSAATHKFLPPPLTMPYSEIGDDLRSLDFDHADVSSDLHLTSSSSVSSFSSSSSSLFSAAGTDDPSPKMEKDPRKIARRYQVELCKKATEENVIVYLGTGCGKTHIAVMLIYELGHLVLSPKKSVCIFLAPTVALVEQQAKVIADSVNFKVAIHCGGKRIVKSHSEWEREIAANEVLVMTPQILLHNLQHCFIKMECISLLIFDECHHAQQQSNHPYAEIMKVFYKSESLQRPRIFGMTASPVVGKGSFQSENLSKSINSLENLLNAKVYSVESNVQLDGFVSSPLVKVYYYRSALSDASQSTIRYENMLEDIKQRCLASLKLLIDTHQTQTLLSMKRLLKRSHDNLIYTLLNLGLWGAIQAAKIQLNSDHNVQDEPVGKNPKSKICDTYLSMAAEALSSGVAKDENASDLLSLAALKEPLFSRKLVQLIKILSVFRLEPHMKCIIFVNRIVTARTLSCILNNLELLRSWKSDFLVGLSSGLKSMSRRSMETILKRFQSKELNLLVATKVGEEGLDIQTCCLVIRYDLPETVTSFIQSRGRARMPQSEYAFLVDSGNEKEMDLIENFKVNEDRMNLEITYRSSEETCPRLDEELYKVHETGACISGGSSISLLYKYCSRLPHDEFFQPKPEFQFKPVDEFGGTICRITLPANAPISEIESSLLPSTEAAKKDACLKAVHELHNLGVLNDFLLPDSKDEIEDELSDDEFDFDNIKGEGCSRGDLYEMRVPVLFKQKWDPSTSCVNLHSYYIMFVPHPADRIYKKFGFFMKSPLPVEAETMDIDLHLAHQRSVSVKIFPSGVTEFDNDEIRLAELFQEIALKVLFERGELIPDFVPLELQDSSRTSKSTFYLLLPLCLHDGESVISVDWVTIRNCLSSPIFKTPSVLVEDIFPPSGSHLKLANGCWNIDDVKNSLVFTTYSKQFYFVADICHGRNGFSPVKESSTKSHVESIYKLYGVELKHPAQPLLRVKPLCHVRNLLHNRMQTNLEPQELDEYFIEIPPELSHLKIKGLSKDIGSSLSLLPSIMHRMENLLVAIELKHVLSASIPEIAEVSGHRVLEALTTEKCHERLSLERLEVLGDAFLKFAVSRHLFLHHDSLDEGELTRRRSNVVNNSNLCRLAIKKNLQVYIRDQALDPTQFFAFGHPCRVTCDEVASKEVHSLNRDLGILESNTGEIRCSKGHHWLYKKTIADVVEALVGAFLVDSGFKGAVKFLKWIGVNVDFESLQVQDACIASRRYLPLTTRNNLETLENQLDYKFLHKGLLVQAFIHPSYNRHGGGCYQRLEFLGDAVLDYLMTSYFFTVFPKLKPGQLTDLRSLSVNNEALANVAVSFSLKRFLFCESIYLHEVIEDYTNFLASSPLASGQSEGPRCPKVLGDLVESCLGALFLDCGFNLNHVWTMMLSFLDPVKNLSNLQISPIKELIELCQSYKWDREISATKKDGAFTVELKVTKNGCCLTVSATGRNKREGTKKAAQLMITNLKAHENITTSHPLEDVLKNGIRNEAKLIGYNEDPIDVVDLVGLDVENLNILETFGGNSERSSSYVIRRGLPQAPSKTEDRLPQKAIIKAGGPSSKTAKSLLHETCVANCWKPPHFECCEEEGPGHLKSFVYKVILEVEDAPNMTLECYGEARATKKGAAEHAAQAAIWCLKHSGFLC

SEQ ID NO: 98 - protein, 1688 aa, Arabidopsis thaliana
MRDEVDLSLTIPSKLLGKRDREQKNCEEEKNKNKKAKKQQKDPILLHTSAATHKFLPPPLTMPYSEIGDDLRSLDFDHADVSSDLHLTSSSSVSSFSSSSSSLFSAAGTDDPSPKMEKDPRKIARRYQVELCKKATEENVIVYLGTGCGKTHIAVMLIYELGHLVLSPKKSVCIFLAPTVALVEQQAKVIADSVNFKVAIHCGGKRIVKSHSEWEREIAANEHCFIKMECISLLIFDECHHAQQQSNHPYAEIMKVFYKSESLQRPRIFGMTASPVVGKGSFQSENLSKSINSLENLLNAKVYSVESNVQLDGFVSSPLVKVYYYRSALSDASQSTIRYENMLEDIKQRCLASLKLLIDTHQTQTLLSMKRLLKRSHDNLIYTLLNLGLWGAIQAAKIQLNSDHNVQDEPVGKNPKSKICDTYLSMAAEALSSGVAKDENASDLLSLAALKEPLFSRKLVQLIKILSVFRLEPHMKCIIFVNRIVTARTLSCILNNLELLRSWKSDFLVGLSSGLKSMSRRSMETILKRFQSKELNLLVATKVGEEGLDIQTCCLVIRYDLPETVTSFIQSRGRARMPQSEYAFLVDSGNEKEMDLIENFKVNEDRMNLEITYRSSEETCPRLDEELYKVHETGACISGGSSISLLYKYCSRLPHDEFFQPKPEFQFKPVDEFGGTICRITLPANAPISEIESSLLPSTEAAKKDACLKAVHELHNLGVLNDFLLPDSKDEIEDELSDDEFDFDNIKGEGCSRGDLYEMRVPVLFKQKWDPSTSCVNLHSYYIMFVPHPADRIYKKFGFFMKSPLPVEAETMDIDLHLAHQRSVSVKIFPSGVTEFDNDEIRLAELFQEIALKVLFERGELIPDFVPLELQDSSRTSKSTFYLLLPLCLHDGESVISVDWVTIRNCLSSPIFKTPSVLVEDIFPPSGSHLKLANGCWNIDDVKNSLVFTTYSKQFYFVADICHGRNGFSPVKESSTKSHVESIYKLYGVELKHPAQPLLRVKPLCHVRNLLHNRMQTNLEPQELDEYFIEIPPELSHLKIKGLSKDIGSSLSLLPSIMHRMENLLVAIELKHVLSASIPEIAEVSGHRVLEALTTEKCHERLSLERLEVLGDAFLKFAVSRHLFLHHDSLDEGELTRRRSNVVNNSNLCRLAIKKNLQVYIRDQALDPTQFFAFGHPCRVTCDEVASKEVHSLNRDLGILESNTGEIRCSKGHHWLYKKTIADVVEALVGAFLVDSGFKGAVKFLKWIGVNVDFESLQVQDACIASRRYLPLTTRNNLETLENQLDYKFLHKGLLVQAFIHPSYNRHGGGCYQRLEFLGDAVLDYLMTSYFFTVFPKLKPGQLTDLRSLSVNNEALANVAVSFSLKRFLFCESIYLHEVIEDYTNFLASSPLASGQSEGPRCPKVLGDLVESCLGALFLDCGFNLNHVWTMMLSFLDPVKNLSNLQISPIKELIELCQSYKWDREISATKKDGAFTVELKVTKNGCCLTVSATGRNKREGTKKAAQLMITNLKAHENITTSHPLEDVLKNGIRNEAKLIGYNEDPIDVVDLVGLDVENLNILETFGGNSERSSSYVIRRGLPQAPSKTEDRLPQKAIIKAGGPSSKTAKSLLHETCVANCWKPPHFECCEEEGPGHLKSFVYKVILEVEDAPNMTLECYGEARATKKGAAEHAAQAAIWCLKHSGFLC

SEQ ID NO: 99 - protein, 997 aa, Arabidopsis thaliana
MSNRGGGGHGGASRGRGGGRRSDQRQDQSSGQVAWPGLQQSYGGRGGSVSAGRGRGNVGRGENTGDLTATQVPVASAVSGGRGRGNIGDPTFSVASSSKTVSVASSSKEESKNTEVSETMSNLQITSTETKPEMTSLPPASSKAVTFPVRPGRGTLGKKVMVRANHFLVQVADRDLYHYDVSINPEVISKTVNRNVMKLLVKNYKDSHLGGKSPAYDGRKSLYTAGPLPFDSKEFVVNLAEKRADGSSGKDRPFKVAVKNVTSTDLYQLQQFLDRKQREAPYDTIQVLDVVLRDKPSNDYVSVGRSFFHTSLGKDARDGRGELGDGIEYWRGYFQSLRLTQMGLSLNIDVSARSFYEPIVVTDFISKFLNIRDLNRPLRDSDRLKVKKVLRTLKVKLLHWNGTKSAKISGISSLPIRELRFTLEDKSEKTVVQYFAEKYNYRVKYQALPAIQTGSDTRPVYLPMELCQIDEGQRYTKRLNEKQVTALLKATCQRPPDRENSIKNLVVKNNYNDDLSKEFGMSVTTQLASIEARVLPPPMLKYHDSGKEKMVNPRLGQWNMIDKKMVNGAKVTSWTCVSFSTRIDRGLPQEFCKQLIGMCVSKGMEFKPQPAIPFISCPPEHIEEALLDIHKRAPGLQLLIVILPDVTGSYGKIKRICETELGIVSQCCQPRQVNKLNKQYMENVALKINVKTGGRNTVLNDAIRRNIPLITDRPTIIMGADVTHPQPGEDSSPSIAAVVASMDWPEINKYRGLVSAQAHREEIIQDLYKLVQDPQRGLVHSGLIREHFIAFRRATGQIPQRIIFYRDGVSEGQFSQVLLHEMTAIRKACNSLQENYVPRVTFVIVQKRHHTRLFPEQHGNRDMTDKSGNIQPGTVVDTKICHPNEFDFYLNSHAGIQGTSRPAHYHVLLDENGFTADQLQMLTNNLCYTYARCTKSVSIVPPAYYAHLAAFRARYYMESEMSDGGSSRSRSSTTGVGQVISQLPAIKDNVKEVMFYC

SEQ ID NO: 100 - DNA, 3358 bp, Glycine max
ctccacgtcaccacaccacaccacatcatcaaacgtccgagagcggctaacagcacaaactgcatagagcgtcaccgcagagtgcgtcattattattattttctcttcgtactcccccagaggaatgagaggatgtgaacaggtgctcgctgatgccactattaaaagagtgaagggagcgagtaacagaatcacgcttcaaatcatctgcattcatttttcttctctctacttcttctgcgtcatcttagggttttggtttgtgctcctctcactgattttctggagatggcttctttcgggccaaatggaactgaaaatgaggattcgttgcctcccccacctcccgttgtaccatcagatgttgtacctgttaaagctgagccggagaagaaaaaggcttcaaggtttccaatagccaggcgtggccttgcttcaaaagggacgaagctgcaacttctcaccaatcactacagagtgaacgttgcaaacactgatgggcatttttatcagtatagtgttgctcttttttatgatgatggacgacctgtggagggtaagggtgtagggaggaagcttctggacagggtgcatgaaacgtatgattctgaattgaatgggaaagattttgcatatgatggtgagaagactctgtttactctcgggtctcttgctcgcaacaagcttgagtttacggttgttctggaggatgttattgctaccagaaacaatggaaactgcagcccagagggcaatggagaactgaatgagagtgacaaaaagaggatgaggcgccctaatagatccaaggcatttaaagtggaacttagctatgcttcaaagattccattgcaggccattgccaatgctctacgtggacaggaatctgagaattatcaagaagcaataagagtgcttgatatcattttgaggcaacatgctgctaagcaagggtgtttgcttgtgcggcaatcgttctttcacaacaatcccaagaattttgctgatgtaggaggaggtgtacttggttgcaggggcttccactctagttttagaactactcaaagtggactgtctttgaacatagatgtctcaaccaccatgataattacccctgggcctgtggttgacttcctaatatccaatcaaaatgtgagagaccccttttcacttgattgggcaaaggccaagaggacattaaaaaacctgaggattaaatcgagcccatctaatcaagaattcaaaatcactgggcttagtgaactcccttgcaaagatcaaatgtttacattgaagaaaaaaggtggtgatgatgacactgaggaagaagtgacagtatatgattattttgttaatatccgcaagatagatcttcggtattctggggatctcccatgtatcaacgttgggaaaccaaaaaggccaacttacattcctcttgagctgtgttctttggtatcacttcaacgttatacaaaagcactatccacacttcaaaggtcttcattggtggagaagtccaggcagaagccacaagagaggatgagggtcttgtctgatgcacttaaaagtagcaattatggttctgaaccaatgctacgcaattgtggaatctctataagccccaactttactgaagttgagggtcgggttttacaagctccacggttgaaatttggtaatggggaggacttcaatcctagaaatgggaggtggaacttcaataacaagaaaattgtcaagccaactaaaatagaaagatgggctgtggttaacttctctgcacgctgtgatatacgagggcttgtgagggatctcattaagtgtggtggaatgaaaggcattgtgatagatcagccgtttgatgtgtttgaagaaaatggtcagtttaggcgtgcaccgccagtggttcgagttgagaagatgtttgagttggtccagtcaaaacttcctggggctcctcagtttcttctttgtctgcttcctgagaggaaaaattctgatctttatggtccatggaagaagaagaatcttgctgagtttggaattgtgactcagtgtatagctccgacaagggtcaatgaccaatatttgactaatgttctgttgaaaatcaatgctaagcttggtggtctgaactcaatgttaggcgttgagcattctccttctattcctattgtttctagagcgccaaccatcattattggcatggatgtgtctcatggttcgccagggcaaacagatattccttcaattgctgcggtggtcagctctagagaatggcctctaatatcaaagtatagggccagtgtccgtacgcagtctccaaagatggaaatgattgataatttgttcaagaaagtttccgacaaggaggatgaaggcataatgagggagcttctacttgatttctatacaagttctggaaatagaaagcccgataatataatcatattcagggatggtgttagtgagtcccagttcaatcaagttttgaacattgaacttgatcaaattatcgaggcttgcaagtttttagatgaaaagtggaatcccaagtttttggtgattgttgctcaaaagaaccatcatactaaattctttcaacctggagctcctgacaatgttcctcctggaacggtaattgataacaaaatttgtcatcctcggaattatgatttctacatgtgtgcacatgctggaatgattggtactagcaggcctacacactaccatgttctcttagacgagattggcttttcacctgatgatctacaggagcttgtgcattcattatcatatgtgtatcagaggagcacaactgccatttctgtcgttgctccaatatgctatgctcatctggctgcaactcagatgggtcaatttatgaaatttgaggacaaatctgagacatcttcaagtcatggtggttctggtatacctgctcctcccgtccctcagttgccaagattgcaggacaaagtttcgagctcaatgttcttttgttgaaggatctgtttctagggataggcgatgactgataacagtgctgtttataagaccttcataggatagtttttttgtggaaacagttgaactatgggcgccaatggtgtaggtaaggattattatacatgtaagcaggcattttgctcatgcctttacatgtgtttagtcttttactattttgaatattgttgcgaagtctttcgctattttgaagtttgttaaggtttatgtgattcctatggcgttcctattatgcactcttgatcattatctaatctagtggtttgcatgaatcaaaaaggtgaaatgggtattactgtttttgttaaagtttgttggtgatctgtct

SEQ ID NO: 101 - DNA, 3384 bp, Glycine max
gggtaacattacaaactgtatagagcagcaccgcagagtgcgtcatttttattttttattttttctcttcgcaattcactcattcactcactcactcactcactcactctctctcgctgctgccattattaaaagagtgaagagagagcgagttatagaaccatacttcaaatcattttcattccattttcttctctctgcgccttcttagggtttgggtttctgcttgtgcttctgtcactcattctggagatggcttcttcggggccaaatggaactgacaacggggattcgttgcctcccccgcctcctgttgtcccatcagatgttgtacctgtcaaagctgagctggagaagaagaaggctttgcggcttccaatagccaggcgtggccttgcttcaaaagggacaaagctgcaacttctcaccaatcactacagggtgaacgttgcaaatactgacgggcatttttatcagtatagtgttgctcttttttatgatgatggacgacctgtggagggtaagggtgtagggaggaagcttctggacagggtgcatgagacgtatgattctgaattgaatgggaaggattttgcatatgatggtgagaagactctgtttactcttgggtctcttgctcgcaacaagcttgagtttacggtcgttttggaggatattattgcttccagaaacaatggaaactgcagcccagatggcaatggagaactgaatgagagtgacaaaaagaggatgaggcgccctaatagttccaaggcatttaaagttgagcttagctatgcttcaaagattccattgcaggccattgccaatgctctacgtggacaggaatccgagaattatcaagaagctataagagtgcttgatatcattttgaggcaacatgctgctaagcaaggctgtttgcttgtgaggcaatcgttcttccacaatgatcccaagaattttgctgatgtaggaggaggtgtacttggatgcaggggtttccattctagctttagaactacacaaagtggactgtctttgaacatagatgtctcaaccacgatgataattacccctgggcctgtggtggacttcctaatatccaatcaaaatgtgagagaccccttttcacttgactgggccaaggccaagaggacattaaaaaatctgaggattaaagcgagcccatctaatcaagaattcaaaataactgggattagtgaattcccttgcaaagatcaaacgtttaccttgaagagaaaaggtggtgatgatgttgctgaggaagaagtgacagtatatgattattttgttaatatccgcaagatagatcttcgatattctggggatctcccatgtattaacgttggaaagccaaaaaggccaacttatatccctcttgagctttgctctttggtatccctgcaacgttatacaaaagcactatccactcttcaaagggcttcattggtggagaagtccaggcagaagccacaggagaggatgagggttttgactgatgcacttaaaagtagcaattatggttccgaaccaatgctacgtaattgtgggatctctataagccccaactttactgaagttgagggtcgggttttacaagctccgcggttaaaatttggtaatggggaagacttcaatcctagaaatgggaggtggaacttcaataacaagaaaattgtcaagccaactaaaatagaaagatgggctgtggttaacttctctgcacgctgtgatacacgagggcttgtgagggatctcattaagtgtggtggaatgaaaggaattgtgatagatcagccatttgatgtgtttgaagaaaatggtcagtttaggcgtgcaccgcctgtggttcgagtagagaagatgtttgaattggttcagtctaaacttcctggggctcctcagtttcttctttgtctgcttcctgagaggaaaaattctgatctttatggtccatggaagaagaagaatcttgctgagtttggaatcgtgactcagtgtatagctccgaccagggtcaatgaccaatatttgactaatgttctgttgaaaatcaatgctaagcttggtggcctgaactcaatactaggtgttgagcattctccttctattcctattgtttctagagcaccaaccattattattggcatggatgtgtctcatggttcgccagggcaaacagatattccttcaattgccgcggtggtcagctcccgagaatggccactaatatcaaagtatagggctagcgtccgtacccagtctccaaagatggaaatgattgataatttgttcaagaaggtttctgacaaggaggatgaaggcataatgagggagcttctacttgatttctatacaagttctgggaatagaaagcccgataatataatcatattcagggacggtgttagtgagtcccagttcaatcaagttttgaacattgaacttgatcaaattatcgaggcttgcaagtttttagatgaaaagtggaaccccaagtttttggtgattgttgctcaaaagaaccatcatactaaattctttcaacctggagctcctgacaatgttcctcctggaactgtaattgataacaaaatttgccatcctcggaattatgatttctatatgtgtgcacatgctggaatgattggtactagcaggcccacacactaccatgttctgttagacgagattggcttttcacctgatgatctacaagagcttgtacattcattatcatatgtgtatcagaggagcaccactgccatttctgtcgttgctccaatttgctatgctcatctggctgctactcagatgggtcagtttatgaaatttgaagacaaatctgagacatcttcgagtcatggtggttctggtatgcctgctcctcccgtccctcagttgccaagattgcaggaaaatgtttcgagctcaatgttcttttgttgaaggatctgttgcagttctagggatagtgataactgataacagtgctgtttataagacttcataggatagtttttttgtttgaaccgttgactatgggcgccattggtagtaggaaaggattattatacatgtaaaaaggcattttgcttatgcctttacatgtgtttagtctttaactattttgatactgttgcgagcgaagtctttcgctattttgaagattgttaaggtttatgtgattcctatggcgctcttgatcattttctattttagttgtggtttgcatgaatcaaaagattaaatgggtatattactgttcttatttacggataaaatccatattatagactcctgattgcaatgtgacccgagtaaataagaatgtctcaattgtgtttaaaatacgtgaat

SEQ ID NO: 102 - DNA, 3410 bp, Glycine max
tcctttaaaatcaaacatatgcaggcgtaggaaaagtcccgaaacccgaggcacgcacgcgtcagtgacatgcctgcacgcacttactcgccatgcgtgcgtttcatccttcgagctcgctcactgcatcaccgcacccaatcaatcccacccctccgtgcaatcaacaccaaacatgaatcaacggtccccaacgcatggaaccgaaccgcagagaataatcgctttgttgactcacaagagagagagagagacgatgacaaaagaggctatggattcatttgagccagatggaaatgggaaggagtcactgccaccaccacctcctgttgttccctctgatattgtacctctcaaagcagaggaggtgctctgtacccctaccgagcataataagaaaaaggcttcccgacttccaatagccagatctggtctgggatcaaaaggaaataaaatacaattactaaccaatcacttcaaagttaatgttgctaaaaatgatgggcatttcttccattatagtgtggcttttacttatgaagatggacgccctgtagaaggtaagggtgtagggagaaagataatagatagggtgcaggagacatatcattctgacttaaatggtaaggactttgcatatgatggggagaaaagtctgtttactgttggctctcttcctcaaaacaagcttgagtttgaagttgttcttgaggatgtcacctctaacaggaataatggcaattgcagccctgatggtctaggggacaatgagagtgacagaaagaggatgcgacgtccttatcgttcgaagtcattcaaagtagagataagctttgctgcaaaaattccaatgcaggccattgccagtgccttacgcgggcaagagactgagaattttcaagaagccatcagagttcttgatatcattttgaggcagcatgctgctaagcaaggctgcttacttgtacgccaatcctttttccacaataatccaaataattttgctgatgtaggaggtggtgtcctaggctgtagaggattccactcaagctttagaactacacagagtggcctgtctcttaacatagatgtgtcaactacaatgataatttctcctgggcctgtggtggatttcttaatttccaatcaaaatgtgagagatccttttcaacttgactgggctaaggccaaaaggaccctaaaaaatctgaggattaaaactagcccatccaatcaagaattcaaaatttctgggctcagtgaactcccatgcagagagcagacttttactttgaaaggtaaaggtgggggggatggtgaagatggtaatgaggaaatcactgtatatgattattttgttaaggttcgtaagatagatctccgatactctgctgaccttccatgtatcaatgttggcaagcctaaacgaccaacatttttccccattgaggtttgtgaattggtatcattgcaacgatatacaaaagctctgtccacgcttcaaagggcttcattagtggagaagtcgaggcagaagccacaagagaggatgaaaattttgtctgatgcactgagaacaagcaactatggtgctgaacctatgctccggaattgtggaatttctataagcactggcttcactgaagtggagggccgggtgttgcctgcaccaaggttgaagtttggcaatggtgaggatctcaatcctaggaatgggagatggaatgtcagcagagtgaaatttgtggaaccatcaaagatagaaagatgggctgttgctaacttttctgcacgctgtgatgtacgaggacttgtacgggacctcattagaattggagatatgaaaggaattactatagaacaaccatttgacgtgtttgatgagaatccacagtttaggcgtgccccccctatggttagagtggagaaaatgttcgagcatatccaatctaaacttcctggggctcctcagttccttctctgtttgcttcctgatcggaaaaattgtgatatttatggtccatggaaaaagaagaatcttgctgattttggaatcataaatcagtgtatgtgtcctttaagggtcaatgaccagtacctgactaatgttatgttgaagatcaatgccaagcttggtgggttgaattcattgttaggcgttgaacattctccttctcttcctgttgtttccaaagctcccaccctcattctgggaatggacgtgtcacatggctcacctgggcagactgacattccttcaattgctgcggtggtcagctctagacactggcctctgatatcaaagtatagggcatgtgttcgtacgcaatctgcaaagatggaaatgattgataatttgttcaagctagtatctgaaaaggaagatgaaggcatcataagggaacttttgcttgatttctatacaacttctgggaggagaaaaccggaaaatataatcatattcagggatggggttagtgagtcacaattcaatcaagttttgaatattgaactcgatcgaatcattgaggcttgcaaatttctcgatgaaaattgggagccaaaatttgtggtaattgttgctcagaagaaccaccacactagatttttccagcctggctctcccgacaatgtcccacctggaactgttatcgacaataaaatttgtcatcccagaaattatgatttctacctatgtgcacatgctggaatgataggaactagtaggcctacccattatcatgtgctgcttgatcaggttggtttctctccggatcagctgcaggagcttgtccattcattatcatatgtgtatcagaggagcactactgccatttctgttgttgctccaatatgctatgcgcacttggctgctactcagttggggcagttcatgaaatttgaggacaaatctgaaacatcttcaagccatggtggattgagcggtgcaggtgctgttcccgtccctcagttgcctcccttgcaggagaatgtccgcaacacaatgttcttttgttgaggccttaatgctctgccctgtctcctcaagtggtgaaaatgctgtacataaaactatgtttctaatcttgcaagttatgcggacgaagtttatattgtggtagacttggtcttcttagccatatttagtctttctagcacaagccttttcaaatgttcggggaccttaccttactttttgtagcaagactctctttagcgcaacgtctttttgtagcaaggcttgatcttcagcacgtcttttgttaggcccccccttttttaaggtttaattgcactttttacctcgaatgctgtaatttatagtgaattttacttatctccaacaaattaccttggcgtattttattccaaatttttaagaaacttagattttattgtgttattttact

SEQ ID NO: 103 - DNA, 3412 bp, Glycine max
tgagtgaggatttcatttatagtttatagagagagagagcgttgacacctatccattttgaaaccttctaaactcactctctcactttctcactccctcactccctccgttgacgtttttgttttctttttctctgtgttctgaagaagttttagggtttcgttttgtttctctcttcggccacttcaggctatggattcatttgagccagatggaaatgggaaggagtcactgccaccaccacctcctgttgttccctctgatattgtacctctcaaagcagaggaggtgctctgtacccctaccgagcataataagaaaaaggcttcccgacttccaatagccagatctggtctgggatcaaaaggaaataaaatacaattactaaccaatcacttcaaagttaatgttgctaaaaatgatgggcatttcttccattatagtgtggcttttacttatgaagatggacgccctgtagaaggtaagggtgtagggagaaagataatagatagggtgcaggagacatatcattctgacttaaatggtaaggactttgcatatgatggggagaaaagtctgtttactgttggctctcttcctcaaaacaagcttgagtttgaagttgttcttgaggatgtcacctctaacaggaataatggcaattgcagccctgatggtctaggggacaatgagagtgacagaaagaggatgcgacgtccttatcgttcgaagtcattcaaagtagagataagctttgctgcaaaaattccaatgcaggccattgccagtgccttacgcgggcaagagactgagaattttcaagaagccatcagagttcttgatatcattttgaggcagcatgctgctaagcaaggctgcttacttgtacgccaatcctttttccacaataatccaaataattttgctgatgtaggaggtggtgtcctaggctgtagaggattccactcaagctttagaactacacagagtggcctgtctcttaacatagatgtgtcaactacaatgataatttctcctgggcctgtggtggatttcttaatttccaatcaaaatgtgagagatccttttcaacttgactgggctaaggccaaaaggaccctaaaaaatctgaggattaaaactagcccatccaatcaagaattcaaaatttctgggctcagtgaactcccatgcagagagcagacttttactttgaaaggtaaaggtgggggggatggtgaagatggtaatgaggaaatcactgtatatgattattttgttaaggttcgtaagatagatctccgatactctgctgaccttccatgtatcaatgttggcaagcctaaacgaccaacatttttccccattgaggtttgtgaattggtatcattgcaacgatatacaaaagctctgtccacgcttcaaagggcttcattagtggagaagtcgaggcagaagccacaagagaggatgaaaattttgtctgatgcactgagaacaagcaactatggtgctgaacctatgctccggaattgtggaatttctataagcactggcttcactgaagtggagggccgggtgttgcctgcaccaaggttgaagtttggcaatggtgaggatctcaatcctaggaatgggagatggaatgtcagcagagtgaaatttgtggaaccatcaaagatagaaagatgggctgttgctaacttttctgcacgctgtgatgtacgaggacttgtacgggacctcattagaattggagatatgaaaggaattactatagaacaaccatttgacgtgtttgatgagaatccacagtttaggcgtgccccccctatggttagagtggagaaaatgttcgagcatatccaatctaaacttcctggggctcctcagttccttctctgtttgcttcctgatcggaaaaattgtgatatttatggtccatggaaaaagaagaatcttgctgattttggaatcataaatcagtgtatgtgtcctttaagggtcaatgaccagtacctgactaatgttatgttgaagatcaatgccaagcttggtgggttgaattcattgttaggcgttgaacattctccttctcttcctgttgtttccaaagctcccaccctcattctgggaatggacgtgtcacatggctcacctgggcagactgacattccttcaattgctgcggtggtcagctctagacactggcctctgatatcaaagtatagggcatgtgttcgtacgcaatctgcaaagatggaaatgattgataatttgttcaagctagtatctgaaaaggaagatgaaggcatcataagggaacttttgcttgatttctatacaacttctgggaggagaaaaccggaaaatataatcatattcagggatggggttagtgagtcacaattcaatcaagttttgaatattgaactcgatcgaatcattgaggcttgcaaatttctcgatgaaaattgggagccaaaatttgtggtaattgttgctcagaagaaccaccacactagatttttccagcctggctctcccgacaatgtcccacctggaactgttatcgacaataaaatttgtcatcccagaaattatgatttctacctatgtgcacatgctggaatgataggaactagtaggcctacccattatcatgtgctgcttgatcaggttggtttctctccggatcagctgcaggagcttgtccattcattatcatatgtgtatcagaggagcactactgccatttctgttgttgctccaatatgctatgcgcacttggctgctactcagttggggcagttcatgaaatttgaggacaaatctgaaacatcttcaagccatggtggattgagcggtgcaggtgctgttcccgtccctcagttgcctcccttgcaggagaatgtccgcaacacaatgttcttttgttgaggccttaatgctctgccctgtctcctcaagtggtgaaaatgctgtacataaaactatgtttctaatcttgcaagttatgcggacgaagtttatattgtggtagacttggtcttcttagccatatttagtctttctagcacaagccttttcaaatgttcggggaccttaccttactttttgtagcaagactctctttagcgcaacgtctttttgtagcaaggcttgatcttcagcacgtcttttgttaggcccccccttttttaaggtttaattgcactttttacctcgaatgctgtaatttatagtgaattttacttatctccaacaaattaccttggcgtattttattccaaatttttaagaaacttagattttattgtgttattttactcctaacgtaactgtattttttactcctattttttttttttattttcttggcaaattttatccaattttttttttcaaattt

SEQ ID NO: 104 - DNA, 3267 bp, Glycine max
gcttaattattatataatcactttttctctctacgtttttctttttaacttttctctcttattcctaccctaattgactaattcaccaggtgtccattcatcaccactccacataaacctatacactaggtaagcaagatcaagaatcacatcttgcatttgcttcttgcacaacaatttccacctttttttataaaagaaacttcaatgttcaaatgtctgaaactattagttcataaatttcaaaccccacccaatccggaaaccaaaaatttcccaattgtccatttcccctccaatgcatcttcttccctccaaatcaccatttccaaagctccttctccttattcttcttcgccttcttcttccaatctgaaccctacccaacaccatcaccaacaagaacaccaccttcttctataacactaccatgaattctctcttttcgccggaaaaccttcctccaccaccgggaatcccaatccccgccacaattgccgccgccagcaccaccaccccaaacccaattctaatcccaaagctggaacctttcgatgaatggctcaacacccacacaccccaacaacagcaacaatctcaggaccccaattcttcaaatgggtccctcgacctcgaccttaagctcttcggcgacgaatcccccgaagatttctccggcgaccctaacttgctctccgacttcaaccgtctctctcagcttttcagaaccgctttctccaacaacaacgccgttcccgaccccatcacccaagggatccagcagctcggaaacgacgccgtttccaacccctttgccaaacccccccaaaacgaaaccaccgtggttccaccgccgagcttccaaaacggcaccgtttcggaccccgggatgctgctgcagcagcagcagcagtatccgaacggcgccgtttcagacccagattcgcgggcaattgtgccggtcccggaggacgggcggtcctcctcggtggcggtcaccacgccgcggcagccgcggcgctgcaaagagctggtccgcctgatggatgtcggcgggccggagcagcgtcacttccgggacgtggtccggcggacgaggatgctttacgactcccttcgcgtcctggcgacggtggaggacgagggccgggtggatgcccggcgggggcgcagcgatttgcgtgcctcggcggtgatgaggaactgtggcctgtggctgaaccgtgacaagagaattgttggtgcaattcccggtgtctgcattggtgatgtgttcctttataggatggagttgtgtgttgttggccttcatggtcagcctcaggctgggattgattatctccctgccagcatgagttccaatggtgaaccaattgccactagtgtcattgtttctggtggttatgaggatgatgttgatgagggtgatgttatcatttactctggccacggtggccaggacaagcattctaggcaggttttccaccagaagcttgaggggggaaatcttgcaatggagaggagtatgcactatgggattgaggtcagggttattcgtggggtgcggtatgagggtgctgcctctgctaccgggaggttgtatgtgtatgatgggttgtataggattcatgagtgctggtttgatgtggggaagtcgggtttcggggtttataagtataagctgtgtaggattgatgggcaggctaagatggggactgtggtgatgaaggaggcgcttatgcttaggaaggatcccttgagtttcaaacccatgtgttgtttgtctcttgatgtttcgaataggaaggaaaatgtggccattcggctttttaacgacattgatcgtaactatgaccctctgcagtatgagtatcttgtgaagacaaattttccgcagtttgtctttcatcagagtgggagggggacgggttgtgagtgtgtggatgggtgtgttgaggggtgcttttgtgctatgaagaatggaggggattttccttataatcagagtgggattctcttgagagggaagcctttggtttttgagtgtggcccgttttgtcattgtcctcctcattgtcgaaaccgtgtcacgcagaaggggttgaaaaataggttggaagtgtttagatctagggaaactggttggggagttaggtccttggaccttattcaagctggtgcttttatatgtgagtacacgggggttgttctcactagggatcaagcacagcttttgacaatgaatggtgattcgttgatatatccgaatcggtttactgataggtgggcagaatggggggacttatctatgattgactccaattatgtgcgtccatcgtatccgtcaatacctcctttggattttgctatggatgtgtcaagaatgaggaatgttgcttgctatatgagtcatagttcgactcccaatgtgttggttcagtttgttctctatgatcacaataatttgatgttccctcaccttatgctatttgcgatggagagcatccctccgatgagagagctcagccttgattatggggtagctgatgagtggacaggaaagctctctataggtaactgaacaattttgggagtttcatacactttataatatactgaagctgagttttgggcattgtttgcagagagatagtcaagttgatgcagcacaactttcacaagttttcaaccccgccaatttacaaggaacagtagtagaattgcttgctatttacggtgtcaggatatcaaaattcaaatataaagaaatgtctattacgttattctatctaactgttggtggctagtacacggtgtgcctttgtgttgagaaagatcaggaattgaagttgccaagtctgcttaatcttgaagacttctgtaggtttctcacttgttgatgtcatttgttttttctgtaattgatgtcttcctcatctcggcgaagcattttcacacatttttgtaagcactaatagtgcaagctgtattaactctttcttcttttggagtactttgtatatagtataagttcaaaacttgtataggttttgtattagtgactggtatcggatgcagcattttaattagtttagaactgggtaaattgggcatctggttattaagatgataggatatagccattgttgctaatgatcttgtatgaggaaagtcaattatgatgaaatggacaatttggttatgaatttcacccaataaggttgtagaacatctatgataagacattgtttgcacgttgcatgtaga

SEQ ID NO: 105 - DNA, 3230 bp, Glycine max
cattttctcactttatctatttcttttcttctcatctctcttcttcctaccctaattcccaaaaaatgaggtgtccattaatcaccactccacataaatctacacattaggtaagcaacatcaaggatctggcatcttgcacagctatctctacctttcccacaaaacaaaaaagcaattcaaagttcaaattctgaagctcttagttcataaatttcaaaccccacccaaccaaaatttcaaaaccggaaaccaaaaatttcccaagtgtccatttcccctccaatgcatcttcttccctccaaatcaccatttccaatgcttcttcttcttccaatctaaaccctacccaacaccaccaccacctccacctccaacaagaacaccttcttctataacattaccaccatgaattttctcttttcacgggaaaaccttcccccacctccgggaatcccaatccccgccaccattgccgccgccaacaccaccccaaacccaattctaatcccaaagctcgaacctttcgacgaattgctcaacacccacacaccccaacaacaacaacaatctcaggaccccagtttttcaaatgggtcccttgacctcgacctcgacctcgacctcaagctcgtctgcgacgaaacccccggtgctttctctggcgacccaagcttgctctcagatttcaaccgtctctctcagcttttcaaaaccgctttcaccaacaacaacgccgttctcgaccccatcgcccaagggctccagcagctccaaaacgacgctgtttccgaccctctagacggcactaccgttgttccaccgcagagcttccaaaattcggaccccgggatgcagcagcagcagcagtacccgaacggggccgtttcggacccggattcgcgggcaattgtgccggtcccggaggaagggcggtcctcttcggtggcggtcaccacgccgcggcagcggcgcttcaaggagctggtccgcctgacggatgtcggcgggccggagcaacggcacttccgggacgtggtccgccggacgaggatggtttacgactccctgcgcgtcctggcgacggtggaggacgagggccgggtggatgcccgccgggggcgcagcgatctgcgcgcctcggcggtgatgaggaactgtggcctgtggctgaaccgtgacaagagaattgttggtgcaattcccggtgtctgcattggtgatgtgttcctttataggatggagttgtgtgttgttggccttcacggtcagcctcaggctgggattgattatctccctgctagcatgagttccaatggtgaaccaattgccactagtgtcattgtttctggtggttatgaggatgatgttgatgagggtgatgttattatttactctggccatggtggccaggacaagcattctaggcaggttttccaccagaagcttgagggggggaaccttgcaatggagaggagtatgcactatgggattgaggtgagggtcattcgcggagtgcggtatgagggtgctgcctctgctactgggaggttgtatgtgtatgatgggttgtatagaattcatgagtgctggtttgatgtggggaagtcgggttttggggtttataagtataagctgtgtaggattgatgggcaggctaagatggggactgtggtgatgaaggaggcgcttatgcttaggaaggatcccttgagtttcaaacccacgtgttgtttgtcgcttgatgtttcaaataggaaggagaatgtggcggttcggcttttcaatgacattgatcctaactatgaccctctgcagtatgagtatcttgtgaagacaaattttccgcagtttgtgttccatcagagcgggagggggacaggttgtgagtgtgcggacgggtgtgttgaggggtgcttttgtgccatgaagaatggaggggattttccttataatcagagtgggattctcttgagagggaagcctttggtttttgagtgtggcccattttgtcgttgtcctcctcattgtcggaaccgtgtcacgcagaaggggttgaaaaataggttggaagtgttcagatctagggaaactggttggggagttaggtccatggaccttattcaagctggtgcttttatatgcgagtacacaggggttgttctgactagggagcaagcacggcttttgactatgaatggtgattccttgatatatccaaatcggtttactgataggtgggcagaatggggggacttgtctatgatagactccaattttgtgcgtccatcatatccgtcaatacctcctttggattttgccatggatgtgtcaagaatgaggaatgttgcttgctatatgagtcatagttcaactcccaatgtgttggttcagtttgttctgtatgatcacaataatttgatgttccctcgccttatgctatttgcgatggagagcatccctccgatgagagagctcagccttgattatggggtagctgatgagtggacaggaaagctctctatatgcaatgaatgattttgaaagtttcatacactttataatatactgaagctgactttcgggcattgtttgcagagatagtcaagttgatgcagcacaagttttcaacactgccaatttacaaagagcagtagtagaattgcttgctatacgacggtgtcaggaaatcaaaattcaaatataaagaaatgtctattacgttattctggtttttatctaactgtcaatggctagtacacggtgctcctctggtgaggaaggtcaagaattgaagttcccatttctgcttaatcttgaagacttcagtagttttctcacttgttgatgccatttgtttgttctgtaattgttgatgtcttcctcagctcggcgaagcattttcaaatcacatttttgtaagcaataatagtgcaagctgtattaactctttcttcttttggagaacttgtttgtatatagtataatttcaaagcttgtaaaggttttataatagtgactggtatcggatgcaacattttaattaatttagaagcgggtaaattgggcatctggatattaagattactaggatatagccattgttgctaatgatcttgtatgaggaaaatcaaattatgatgaaatggacaatttggttgttatgaatttaacccaataatgtagtagaacaactatggtaaagaaattgtttgcactttgtatgtaga

SEQ ID NO: 106 - DNA, 1767 bp, Glycine max
cccaaacccgaacccttctgggatacccacatcgaaacctccgacgaactcgacctctactccgagttcaatcgcgtcactgagctctttcacttcgccttcggagccaccaacgttgtcgaccctttcggagccaccaatgttgcatgccccgaacagactccgctggttcctgttcctcaggagctcgattcagcggcccagcccgacccgaattcgccctccgaggacgtcttgcgagcgatcgttccggtaccgccggagcagcaggacggcgcggtggccaccgccaccgtgccgaggcggaagcagagccggcagaaggagctggtgagagtgatggatctgtctccgagggacgaggctcatttgcgcgagaccgtgaggaggacaaggctcatatacgactcgctgcgagtgttgacctccgtggaggaggagaagcgagtcgcctcagtggcattgcggcgtctccggggagacctgcgggctgccagcctgatgagagagcgtggactgtggctgaaccgtgacaagaggatcgtcggggcgatccccggaattatggttggggatttgttcctttttcggatggagttgtgtgtggttggattgcacggtcagatacaggctggaatagattttcttcctgcaagcatgagttccactggagaacctattgctaccagtgtcattgtttctggtggctatgaggatgacatggatgatggtgaggttatagtttacactggccatggagggcaggagaagaattcctccaggcagatctctcatcagaagttggagtcagggaaccttgcattggagaggagtatgcattatggtgttgaggtaagggttatccgtgggatgaagtatgaggggagtgctgctgggtctggtaaggtgtatgtgtatgatggggtgtataggattgttgattgctggtttgatgtggggaggtcgggttttggggtttataagtttaagctttggaggattgaggggcaggctaagatgggtagtgctattttgaaggaagctaggaatgttaggaggagtgagctggatttgaatcccacatctgctgatatggctaacaggaaggagaatgttgcagttcggctttttaatgactttgatgatgatcggggtcctctttgctatgaatatcttgtgaggacttgttttccgaagtttgtgtttcatcagagtgggaaagctactggctgtgactgtgtggatggttgtggtgatggatgcttttgtgctatgaaaaatgggggtgagtttccttacactctgcaggggcatcttgtgagagggaagcctttgatttttgaatgtggcccattttgctcctgtcctcctcattgtcgcaatcgtgttgcgcagaaggggctgaaatataggttggaagtgtttaggtctaagcagacatcttggggagtaaggtccttggaccttattcaagctggttcttttatctgtgagtttgcaggggttgttttgaccagggagcaagctcaactcttaacaatgaatgatatttctctggatgtgtcaacaatgaggaatgttgcttgctatatgagccatagttcaactccaaatgtctgggttcagtttgttctgcatgatcacaacaatttgatgttcccacaccttatgctatttgccatggaaaacatccctcccatgagagagctcagccttgattatggtgtagctgatgagtggacaggcaaactctctatatgtaactga

SEQ ID NO: 107 - DNA, 2477 bp, Glycine max
tcacatttcattaaaatttcaagtccaccttggtcttccagctctaacgttactttgtcccgcatacttcacgcctctgctgttaccacactcactcactactactactcgctctccccacgctacactggttgcgcgtgagtctcaatcgccgcattctcttcgcgcgatctttctacgatcactgaacagagcatatacaaatgagttcgaaaagagggggtgggagacctgtaaccgtggctaacaatgatatgtccaaagggaaaagcatatctgaagctcatccaaaagttgagcagttgactcagggtatcgctgacactaagctaaactcaggacaagatgatggtgagtgggaggtatatgcaaggaaatccaagaacaaggctggaagcagtgctgcaaaaccatgggcccccccagcccataattctaatcctagggcatgggggaatgcagaaatggctcaaaagccaggcatccggggtcatggtggacttggaagatcttcgggaaatccctggcagacacaaaatgctaactttaggagaccagctggcagaggaaatggaaggcctcagttagcaacaagtggatatgaaagcaactatgttccaaatcctgcaattcggcctccacttgagcatggctggaactggcaatccagacctggtgcattgcagtccaatgcaagggatgaaatttcaccagaggaccttcaaaagaatgatgatgttgatgacgatgatggggaggaggactctgatgcttttgaagataccgatgatgatctgatgagtgatgactatgattcagatgctagtcaaaagagtcatgagacacgtaagaaaatcaaatggtttaagaagttttttgagattttggatggcttgactgttgaacagataaatgaaccagaaagacagtggcattgtccagcttgccaaggtggtcctggagctattgattggtacagaggactgcagcccttggtgacacatgccaaaacaaagggatctaaaagggtgaagattcacagggagcttgctatacttttggatgaggaattacgcagaaggggtacttcagtaattccagctggggaagtatttggaaaatggaaaggtttgaaagaagaagaaaaagaccatgacatagtttggcccccaatggttgtcattcagaatacaaagcttgaacaggatgaaaatgataagtggataggtatgggtaaccaagaacttcttgattattttagcacatatgatgctgtgagagcacgacactcttatggcccacagggtcatcgtgggatgagtgttttgatatttgaagcctcagctagtggctatctagaggcagagcgtctccacaagcattttgcagagcaaggaactgataaagattcttggttcagtcgccctattttatatctccctggggggaatcgccagctctatggatacatggctacaaaagaagatatggactttttcaacagacattcccaaggtaaatctagactcaaatatgacataagatcatatcaggagatggttgtacaccaaattcggcaaatgaatgaagacaaccaacagctgctctattttaagaacaaggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagagatgtatatgcaagaacaattcttcaaggaccagatcaaaatcattcatgattcaagggatgcaaaggaagaagatttcgagaggatgcaacaggaggaacgtgagaaggtgaagcagtcaagtactactggtcatgtgaatgctgaggaatatagactcaaggtggaagagtatctgaaatttgttgaggtccaagataaagaaatggagaactttgttgctgaaaaggagaagctgttacatgctcatggcacgggttatgctgcaatgaagcggaggcattgggaggaagaagttcagtatgagcagaagtttgatgaggaattggctaacctcatggaaaagtactccccgtcgtagaagtccaatggtatctaatggtagggtcttttgcacagactcatacaaacagataaacacagccaaataggtagagaaaataaatagagacatcagctttctagagattgagacttttactaaattcagtatgtcattttcttttctttagtacttgttggcatttggtacattcttggatatagaaacctggttaaaattttaaatggtggtgcatgcggttcgaattgaatgacaaattttacaaattggacgttgccatgccctgatgaatgatttatgcattatgagtttgaatatcttgagccaggggattttactgtttcaatatgtttgaaagttccgttaagaatcaac

SEQ ID NO: 108 - DNA, 2472 bp, Glycine max
tcacatttcattaaaatttcaagtccaccttggtcttccagctctaacgttactttgtcccgcatacttcacgcctctgctgttaccacactcactcactactactactcgctctccccacgctacactggttgcgcgtgagtctcaatcgccgcattctcttcgcgcgatctttctacgatcactgagcatatacaaatgagttcgaaaagagggggtgggagacctgtaaccgtggctaacaatgatatgtccaaagggaaaagcatatctgaagctcatccaaaagttgagcagttgactcagggtatcgctgacactaagctaaactcaggacaagatgatggtgagtgggaggtatatgcaaggaaatccaagaacaaggctggaagcagtgctgcaaaaccatgggcccccccagcccataattctaatcctagggcatgggggaatgcagaaatggctcaaaagccaggcatccggggtcatggtggacttggaagatcttcgggaaatccctggcagacacaaaatgctaactttaggagaccagctggcagaggaaatggaaggcctcagttagcaacaagtggatatgaaagcaactatgttccaaatcctgcaattcggcctccacttgagcatggctggaactggcaatccagacctggtgcattgcagtccaatgcaagggatgaaatttcaccagaggaccttcaaaagaatgatgatgttgatgacgatgatggggaggaggactctgatgcttttgaagataccgatgatgatctgatgagtgatgactatgattcagatgctagtcaaaagagtcatgagacacgtaagaaaatcaaatggtttaagaagttttttgagattttggatggcttgactgttgaacagataaatgaaccagaaagacagtggcattgtccagcttgccaaggtggtcctggagctattgattggtacagaggactgcagcccttggtgacacatgccaaaacaaagggatctaaaagggtgaagattcacagggagcttgctatacttttggatgaggaattacgcagaaggggtacttcagtaattccagctggggaagtatttggaaaatggaaaggtttgaaagaagaagaaaaagaccatgacatagtttggcccccaatggttgtcattcagaatacaaagcttgaacaggatgaaaatgataagtggataggtatgggtaaccaagaacttcttgattattttagcacatatgatgctgtgagagcacgacactcttatggcccacagggtcatcgtgggatgagtgttttgatatttgaagcctcagctagtggctatctagaggcagagcgtctccacaagcattttgcagagcaaggaactgataaagattcttggttcagtcgccctattttatatctccctggggggaatcgccagctctatggatacatggctacaaaagaagatatggactttttcaacagacattcccaaggtaaatctagactcaaatatgacataagatcatatcaggagatggttgtacaccaaattcggcaaatgaatgaagacaaccaacagctgctctattttaagaacaaggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagagatgtatatgcaagaacaattcttcaaggaccagatcaaaatcattcatgattcaagggatgcaaaggaagaagatttcgagaggatgcaacaggaggaacgtgagaaggtgaagcagtcaagtactactggtcatgtgaatgctgaggaatatagactcaaggtggaagagtatctgaaatttgttgaggtccaagataaagaaatggagaactttgttgctgaaaaggagaagctgttacatgctcatggcacgggttatgctgcaatgaagcggaggcattgggaggaagaagttcagtatgagcagaagtttgatgaggaattggctaacctcatggaaaagtactccccgtcgtagaagtccaatggtatctaatggtagggtcttttgcacagactcatacaaacagataaacacagccaaataggtagagaaaataaatagagacatcagctttctagagattgagacttttactaaattcagtatgtcattttcttttctttagtacttgttggcatttggtacattcttggatatagaaacctggttaaaattttaaatggtggtgcatgcggttcgaattgaatgacaaattttacaaattggacgttgccatgccctgatgaatgatttatgcattatgagtttgaatatcttgagccaggggattttactgtttcaatatgtttgaaagttccgttaagaatcaac

SEQ ID NO: 109 - DNA, 2887 bp, Glycine max
attgcatcacggattgtggccaccctacttgttattctttccttgtgcaaaaccctgtttgtttggccactcaaaaatgtcatttgatgctgtttctgtgtggcctgtattggagtagttcagtgttgctgtaattgcagtgcaacttgtggctgcttttgcatagacctgtggccatcctagctgttgttctctccatatacaaatccctgtttgttttgcccctcaaaatgtcatttggtgctgtttctgtgtggcctgtagtggagcagttcagtgttgtggttattgtggcacgaattgtggtctctttcgcatggaattgtggcatttccggctgttattctttccatatacaaaaacctatttgtttggctcctccaacgacgtcgtttggtgtcataaggctacaattccatgtgaaacggccacaatctgcctcaggaaaaaacccgtttgtttggcccctctaacgatgtcgtttagtgtcataaggtgggcagtcttgggattttttgcccttaaaagaaaaccctacttctctttgctatttgatgcaaatcatctgaccctgagctctcagctgcgcttctggccaatctgtggcactccaaacagagcatataaaaatgagtttgaaaagaggaggtgggagacctgtaactgtggctaacaatgatatgtccaaagggaaaagcatatctgaacctcagccaaaagttgagcagttgactcagggtattgctgatactaagctaaactcagaacaagatgatggtgagtgggaggtatatgcaaggaaatccaagaacaaggctggaagcagtgctgcaaaaccatggggccccccggtccataattctaatcctagggcatgggggaatgctgaaatggttcaaaagccaggcatccggagtcatggtggagttggaagatcttctggaaatccctggcagacaccaaatgctaactttaggagaccagctggcagaggaaatggaaggcctcaattaggaacaagtggatatgaaagcaactatgtgactccaaatcctgtaattcggcctccactcgagcatggctggaactggcaatccagacctggtgcaatgcagtccaatgtaagggatgaaatttcaccagaggaccttcaaaagaattatggtgttgatgatgatggggaggaggaggaatctgatgatttggaagatactgatgatgatctgatgagtgatgacgatgattctgatgctagtcaaaagagtcatgagacacgtaagaaaagcaaatggtataagaagttctttgagattttggatggcttgactgttgaacagataaacgaaccagaaagacagtggcattgtccagcttgccaaggtggtcctggagctattgattggtacagaggactgcagcccttggtgacacatgccaaaacaaagggatcaaaaagggtgaagattcacagggagcttgctatacttttggatgaggaattacgcagaaggggtacttcagtaattccagctggggaagtatttggaaagtggaaaggtttgaaagaagaagaaaaggaccatgagatagtttggcctccaatggttgtcattcagaatacaaagcttgaacaggatgaaaatgataagtggataggtatgggtaaccaagaacttcttgattattttagcacatatgctgctgcaaaagcacggcactcttatggcccacagggtcatcgtgggatgagtgttttgatatttgaagcctcagctagtggctatctagaggcagagcgtctccacaagcattttgcagagcaaggaactgataaagatgcttggttcaatcgccctattttatatctacctggggggaatcgccagctctatggatacatggctacaaaagaagatctggactttttcaacaggcattcccaaggtaaatctagactcaaatatgacataatgtcatatcaggagatggttgtacaccaaattcggcaaatgaatgaagacaaccaacagctgctctattttaaggacaaggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagagatgtatatgcaagaacaattcttcaaagaccagatcaaaatcattcatgattcaagggatgcaaaggaagaagattttgagaagatgcaacaggaagagcgtgagaaggtgaagcagtcaagtagtactggtcatgtgaatgctgaggaatatagactcaaggtggaagagtatctgaaatttgttgaggtccaagataaagaaatggagaactttgttgctgaaaaggagaaactgttgcatgctcatggcatgggttatgctgcaatgaagcggaggcattgggaggaagaagttcagtatgagcagaagtttgatgaggaactcgccaacctcatggaaaagtactccccgttggagaagttcaatggtatctaatggtagggtcttttgcacagactcatacaaacagataaacacagccaaataggtagagaaaatagagacatcagctttctagagatcgagacttttactaaattcagtatgtcattttcttttctttagtacttgttggcatttggtacatgactggatatagaaaaccttgttaaaattttaaatggtggtgcatgtggttcgaatgactagaaattttacaaatagaaattttacaattgggagttgctatgccccgatgaatgattgatgcattgtgagtttgaatatctttagccaggggattttacagtttgagt

SEQ ID NO: 110 - DNA, 2554 bp, Glycine max
aaacagaggcaactctttttcttgtttcctatcaacaacattctccttcgtctcgaagtttatccgtacgtgccattttaccatttcttgtttatttatttttcttttcctttctctgtactcaataaatcacatttcaagtccaccttggtcagtcttcctcctctaacgttccttcctttgctgttacaacactcactcactcgctctccgcgcttttctggaggcgcgtgagtctcaaccgccacattttcttcgcgcgatcttcctacgatcagtgaacagagcatataaaaatgagtttgaaaagaggaggtgggagacctgtaactgtggctaacaatgatatgtccaaagggaaaagcatatctgaacctcagccaaaagttgagcagttgactcagggtattgctgatactaagctaaactcagaacaagatgatggtgagtgggaggtatatgcaaggaaatccaagaacaaggctggaagcagtgctgcaaaaccatggggccccccggtccataattctaatcctagggcatgggggaatgctgaaatggttcaaaagccaggcatccggagtcatggtggagttggaagatcttctggaaatccctggcagacaccaaatgctaactttaggagaccagctggcagaggaaatggaaggcctcaattaggaacaagtggatatgaaagcaactatgtgactccaaatcctgtaattcggcctccactcgagcatggctggaactggcaatccagacctggtgcaatgcagtccaatgtaagggatgaaatttcaccagaggaccttcaaaagaattatggtgttgatgatgatggggaggaggaggaatctgatgatttggaagatactgatgatgatctgatgagtgatgacgatgattctgatgctagtcaaaagagtcatgagacacgtaagaaaagcaaatggtataagaagttctttgagattttggatggcttgactgttgaacagataaacgaaccagaaagacagtggcattgtccagcttgccaaggtggtcctggagctattgattggtacagaggactgcagcccttggtgacacatgccaaaacaaagggatcaaaaagggtgaagattcacagggagcttgctatacttttggatgaggaattacgcagaaggggtacttcagtaattccagctggggaagtatttggaaagtggaaaggtttgaaagaagaagaaaaggaccatgagatagtttggcctccaatggttgtcattcagaatacaaagcttgaacaggatgaaaatgataagtggataggtatgggtaaccaagaacttcttgattattttagcacatatgctgctgcaaaagcacggcactcttatggcccacagggtcatcgtgggatgagtgttttgatatttgaagcctcagctagtggctatctagaggcagagcgtctccacaagcattttgcagagcaaggaactgataaagatgcttggttcaatcgccctattttatatctacctggggggaatcgccagctctatggatacatggctacaaaagaagatctggactttttcaacaggcattcccaaggtaaatctagactcaaatatgacataatgtcatatcaggagatggttgtacaccaaattcggcaaatgaatgaagacaaccaacagctgctctattttaaggacaaggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagagatgtatatgcaagaacaattcttcaaagaccagatcaaaatcattcatgattcaagggatgcaaaggaagaagattttgagaagatgcaacaggaagagcgtgagaaggtgaagcagtcaagtagtactggtcatgtgaatgctgaggaatatagactcaaggtggaagagtatctgaaatttgttgaggtccaagataaagaaatggagaactttgttgctgaaaaggagaaactgttgcatgctcatggcatgggttatgctgcaatgaagcggaggcattgggaggaagaagttcagtatgagcagaagtttgatgaggaactcgccaacctcatggaaaagtactccccgttggagaagttcaatggtatctaatggtagggtcttttgcacagactcatacaaacagataaacacagccaaataggtagagaaaatagagacatcagctttctagagatcgagacttttactaaattcagtatgtcattttcttttctttagtacttgttggcatttggtacatgactggatatagaaaaccttgttaaaattttaaatggtggtgcatgtggttcgaatgactagaaattttacaaatagaaattttacaattgggagttgctatgccccgatgaatgattgatgcattgtgagtttgaatatctttagccaggggattttacagtttgagt

SEQ ID NO: 111 - DNA, 2419 bp, Glycine max
cgggtaccgtgtgggactttttattgtgtgattatgatacacatacacattacacgctagactctggaccatcatctgctatcggaggcttcaatattttgaccactggaagctgttttgttgcctttgtatgaggtgtcattgataattatgcttcgaagtgacagtatcaactccctgagataggtggtgaaaattgaattatggctgatgatggtgctgatccatttccgaagttgacaagtgtgtatagagtgtctggttccaaaaacaataagctgagctggaatgtagccaattctcagcaaagtgttgactccagtgtaaacaactcaaggcagttacagagcatttctgatggcagtgcttcaagatcctggttttctcaaaattctagaccaaatgcatgggaagttccaagtgtgattcagaagctgaggctggggaagcggggtaatgacggattgactaacaacagtaacctacaggacaaaagtaattctccagatgctctggctttgacgggaagtggaattttgaatgacagcaagttgcctcctgagtcagcaatatctccaacatcagagacatgtttaaattcatctgttgatgttgttgatacaactacatccaaggatttaaaaaatgttgaatgcaaggatgagagaatcccagaaccccattgtgaagacaatggatctgatattgtttttgatagtgatgacgattgttttttagacaacattgacttggataccggggagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggttgcagccccttttggatcattccagaacaatacaaacaacgagggcaagactgcaccggatgtttgctgaaactttggaggaagagtgtttcaggagaagagctccattaacaacggttggcgaagtccacaatatatgggagggtcttgataagaaagtcaaggatcatgaaatagtttggcccccaatggttattatcatgaatacaagatatgagcaggacgaaagtaataagtggaatggaatggggaaccaagaactcgtcgattgcttcagtgactatgctgcattgaaggctcgacactcgtatggtccacaagggcaccgagggatgagtgctttaatttttgaggaaaccacggcaggttatctagaagctgtgcggctgcacaagcattttaaagagcaaggaagagatagggaagcttgggattgctgtcaaaatccatttctcccaggtgggaagcgccaactttatggttacttggcttctaaagaagatttggatattttcaacaaacactccggaggaaagacaaaactgaagtttgaaatgagatcatatcaagagatggttgagagaaagataaaacatattaatgatgatagtcggaagcttgactattataagagcatggtagccaaagaacaaatcaaatcacaagtcggtgcagactctttatgtaaatcaagtgagaagttaagcatgacaactgaaaaaaaccgtgttgaccaacaggacaaggagatggatgcactagaaaaaaatttccagagccaaatccaagacattcaacaagccatagctgcaaaggaggataagtttgtgaaattacagctgcaggcaatgcaagaaaaagtgaaagagtcctgcaaagaatcttctgagaaagaggacaaggtggaaaatatctctagtttcctgaagcctcaagacaaggagatgaagcaattcgaggcagagagagagaaaattaaaaaaattcatgaagagaaaaagttggctctgaagaagaagcagtggcaagagcaggttgaacttgagaaggagttagagaatgaactgacgcagctcatggacaagtacaattgcaaccaatctcaagaaaaaaactgttagaaatgaatgacagctaggtaacattattaaggaaaacatacacagaaatggtaaaagccaaaagcattcataggcatacatatcaggcagagtacatgattatgtgttctttctgccacattttattttccataaattaatacttttttcttttggtttacccttgcattttttattttgaaagttgaaaagtgagagttaacaagccccaccggcaccgaaattctggtcccattttcattgatacttgatatagttttgctcattatatctgtagcgtgctttgcttgcaaatggtttcgaatataagtaattttctgttgattgaagttactgttgggaattttggatgcatagtttgaaatagaattagtctgaga

SEQ ID NO: 112 - DNA, 3075 bp, Glycine max
tttttattgtgtgattatgatacacatacacattacacgctagactctggaccatcatctgctatcgggtatggctgctgctactgcattctctctccaattccatggatttttgtttttttaaattcttattgcttctttcacatgcaaaactcttaatagtacaattgccttatgaatgcgttattgctatgctgttataaaccaatgctttgttctgttgctccttctgctgttttcttttgttggcaggggtaagtagattcttttcatgaattctcaatgcatgtacccgatatttgctctttctcagataactctgttcctcgattgctcctttgttggggctgaaaaaagaggaacacaacgattgtttgtgtagttaatcaaccaaatgagaaaaaagaggaacacaacgattgagaattaagggataggtaatcaatcaaacttgttcttgactctgtgctatttccatcacagttgctggaaaggttttcactttatcattgaattgatccaatgctctggctctcggtttatgaattaattaaactgttttcattgacatgaattggaacttttggactgtttcttatgacaattttcaaactttatatataaattagcttgggtaaggattgttgtttatgaaaccaattcctttggaacttctgatgctagatgtatttttttaattaagccatccatttgcttgtttattgtttccctgattcccagaggcttcaatattttgaccactggaagctgttttgttgcctttgtatgaggtgtcattgataattatgcttcgaagtgacagtatcaactccctgagataggtggtgaaaattgaattatggctgatgatggtgctgatccatttccgaagttgacaagtgtgtatagagtgtctggttccaaaaacaataagctgagctggaatgtagccaattctcagcaaagtgttgactccagtgtaaacaactcaaggcagttacagagcatttctgatggcagtgcttcaagatcctggttttctcaaaattctagaccaaatgcatgggaagttccaagtgtgattcagaagctgaggctggggaagcggggtaatgacggattgactaacaacagtaacctacaggacaaaagtaattctccagatgctctggctttgacgggaagtggaattttgaatgacagcaagttgcctcctgagtcagcaatatctccaacatcagagacatgtttaaattcatctgttgatgttgttgatacaactacatccaaggatttaaaaaatgttgaatgcaaggatgagagaatcccagaaccccattgtgaagacaatggatctgatattgtttttgatagtgatgacgattgttttttagacaacattgacttggataccggggagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggttgcagccccttttggatcattccagaacaatacaaacaacgagggcaagactgcaccggatgtttgctgaaactttggaggaagagtgtttcaggagaagagctccattaacaacggttggcgaagtccacaatatatgggagggtcttgataagaaagtcaaggatcatgaaatagtttggcccccaatggttattatcatgaatacaagatatgagcaggacgaaagtaataagtggaatggaatggggaaccaagaactcgtcgattgcttcagtgactatgctgcattgaaggctcgacactcgtatggtccacaagggcaccgagggatgagtgctttaatttttgaggaaaccacggcaggttatctagaagctgtgcggctgcacaagcattttaaagagcaaggaagagatagggaagcttgggattgctgtcaaaatccatttctcccaggtgggaagcgccaactttatggttacttggcttctaaagaagatttggatattttcaacaaacactccggaggaaagacaaaactgaagtttgaaatgagatcatatcaagagatggttgagagaaagataaaacatattaatgatgatagtcggaagcttgactattataagagcatggtagccaaagaacaaatcaaatcacaagtcggtgcagactctttatgtaaatcaagtgagaagttaagcatgacaactgaaaaaaaccgtgttgaccaacaggacaaggagatggatgcactagaaaaaaatttccagagccaaatccaagacattcaacaagccatagctgcaaaggaggataagtttgtgaaattacagctgcaggcaatgcaagaaaaagtgaaagagtcctgcaaagaatcttctgagaaagaggacaaggtggaaaatatctctagtttcctgaagcctcaagacaaggagatgaagcaattcgaggcagagagagagaaaattaaaaaaattcatgaagagaaaaagttggctctgaagaagaagcagtggcaagagcaggttgaacttgagaaggagttagagaatgaactgacgcagctcatggacaagtacaattgcaaccaatctcaagaaaaaaactgttagaaatgaatgacagctaggtaacattattaaggaaaacatacacagaaatggtaaaagccaaaagcattcataggcatacatatcaggcagagtacatgattatgtgttctttctgccacattttattttccataaattaatacttttttcttttggtttacccttgcattttttattttgaaagttgaaaagtgagagttaacaagccccaccggcaccgaaattctggtcccattttcattgatacttgatatagttttgctcattatatctgtagcgtgctttgcttgcaaatggtttcgaatataagtaattttctgttgattgaagttactgttgggaattttggatgcatagtttgaaatagaattagtctgaga

SEQ ID NO: 113 - DNA, 2301 bp, Glycine max
atacacatacacattacacgctagactctggaccatcatctgctatcggtatcaactccctgagataggtggtgaaaattgaattatggctgatgatggtgctgatccatttccgaagttgacaagtgtgtatagagtgtctggttccaaaaacaataagctgagctggaatgtagccaattctcagcaaagtgttgactccagtgtaaacaactcaaggcagttacagagcatttctgatggcagtgcttcaagatcctggttttctcaaaattctagaccaaatgcatgggaagttccaagtgtgattcagaagctgaggctggggaagcggggtaatgacggattgactaacaacagtaacctacaggacaaaagtaattctccagatgctctggctttgacgggaagtggaattttgaatgacagcaagttgcctcctgagtcagcaatatctccaacatcagagacatgtttaaattcatctgttgatgttgttgatacaactacatccaaggatttaaaaaatgttgaatgcaaggatgagagaatcccagaaccccattgtgaagacaatggatctgatattgtttttgatagtgatgacgattgttttttagacaacattgacttggataccggggagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggttgcagccccttttggatcattccagaacaatacaaacaacgagggcaagactgcaccggatgtttgctgaaactttggaggaagagtgtttcaggagaagagctccattaacaacggttggcgaagtccacaatatatgggagggtcttgataagaaagtcaaggatcatgaaatagtttggcccccaatggttattatcatgaatacaagatatgagcaggacgaaagtaataagtggaatggaatggggaaccaagaactcgtcgattgcttcagtgactatgctgcattgaaggctcgacactcgtatggtccacaagggcaccgagggatgagtgctttaatttttgaggaaaccacggcaggttatctagaagctgtgcggctgcacaagcattttaaagagcaaggaagagatagggaagcttgggattgctgtcaaaatccatttctcccaggtgggaagcgccaactttatggttacttggcttctaaagaagatttggatattttcaacaaacactccggaggaaagacaaaactgaagtttgaaatgagatcatatcaagagatggttgagagaaagataaaacatattaatgatgatagtcggaagcttgactattataagagcatggtagccaaagaacaaatcaaatcacaagtcggtgcagactctttatgtaaatcaagtgagaagttaagcatgacaactgaaaaaaaccgtgttgaccaacaggacaaggagatggatgcactagaaaaaaatttccagagccaaatccaagacattcaacaagccatagctgcaaaggaggataagtttgtgaaattacagctgcaggcaatgcaagaaaaagtgaaagagtcctgcaaagaatcttctgagaaagaggacaaggtggaaaatatctctagtttcctgaagcctcaagacaaggagatgaagcaattcgaggcagagagagagaaaattaaaaaaattcatgaagagaaaaagttggctctgaagaagaagcagtggcaagagcaggttgaacttgagaaggagttagagaatgaactgacgcagctcatggacaagtacaattgcaaccaatctcaagaaaaaaactgttagaaatgaatgacagctaggtaacattattaaggaaaacatacacagaaatggtaaaagccaaaagcattcataggcatacatatcaggcagagtacatgattatgtgttctttctgccacattttattttccataaattaatacttttttcttttggtttacccttgcattttttattttgaaagttgaaaagtgagagttaacaagccccaccggcaccgaaattctggtcccattttcattgatacttgatatagttttgctcattatatctgtagcgtgctttgcttgcaaatggtttcgaatataagtaattttctgttgattgaagttactgttgggaattttggatgcatagtttgaaatagaattagtctgaga

SEQ ID NO: 114 - DNA, 2689 bp, Glycine max
actgcattctctctccaattccatggatttttgtttttttaaattcttattgcttctttcacatgcaaaactcttaatagtacaattgccttatgaatgcgttattgctatgctgttataaaccaatgctttgttctgttgctccttctgctgttttcttttgttggcaggggtaagtagattcttttcatgaattctcaatgcatgtacccgatatttgctctttctcagataactctgttcctcgattgctcctttgttggggctgaaaaaagaggaacacaacgattgtttgtgtagttaatcaaccaaatgagaaaaaagaggaacacaacgattgagaattaagggatagaggcttcaatattttgaccactggaagctgttttgttgcctttgtatgaggtgtcattgataattatgcttcgaagtgacagtatcaactccctgagataggtggtgaaaattgaattatggctgatgatggtgctgatccatttccgaagttgacaagtgtgtatagagtgtctggttccaaaaacaataagctgagctggaatgtagccaattctcagcaaagtgttgactccagtgtaaacaactcaaggcagttacagagcatttctgatggcagtgcttcaagatcctggttttctcaaaattctagaccaaatgcatgggaagttccaagtgtgattcagaagctgaggctggggaagcggggtaatgacggattgactaacaacagtaacctacaggacaaaagtaattctccagatgctctggctttgacgggaagtggaattttgaatgacagcaagttgcctcctgagtcagcaatatctccaacatcagagacatgtttaaattcatctgttgatgttgttgatacaactacatccaaggatttaaaaaatgttgaatgcaaggatgagagaatcccagaaccccattgtgaagacaatggatctgatattgtttttgatagtgatgacgattgttttttagacaacattgacttggataccggggagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggttgcagccccttttggatcattccagaacaatacaaacaacgagggcaagactgcaccggatgtttgctgaaactttggaggaagagtgtttcaggagaagagctccattaacaacggttggcgaagtccacaatatatgggagggtcttgataagaaagtcaaggatcatgaaatagtttggcccccaatggttattatcatgaatacaagatatgagcaggacgaaagtaataagtggaatggaatggggaaccaagaactcgtcgattgcttcagtgactatgctgcattgaaggctcgacactcgtatggtccacaagggcaccgagggatgagtgctttaatttttgaggaaaccacggcaggttatctagaagctgtgcggctgcacaagcattttaaagagcaaggaagagatagggaagcttgggattgctgtcaaaatccatttctcccaggtgggaagcgccaactttatggttacttggcttctaaagaagatttggatattttcaacaaacactccggaggaaagacaaaactgaagtttgaaatgagatcatatcaagagatggttgagagaaagataaaacatattaatgatgatagtcggaagcttgactattataagagcatggtagccaaagaacaaatcaaatcacaagtcggtgcagactctttatgtaaatcaagtgagaagttaagcatgacaactgaaaaaaaccgtgttgaccaacaggacaaggagatggatgcactagaaaaaaatttccagagccaaatccaagacattcaacaagccatagctgcaaaggaggataagtttgtgaaattacagctgcaggcaatgcaagaaaaagtgaaagagtcctgcaaagaatcttctgagaaagaggacaaggtggaaaatatctctagtttcctgaagcctcaagacaaggagatgaagcaattcgaggcagagagagagaaaattaaaaaaattcatgaagagaaaaagttggctctgaagaagaagcagtggcaagagcaggttgaacttgagaaggagttagagaatgaactgacgcagctcatggacaagtacaattgcaaccaatctcaagaaaaaaactgttagaaatgaatgacagctaggtaacattattaaggaaaacatacacagaaatggtaaaagccaaaagcattcataggcatacatatcaggcagagtacatgattatgtgttctttctgccacattttattttccataaattaatacttttttcttttggtttacccttgcattttttattttgaaagttgaaaagtgagagttaacaagccccaccggcaccgaaattctggtcccattttcattgatacttgatatagttttgctcattatatctgtagcgtgctttgcttgcaaatggtttcgaatataagtaattttctgttgattgaagttactgttgggaattttggatgcatagtttgaaatagaattagtctgaga

SEQ ID NO: 115 - DNA, 2865 bp, Glycine max
aatttaagacgcgtgtgaaaattgacaaaaaatgaaatttgataaaaatttcaagtccgaaaatacaacaaatgagagaaaatgccaagtcaacttaaagttcacttagctatcagccctttcgttttgcttcacacaacagccggcgatcgccttcggatctctgagaaaaggaattcaaaaagagggtgtgagagacctttcactatggcagacattggtgattcttcttccaaagggaaaaatgtattggaatctcttccaaaaattgagcaattaactcaaggtgttgctgatgttaacatagagtcaggacaagatgatggtgaatgggtggtatatgcaaagaagtccaagaatagagcccgaagcacaactgttaaaccatggagtcctccggttcataattctagacccactggaaatacaaagatggctcacaagccagttactcggaatgatggaggagttggaagggcttctgggagtggaaatccttggcagtcccaaaatgctaacttcaagagacctgctggcagaggaaatggaaggccacagttaactgcaagtgaatctgaaagcagcaataatgtgacttctaatccagtcattcgacctcccctcgagcatgggtggaattggcaatctatatctggctccaagcagtccaagagtgttgatgatagcctggtgaagggtgaaattacagaagagtcccctatgaagaatgatagtgttgatgatgaaggggatgaagaggaagggtttgatgctatggaagatacggatgatgatctaatgagtgatgattatgattctgatactagtcaaaagagccacgagactcgtaagaagagcaaatggtttaaggatttctttgagaacttggatggcctatctatcgaaaagatcaatgaaccggaaaggcagtggcactgtacagcttgtcgaggtggtcccggtgctattgattggtacagaggactgcagcctctgattactcatgccaaaacaaaggggtcaaaaagggtgaagatccatagggagtttgctgagcttttggaagaggaactgcgcaaaaggggctctgcagtaattccacctggggaagtatttggtaagtggaaaggtttaaaagatgaggagaaagatcatgaaatagtttggcctccgatggttgtcattcagaatacaaggcttgaacaggatgaaaatgataagtggctaggtatgggtaaccaggagcttcttaattattttagcgcatatgatgctgtgaaagctcgacacgcttatggcccccagggtcatcgggggttgagcgttttgatatttgaagcatcagctataggttatcttgaggctgagcgtctacacaagcactttgcagaacaaggaactgaccgagatgcttggtttagtcaccaccgtagattatttctccctggtggccggcgacagctctatggatacatggcaataaaagaagacctggactttttcaacagacattgccaaggtaaatctagactcaaatatgacatgagatcataccaggagatggttgtaaaccaacttcggcaaatgaatgaggacaaccagctgcttatttatttgaaggacagggatgccaaaaaacaaaaacaaacaaaagctcttgaagaatctttgggtatagtgactgagaagctgcgaaggacaatggaagaaaatcgcattgtgaggttgagaactaaaatgcaacatgaagagaacaaggaagagatgtacatgcaagaagaattttttaaggaacagatcagaatcattcatgattcaagggctgcaaaggaagaagagtttgagaggatgcagcaggagaaacgagagaaggtgaagccgtcaagtactagccctttaaatgaagaggaagggagagttaaggtggacgaatatctaaaatttgttgagtttcaagataaagaaatggaaaactttgttgctgaagaggagaaactccgtcaagctcataaagacaatgttgatgcaatgacgcggaggcactgggaggaaaaggtgcagttggaggaaaggtttaatgaggagctagccaagctcatggaaaagtattccctatctcacccagaaaagtccaatggtatctgatgacagtgtgttgcacatcgcagacaaaaagataaatacagcattataaacagaagataaatggatagagtgattgttctaagttgaagaccctcagatatctgcacttttgtacttgaatacaaggacatgcctagagaatggagatagaaagcttgctaaaatacaaatgacattgcttattttctcctttggtattagtggcttgaacttttgatgtaattgcttttatgcaaattttttgaatagcagcaatttggatggagtgaaatacaccactttaggttatctctggctttggtgaatcgtatgaatggaagcctgatagctctgctgtaagagaagtgttagcgacacactccctaacacacttcctattattattagtgaaaatttattggaaattacaaagtttgagtgaaactcattaaatagttaagacttaccaataaatttcagtcactaataagtgtgttaagtatgttgttaacatttttcttactgtattcatctgtgaagcctgcttctgtattcatctgtcaagcctgcctctgttgcttcaaaactcaaaaggcctgaattcaacgttgtaataaatattgaattttgtttttataggggttaatatttatgtttatccttgtgttcacttgtccgttcgccccatggttatgtttttcaaactttgaggtaataggtttagttgcctttaaatgtaac

SEQ ID NO: 116 - DNA, 2477 bp, Glycine max
gtttaaaagtaaattgttagagaggacgcagtcacgcctgtgactgtgtgatacactagactgtattgctgctactgcattctctctccaattccatgcatttttgcttttttaaattcttattgcttctttcacatgccaaactcttcgagtacaattgccgttacttttattcctccttatgaatgcgttactgctatgttataaatagatgctttgttcttgttgctccatctgtcgtgttcttttgttgacagggtggtgaaaattgaattatggctgatgatggtgctgatccatttccagtgttgacaagtgtgtatagagtatctggttccaaaaacagtcagctgggctggaatgtagccaattctcagcaaactgttgactccagtgtaaacaactcaaggcagttacagagcatttctgatggcagtgctccaagaccctggttttctcaaaattttagaccaaatgcatgggaagttccaggtgtgattcagaagctgaggccggcaaagcggggtaatgacggattggctttgacgggaagtggaattttgaacgacaagttgcctcctgagtcagtaatatctccaacatcagagacagagagagggacagggttaaattcatctgttggagtcgttacaactacatccaaggattgtgaaaatgttgaatgcaaggacaaggataagagaatcccagaaccccaatgtgaaaacaacaatgatcagattgttgacaatggatctgatattgtttttgatagtgatgatgattgttttttagatgacattgactcagatactggagagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggctgcatccccttttggatcattccagaacaatacaaacaaagagggcaagactgcaccggatgtttgctgaaactttggaggaagagtgtttcaggagaagagctccattaacaacagtcagtgacgtccatgatatatgggagggtcttgataagaaagtcaaggatcatgaaatagtttggcccccaatggttatcatcatgaatacaagatacgagcaggacgaaagtaacaagtggaatggaatggggaaccaaggactccttgattgcttctgtgactatgcagcattgaaggctcgacactcgtatggtccacaagggcaccgagggatgagtgccttaatttttgaggaatccacggcaggttatctagaagctgtgcggctccacaagcattttaaagagcaaggaagagatagggaggcttgggattgctatcggaatccatttctcccaggtgggaagcgccaactttatggttacttggcttctaaagaagatttagatattttcaacaagcactctagaggaaagacaaaattgaagtttgaaatgagatcatatcaagagatggttgagagcaagataaaacatattaatgatgatagtcggaagcttgactattataagagcatggtagccaaagaacaaatcaaatcacaagtaggtgcagactctttattgagattaagtgagaagttaagcttgacaaccgaagaaaaccgtgttgatcaacaaaataaggagatggatgcactagaaaaaaatttccagagccaaatcctagacattcaacaagccatagctgcaaaggaagataagtttgtgaaattacagcaggcaatgcaagaaaaagtgaaagagtcctgcggagaatcttctgagaaagaggacaaggtagaaaatatctcttgtttcctgaagccccaagacaaggagatgaagcagtttgaggcagagagagagaaaatcataaaaattcatgaagagaaaaggttggctctgaagaagaagcattggcaagagcaggttgaacttgagaaggagttagagaatgaacggacgcagctcatggacaagtacacttgcaaccagactcaagaagaaaactgttatgtggatcattaaggaaaacatacacagaaatggaaaaagccaaaagcatccacaggcatacagatcatgcagagtacatgttatgtgctctgccacattttccatgaatttatacttttttcttttggtttactcttgcatttattttgaaagttgaaaagtgagaaagttaacaagccccaccggcaccaaaattctggttccattttcattgatacttgatatagttttgctctcattatatatgtagcgtgcatgctttgcttgcaaatggtttcgaatataaattttctgttgattaaagttactgtcttactgtagggaattttggatgtatagtttgaaatggaattagtctgagactcatactgaataataccaaag

SEQ ID NO: 117 - DNA, 4261 bp, Glycine max
ttttagccctaacaatggtagcgaatagcgacactctcagtctcactgagtcacattatctttgtgtgtgtatcgtaaaatgtaaacttcgtggagaaggtatcgcaaactgaatcaatcagactagacttgacccgtcaacttgcaactctctcttcaatcgcaattccttcacttcccactctcatacaaagacccagaatttacatactactgagaacatggacttagaaggaagtgaaaaggattcagtggttactcagattagcattggcggatttggcagtgaggtcaaagcaagtgatctcgtgaattacttggaggataaaattggacttgtgtacaggtgtaggttgaagacttcttggacccctccagagtcatatccagaatttaatatcattgatactgcaaatattagaagaacggataactataagaaggtggagccccatgcctttgtgcattttgcatctccggaatctgtgactgcagccctgaatgcttcaggttgttgtgatctatttttgaagaatcaacccttaaaggtcagctgtgggcctgaaaatccatacttcctgaaccaaaggaggagaactacaactccttttaagatgtctgatgtacttgttgaaattgggactttggttagcccaggggagttttttgtttcttggagaggacctgataaaggtgtaaaatttcttgtggatccctttgatggcatgtgcaggttttgtttcagtagggatactgcattctcattcaaagggatagaaaaaaaagcagtgataaagtgtgattttcaggtgggattcctggttagagacattaatgagatcaagagatataatgatacatcatatctcgttgttttattgcacctagcttcttcaccttgggtttggtacagaactgccgatgatgacattgaagaatcagtaccatttgatttgctagatgatgatgatccttggattagaaccactgattttactcccagtggggcaattggtcgatgcaatttttatagaatttcaatcccacctcgccatggtgcaaaattgatgaaggccatgctttatctgaaaggtcaaagagtgcaaatgcaagaacttgcacttaaacagacacttaggacactgaatgaacctgattttggtgtgcccatgtcagatgctttcttctatatacattttcagaaggacattgcttttgacataatgtttttggtcaatgctattgtacataaaggcatattcaatcagcacaggttgtcggataggttttttgaattgctgaaaaatcaacctaaggagctcaatgtggctgccctgaagcatttatgttcttacaagcgcccagtatttgatgcaactaagaggctaaaaatagtccaagaatggttgctcagaaatcctaaactttatcagatctctaaacagttggatgatattgttgaggttagaagattggttattactccatcaaaagcctattgtataccgcctgaagttgaattgtccaacagggttctcagaaaattcagagaagtttcagattgtttcttgagagtcacctttatggatgaaggcatgcaaacaattaatgtgaatgctcttaactattatgttgctcctatagtgaaggaaatcacatcgaattctttctctcaaaggacaaaaatatataaaagggtcaagactatcttggaacagggattttacttttgtggccgaaaatattcatttttagccttttcatccaatcaacttagagatagatctgcttggttttttgctgaagacaaaataagatgtgatgatatacgaaattggatgggcaagtttaatcagaggaatgttgcaaaatgtgctgctaggatgggacaatgcttctcgtctacttatgcaacagttgaagttgctgcaaatgaagttaactccatgctacctgatgttgagaggaacaattacattttctctgatggtattggtgttatcactcatgatcttgcaagggaagttgcagaaaagttgaagttggacaatgtaccctctgcttaccagatcagatatgctggttttaaaggggttgtggcctcttggccggccaaaggggatggagtcagactttctttgaggcctagtatgaacaagtttcaatctactcataatatcttggagatctgtgcttggaccaggtttcagcctggttttcttaaccggcagattataacattgctttcagcactgggtgtgcctgatgaagtattttggcaaatgcaggaggcaatgcttttgaagttaaatcaaatgcttgtggatgcagatattgctttcgatgttcttaccaaatcatgtgctgagcatgggaatgctgcagcaataatgttaagttgtggcttcagtcccctaacagaacctcatcttagaggaatgctaacttctacacgtgctgcgcagctttggggacttagagaaaagtccaggatttttgtatcgtctgggagatggttgatgggtgtcttagatgagtcgggcgtgcttgaacaagggcagtgctttgttcaagtgtctactccttctcttgaaaattgtttctcaaagcatggttcaagattttcagagacaaagaacctgcatgtagttaaaggttttgtgattatagcaaaaaatccttgccttcatccaggagatgtaagagttttggaggcagttgatgcccccgatttacatcatttaaatgattgtcttgttttccctcaaaagggtgacagaccccatacaaatgaagcttctggaagtgaccttgacggggatttatattttgtcacatgggatgaaaatctcattccaccaagtaagaggagctggatacctatggagtatgcccctcaagaaagcaaacttaagacacgtcaagtgatgacccgagacatcatagaattttttgtcagaaacatggtaaatgaacatttgggtgcaatctgcaatgcacatgtggtacatgccgattccagtgactacggtgccttggatgagaaatgcatacacttggccgagctagcagccactgctgttgattttccaaagaccgggaagcttgtcactatgcctcctcatctgaaaccaaaattgtaccctgatttcatggggaaagagcggcaccagtcttacaggtcgaagaaaatcctgggtagactttaccggcgtatcaaagatgcttatgatgaagatattgatgctccctatttgaactttgtgactggcgatataccgtatgataaagatcttgaagttccaggatctgctgattttattgctgatgcgtgggagcaaaaatgctcatatgatggccaattgagtgggctacttggacaatacaaagtgaaaagagaagaggaagttgttactggacagatttggtctatgccaaaatacaacagtaggaagcaaggggagcttaaagagaggctgaagcactcttacagtgccctgaaaaaagaatttaggcacacttttgagaaattgaattcagatgttggagaattaagcgaggaagaaaaaaatttgttctatgagcagaaagcttcggcctggtatcaggtgacatatcatcctgagtgggtgaaaaaatcccttgatctgcaagataaatcctcagagaaccaagaggctgatagtttgggaagtacggtgatgttgagttttccttggattgcagttgattacctagctcgcacaaagataaggcaacgacatcagagatgtggaaattttgactcaactaagccagttgattctctggcaaagtatctatctgaaaggttataataattctattgagcttgctcttggctactaggccactctgccatcctataatattacgtataatgtgtcttcactttagctgcttcgattgtaactaggtttgttcccaagccaggaaatgcctctggttttgaggcttaagactgtatctagtctagttacatttgatactgtttgaccgttttgttatagtagtcttgtgcatgcggttatatgtatgtgattgtgattaaattatgtttcttgagctttctaaacatagtttgaacaatggtgaagctatcattgaaatctttgtgtgcagcattcataagtattttaaacaatagtgaagttattattgagatctttggcttataggcacagttaaagctcttgggaattaaatgtcttggcgaagtacatatgtgtcaactaataagaag

SEQ ID NO: 118 - DNA, 4398 bp, Glycine max
ttttagccctaacaatggtagcgaatagcgacactctcagtctcactgagtcacattatctttgtgtgtgtatcgtaaaatgtaaacttcgtggagaaggtatcgcaaactgaatcaatcagactagacttgacccgtcaacttgcaactctctcttcaatcgcaattccttcacttcccactctcatacaaagacccaggtacatcactttctattacccttttctaatgtatcaatcctttctcatcaaagggtattgcgagcgagactacgtgggagcatgattgctttcatgatttgatcacaacgctatcctgcgtttggtttcgttactggaatttacatactactgagaacatggacttagaaggaagtgaaaaggattcagtggttactcagattagcattggcggatttggcagtgaggtcaaagcaagtgatctcgtgaattacttggaggataaaattggacttgtgtacaggtgtaggttgaagacttcttggacccctccagagtcatatccagaatttaatatcattgatactgcaaatattagaagaacggataactataagaaggtggagccccatgcctttgtgcattttgcatctccggaatctgtgactgcagccctgaatgcttcaggttgttgtgatctatttttgaagaatcaacccttaaaggtcagctgtgggcctgaaaatccatacttcctgaaccaaaggaggagaactacaactccttttaagatgtctgatgtacttgttgaaattgggactttggttagcccaggggagttttttgtttcttggagaggacctgataaaggtgtaaaatttcttgtggatccctttgatggcatgtgcaggttttgtttcagtagggatactgcattctcattcaaagggatagaaaaaaaagcagtgataaagtgtgattttcaggtgggattcctggttagagacattaatgagatcaagagatataatgatacatcatatctcgttgttttattgcacctagcttcttcaccttgggtttggtacagaactgccgatgatgacattgaagaatcagtaccatttgatttgctagatgatgatgatccttggattagaaccactgattttactcccagtggggcaattggtcgatgcaatttttatagaatttcaatcccacctcgccatggtgcaaaattgatgaaggccatgctttatctgaaaggtcaaagagtgcaaatgcaagaacttgcacttaaacagacacttaggacactgaatgaacctgattttggtgtgcccatgtcagatgctttcttctatatacattttcagaaggacattgcttttgacataatgtttttggtcaatgctattgtacataaaggcatattcaatcagcacaggttgtcggataggttttttgaattgctgaaaaatcaacctaaggagctcaatgtggctgccctgaagcatttatgttcttacaagcgcccagtatttgatgcaactaagaggctaaaaatagtccaagaatggttgctcagaaatcctaaactttatcagatctctaaacagttggatgatattgttgaggttagaagattggttattactccatcaaaagcctattgtataccgcctgaagttgaattgtccaacagggttctcagaaaattcagagaagtttcagattgtttcttgagagtcacctttatggatgaaggcatgcaaacaattaatgtgaatgctcttaactattatgttgctcctatagtgaaggaaatcacatcgaattctttctctcaaaggacaaaaatatataaaagggtcaagactatcttggaacagggattttacttttgtggccgaaaatattcatttttagccttttcatccaatcaacttagagatagatctgcttggttttttgctgaagacaaaataagatgtgatgatatacgaaattggatgggcaagtttaatcagaggaatgttgcaaaatgtgctgctaggatgggacaatgcttctcgtctacttatgcaacagttgaagttgctgcaaatgaagttaactccatgctacctgatgttgagaggaacaattacattttctctgatggtattggtgttatcactcatgatcttgcaagggaagttgcagaaaagttgaagttggacaatgtaccctctgcttaccagatcagatatgctggttttaaaggggttgtggcctcttggccggccaaaggggatggagtcagactttctttgaggcctagtatgaacaagtttcaatctactcataatatcttggagatctgtgcttggaccaggtttcagcctggttttcttaaccggcagattataacattgctttcagcactgggtgtgcctgatgaagtattttggcaaatgcaggaggcaatgcttttgaagttaaatcaaatgcttgtggatgcagatattgctttcgatgttcttaccaaatcatgtgctgagcatgggaatgctgcagcaataatgttaagttgtggcttcagtcccctaacagaacctcatcttagaggaatgctaacttctacacgtgctgcgcagctttggggacttagagaaaagtccaggatttttgtatcgtctgggagatggttgatgggtgtcttagatgagtcgggcgtgcttgaacaagggcagtgctttgttcaagtgtctactccttctcttgaaaattgtttctcaaagcatggttcaagattttcagagacaaagaacctgcatgtagttaaaggttttgtgattatagcaaaaaatccttgccttcatccaggagatgtaagagttttggaggcagttgatgcccccgatttacatcatttaaatgattgtcttgttttccctcaaaagggtgacagaccccatacaaatgaagcttctggaagtgaccttgacggggatttatattttgtcacatgggatgaaaatctcattccaccaagtaagaggagctggatacctatggagtatgcccctcaagaaagcaaacttaagacacgtcaagtgatgacccgagacatcatagaattttttgtcagaaacatggtaaatgaacatttgggtgcaatctgcaatgcacatgtggtacatgccgattccagtgactacggtgccttggatgagaaatgcatacacttggccgagctagcagccactgctgttgattttccaaagaccgggaagcttgtcactatgcctcctcatctgaaaccaaaattgtaccctgatttcatggggaaagagcggcaccagtcttacaggtcgaagaaaatcctgggtagactttaccggcgtatcaaagatgcttatgatgaagatattgatgctccctatttgaactttgtgactggcgatataccgtatgataaagatcttgaagttccaggatctgctgattttattgctgatgcgtgggagcaaaaatgctcatatgatggccaattgagtgggctacttggacaatacaaagtgaaaagagaagaggaagttgttactggacagatttggtctatgccaaaatacaacagtaggaagcaaggggagcttaaagagaggctgaagcactcttacagtgccctgaaaaaagaatttaggcacacttttgagaaattgaattcagatgttggagaattaagcgaggaagaaaaaaatttgttctatgagcagaaagcttcggcctggtatcaggtgacatatcatcctgagtgggtgaaaaaatcccttgatctgcaagataaatcctcagagaaccaagaggctgatagtttgggaagtacggtgatgttgagttttccttggattgcagttgattacctagctcgcacaaagataaggcaacgacatcagagatgtggaaattttgactcaactaagccagttgattctctggcaaagtatctatctgaaaggttataataattctattgagcttgctcttggctactaggccactctgccatcctataatattacgtataatgtgtcttcactttagctgcttcgattgtaactaggtttgttcccaagccaggaaatgcctctggttttgaggcttaagactgtatctagtctagttacatttgatactgtttgaccgttttgttatagtagtcttgtgcatgcggttatatgtatgtgattgtgattaaattatgtttcttgagctttctaaacatagtttgaacaatggtgaagctatcattgaaatctttgtgtgcagcattcataagtattttaaacaatagtgaagttattattgagatctttggcttataggcacagttaaagctcttgggaattaaatgtcttggcgaagtacatatgtgtcaactaataagaag

SEQ ID NO: 119 - DNA, 4437 bp, Glycine max
tttgttttccagccctaacaaatgaaaatggcgaaactgattacagagcgacttgatagcaaatagcgacaagacaaaggacacgcacactcattcactcagtcacactatctttgtgtattgtaaaatgtaaacttcgtggagaaggcatcgcaaaccgaatcaatcagacttgacttgactcgtcatgctgcaactctctctcactttatcttccactcttcaatcgcaattcctccacactctcatacacagctacatcactttctattactcttttctaattcttatatgcttataatgtaatgtgaaccttaagttttcaaccatttcttatcaaagggtattgcgagcgagactctgcggttgctgatactttcatgatttgatcacaacgctatcctgcgtttttagtttggttactggactactaagaacatggacttagaaggaagtgaaaagggttcagtggttactcagattagcattggtggatttggcagtgaggtcaaagcaagtgatctcctgaattacttggaggataaaattggacttgtgtacaggtgtaggttgaagacttcttggacccctccagagtcatatccagaatttaaaatcattgatactgcaaagattagaagaacggaagactacaagaaggtggagccccatgcctttgtgcattttgcatctccggaatctgtgactgcagccctgaatgcttcaggttgttgtgatctatttttgaagaatcaaccgttaaaggtcagctgtgggcccaaaaatccatacttcctgaaccaaaggaggagaactacaactccttttaagatgtctgatgtacttgttgaaattgggactttggttagtccaggggagtttttcgtttcttggagaggacctgataaaggtgtaaaatttcttgtggatccctttgatggcatgtgcaggttttgtttcagtagagatactgcattctcattcaaagggatagacaaaaaagcagttataaagtgtgattttcaggtgggattcctggttagagacattaatgagatcaggagatataatgatacatcatatctcgttgttttattacacctagcttcttcgccttgggtttggtacagaactgccgatgatgacattgaagaatcagtaccatttgatttgctggatgatgatgatccttggatcagaaccactgattttactcctagtggggcaattggtcgatgcaatttttatagaatttcaatcccacctcgccatggtgcgaaattgatgaaggccatgctttatctaaaaggtcaaagagtgcaaatacaagaacttccactcaaacagacacttaggacacagaatgaacctgattttggcatgccaatgtcagatgctttcttctatgtacattttcagaaggacattgcttttgacataatgtttttggtcaatgctattgtacataaaggcatattcaatcagcacaggttgtcggataggttttttgaattgctgagaaatcaacctaaggagcttaatgtggctgccctgaagcatttatgttcgtacaagcgcccagtatttgatgcaactaagaggctaaaaatagtccaagaatggttgctcagaaatccaaaactgtatcagatctctaaacagttggatgatattgttgaggttagaagattggttgttactccatcaaaagcctattgtataccacctgaagttgaattgtccaacagggttctcagaaaattcagagaagtttcagattgtttcttgagagtcacctttatggatgaaggcatgcagacaattaatgtgaatgctcttaactattatgttgctcctatagtgaaggaaatcacatcaaactctttctctcaaaagacaaaaatatataaaagggtgaaaactatcttggaagagggattttacttttgtggccgaaaatattcatttttagccttttcatccaatcaacttagagatagatctgcttggttttttgctgaggacaaaataagatgtgatgatatacgaaattggatgggcaagtttaatcagaggaatgttgcaaaatgtgctgctaggatgggacaatgcttctcatctacttatgcaacagttgaagttgctgcaaatgaagttaactccatgctacccgatgttgagaggaacaattacattttctctgatggtattggtgttatcactcatgatcttgcaagggaagttgcagaaaagttgaaattggacaatgtaccctctgcttaccagatcagatatgctggttttaaaggggtcgtggcctcttggccggctaaaggggatggggtcagactttctttgaggcctagtatgaacaagtttcaatctactcataatatcttggagatctgtgcgtggaccaggtttcagcctggttttcttaatcggcagattataacattgctttcggcactgggtgtgcctgatgaaatattttggcaaatgcaggaggcaatgcttttgaagttaaatcaaatgcttgtggatgcagatatcgcttttgatgttctgaccaaatcatgtgctgagcatgggaatgctgcagcaataatgttaagttgtggcttcagtcccctaacagaacctcatcttagaggtatgttaacttctacacgtgctgcgcagctttggggacttagagaaaagtccaggatttttgtatcatctgggcgatggttgatgggtgtcttagatgagttgggtgtgcttgaacaagggcagtgctttgttcaagtgtctacaccttctcttgaaaattgtttctcaaagcatgggtcaagattttcagagacaaagaacctgcatgtagttaaaggttttgtggttatagccaaaaatccttgccttcatccaggagatgtaagagttttggaggcagttgatgcccccgatttacatcatttaaacgattgtcttgttttccctcaaaagggtgacagaccccatacaaatgaagcttctggaagtgaccttgatggggatctatattttgtcacatgggatgaaaatctcattccaccaagtaagaggagctggatacctatggagtatgcccctcaagaaagcaaacttctgacacgtcaagtgatgacccgagacatcatagaattttttgtcagaaacatggtaaatgaacatttgggtgcaatctgcaatgcacatgtggtacatgctgattccagtgactatggtgccttggatgaaaaatgcatacacttggccgagctagcagccactgctgtcgattttccaaagaccgggaagcttgtcactatgcctcctcatctgaagccaaaattgtaccctgatttcatggggaaagagcggcaccagtcttacaggtcaaataaaatcctgggtagactttaccggcatatcaaagatgcttatgatgaagatattgaagctccgtatttgaactttgtgactggcgatataccatatgataaagatcttgaggttccaggatctgctgattttattgctgatgcgtgggagcaaaaatgctcatatgatggccagttgagtgggctaattggtcaatacaaagtgaaaagagaagaggaagttgttactggacagatttggtccatgccaaaatacaacagtaggaagcaaggggagcttaaggagaggctgaagcactcttacagtgccctgaaaaaagaatttagatacactttcgagaagttgaattcggatgttggagaattaagcgaggaagaaaaaaatttgttgtatgagcagaaagcttcggcctggtatcaagtgacatatcatcctgaatgggtgaaaaaatcccttgatctgcaagataaatcctcagagaaccaagaggctgatagtttgggaagtacggtgatgttgagttttccttggattgcagttgattacctagctcgcacaaagataaggcaacgacatcagaggagtggaaattttgactcaactaagccagttgattatctggcaaagtatctatctgaaaggttataattccattgagagcttgctcttggctacaaggccactctgccattctataatattacagtgaacctgtgttgtatacgccttataatgtgtcttcactttagctgctttgattgtaactaggtttgttcccaagccagggaattcctttgcctttggggcttaagactgtatctagtctagttacatttgatacattgaccgtatgttatagtagtagtcttgttgtgctgcggttatttgtatatgattgtgattgtgattagattatgtttttttgagctttctaagcatactttgaacaaaggtgaaactattgttgagatctttgtgtgcagcattcataagttatttcaaacaatagtgaagttattattgagatcttcg

SEQ ID NO: 120 - DNA, 4446 bp, Glycine max
tttgttttccagccctaacaaatgaaaatggcgaaactgattacagagcgacttgatagcaaatagcgacaagacaaaggacacgcacactcattcactcagtcacactatctttgtgtattgtaaaatgtaaacttcgtggagaaggcatcgcaaaccgaatcaatcagacttgacttgactcgtcatgctgcaactctctctcactttatcttccactcttcaatcgcaattcctccacactctcatacacagctacatcactttctattactcttttctaattcttatatgcttataatgtaatgtgaaccttaagttttcaaccatttcttatcaaagggtattgcgagcgagactctgcggttgctgatactttcatgatttgatcacaacgctatcctgcgtttttagtttggttactggaatttacagactactaagaacatggacttagaaggaagtgaaaagggttcagtggttactcagattagcattggtggatttggcagtgaggtcaaagcaagtgatctcctgaattacttggaggataaaattggacttgtgtacaggtgtaggttgaagacttcttggacccctccagagtcatatccagaatttaaaatcattgatactgcaaagattagaagaacggaagactacaagaaggtggagccccatgcctttgtgcattttgcatctccggaatctgtgactgcagccctgaatgcttcaggttgttgtgatctatttttgaagaatcaaccgttaaaggtcagctgtgggcccaaaaatccatacttcctgaaccaaaggaggagaactacaactccttttaagatgtctgatgtacttgttgaaattgggactttggttagtccaggggagtttttcgtttcttggagaggacctgataaaggtgtaaaatttcttgtggatccctttgatggcatgtgcaggttttgtttcagtagagatactgcattctcattcaaagggatagacaaaaaagcagttataaagtgtgattttcaggtgggattcctggttagagacattaatgagatcaggagatataatgatacatcatatctcgttgttttattacacctagcttcttcgccttgggtttggtacagaactgccgatgatgacattgaagaatcagtaccatttgatttgctggatgatgatgatccttggatcagaaccactgattttactcctagtggggcaattggtcgatgcaatttttatagaatttcaatcccacctcgccatggtgcgaaattgatgaaggccatgctttatctaaaaggtcaaagagtgcaaatacaagaacttccactcaaacagacacttaggacacagaatgaacctgattttggcatgccaatgtcagatgctttcttctatgtacattttcagaaggacattgcttttgacataatgtttttggtcaatgctattgtacataaaggcatattcaatcagcacaggttgtcggataggttttttgaattgctgagaaatcaacctaaggagcttaatgtggctgccctgaagcatttatgttcgtacaagcgcccagtatttgatgcaactaagaggctaaaaatagtccaagaatggttgctcagaaatccaaaactgtatcagatctctaaacagttggatgatattgttgaggttagaagattggttgttactccatcaaaagcctattgtataccacctgaagttgaattgtccaacagggttctcagaaaattcagagaagtttcagattgtttcttgagagtcacctttatggatgaaggcatgcagacaattaatgtgaatgctcttaactattatgttgctcctatagtgaaggaaatcacatcaaactctttctctcaaaagacaaaaatatataaaagggtgaaaactatcttggaagagggattttacttttgtggccgaaaatattcatttttagccttttcatccaatcaacttagagatagatctgcttggttttttgctgaggacaaaataagatgtgatgatatacgaaattggatgggcaagtttaatcagaggaatgttgcaaaatgtgctgctaggatgggacaatgcttctcatctacttatgcaacagttgaagttgctgcaaatgaagttaactccatgctacccgatgttgagaggaacaattacattttctctgatggtattggtgttatcactcatgatcttgcaagggaagttgcagaaaagttgaaattggacaatgtaccctctgcttaccagatcagatatgctggttttaaaggggtcgtggcctcttggccggctaaaggggatggggtcagactttctttgaggcctagtatgaacaagtttcaatctactcataatatcttggagatctgtgcgtggaccaggtttcagcctggttttcttaatcggcagattataacattgctttcggcactgggtgtgcctgatgaaatattttggcaaatgcaggaggcaatgcttttgaagttaaatcaaatgcttgtggatgcagatatcgcttttgatgttctgaccaaatcatgtgctgagcatgggaatgctgcagcaataatgttaagttgtggcttcagtcccctaacagaacctcatcttagaggtatgttaacttctacacgtgctgcgcagctttggggacttagagaaaagtccaggatttttgtatcatctgggcgatggttgatgggtgtcttagatgagttgggtgtgcttgaacaagggcagtgctttgttcaagtgtctacaccttctcttgaaaattgtttctcaaagcatgggtcaagattttcagagacaaagaacctgcatgtagttaaaggttttgtggttatagccaaaaatccttgccttcatccaggagatgtaagagttttggaggcagttgatgcccccgatttacatcatttaaacgattgtcttgttttccctcaaaagggtgacagaccccatacaaatgaagcttctggaagtgaccttgatggggatctatattttgtcacatgggatgaaaatctcattccaccaagtaagaggagctggatacctatggagtatgcccctcaagaaagcaaacttctgacacgtcaagtgatgacccgagacatcatagaattttttgtcagaaacatggtaaatgaacatttgggtgcaatctgcaatgcacatgtggtacatgctgattccagtgactatggtgccttggatgaaaaatgcatacacttggccgagctagcagccactgctgtcgattttccaaagaccgggaagcttgtcactatgcctcctcatctgaagccaaaattgtaccctgatttcatggggaaagagcggcaccagtcttacaggtcaaataaaatcctgggtagactttaccggcatatcaaagatgcttatgatgaagatattgaagctccgtatttgaactttgtgactggcgatataccatatgataaagatcttgaggttccaggatctgctgattttattgctgatgcgtgggagcaaaaatgctcatatgatggccagttgagtgggctaattggtcaatacaaagtgaaaagagaagaggaagttgttactggacagatttggtccatgccaaaatacaacagtaggaagcaaggggagcttaaggagaggctgaagcactcttacagtgccctgaaaaaagaatttagatacactttcgagaagttgaattcggatgttggagaattaagcgaggaagaaaaaaatttgttgtatgagcagaaagcttcggcctggtatcaagtgacatatcatcctgaatgggtgaaaaaatcccttgatctgcaagataaatcctcagagaaccaagaggctgatagtttgggaagtacggtgatgttgagttttccttggattgcagttgattacctagctcgcacaaagataaggcaacgacatcagaggagtggaaattttgactcaactaagccagttgattatctggcaaagtatctatctgaaaggttataattccattgagagcttgctcttggctacaaggccactctgccattctataatattacagtgaacctgtgttgtatacgccttataatgtgtcttcactttagctgctttgattgtaactaggtttgttcccaagccagggaattcctttgcctttggggcttaagactgtatctagtctagttacatttgatacattgaccgtatgttatagtagtagtcttgttgtgctgcggttatttgtatatgattgtgattgtgattagattatgtttttttgagctttctaagcatactttgaacaaaggtgaaactattgttgagatctttgtgtgcagcattcataagttatttcaaacaatagtgaagttattattgagatcttcg

SEQ ID NO: 121 - DNA, 3982 bp, Glycine max
ttttttgtaaatccaaagaaaatcaattttttccctaaaaaatcaattttactgcaattgagagaaaaaattgtaagtttacagtttactccttccaaaattcaacaaaattgaacacgagagtcttttctaccaacggagacacagtcactccagtagagagtagcatcatggggacgacaacgacacccctttcccacacggttcgcgtgtccaacatcccccaatccgcgaccgcgaaggacctcctcgacttcctcgaatcgacgttgggttcctccacggtgttcgccctcgaaatcttctccgacaaccccaactggaagtcccgcggcttcgggcgcgtccagttcgagaccctcgacgccaggtcccgcgccctctcgctctcccaactcaaccagctcctcttcaaccgccacttcctccgcctctccgaaaccgactccgacatcatcttccgcccccaacaccgcctccaaaacggcgtcctctacgccggcttcatgctatccgaccaccgcatgagcgtcctcgaatcgtgggagggcattgcggggtgggtcctgccccaaaggaagagacttgacttctgggtgtggcataatggtgactgttacagactcgagtttttgtttgaggatattttggagtctcatggctattgtttgggagaagatgccagactcaatgcccttctcttgaagatgaaatttgggccaaggatttataagaaaaagacagggacagatgtggcagccaattttaggggtgatagataccgttttctgaaggaggattttgaatttctttgggtgcggactactgacttctcgcctctcaagtcaattgggcactctacttcgttttgttgggaaattgtggaggaacatttagcttcggatgtttttacaagtttcccactctacaaggaaaatttgagagatctggctctggaagacagagaagaactctgttctttgacagaagcagttccgcttgtaaaacatgctacgcaatccaagttaccttatgaggctgttttccagctgaattctcttgttcatacccagaaaataagtcttgcttcggtggatgatgaattgattgacttgttagcagacttagatgaagaaactagagctgtggtttttcagaaattgcacaagatgagcttcacttgttatgagcctctcaaatttgtcaagactcaattgcatgtgctgagtaacaagaaaaaaggtctgctgcaatcgccgcagaataggctgacagatagtaatattatgagctgtcatagagccttgattaccccgacaaagatttattgccttggtcccgagcttgaaacctcaaatcatgtggtaaagcactttgcttcacttgcatcagacttcatgaggattacctttgttgaagagaattggaataagcttccaactaatgcagtatcaactggtgtgcaaaagggaatcttttcaaagcctttgaaaactgaaatatataagcggatattgactattcttcgagatgggatcgtaattggctcaaagagatttgagttcctggccttctctgctagtcagctgcgatcaaattctgtttggttatttgcttctaatgacaatctgaaagcagcagatatcagagaatggatgggatgcttcaacaatattcgcagtgtttctaaatgtgcagcgaggatgggtcagttgttcagttcttccatgcaaacttttgaagtggcctctgaagatgtggagatgattccagatattgaagttacttctgatggtgtaagctactgtttctcagatggtattggaaaaatttcccaatgttttgctaggcaagttgctcaaaagctaaacttggatcatactccatcagcatttcaaattcggtatggaggatttaaaggtgtcattgccattgatcgccattcctttaggaagttatcattgcgtagcagcatgcttaagtttgaatccaataataggatgctttgtgtcactaaatggagtgagtcaatgccttgctttctcaatcgagagattatatccctgttgactacgttaggagtaaaagatgaggtacttttggcaatgcaacaggaccaattggatttgttaggaaggatgttgactgatagtaaagcagctttggatgttttggaaagtttaaacggagctgattcaaagagcattctagtgaagatgttgcatgaatttaatgagccaaacagtgagccttacctatcgatgatgcttaaggcttattatgcataccaattatctgacttgaaaagtagatgccgaatatttgttcccaagggtcgggtcttggtaggttgcttggatgaaactggtcttttgaattatggccaagtatttgtccgcataaccgtggcaaaaactagggaaaattttggagatgaaaacctaaggaaagtggatggggatgatagcacacgtataatagtgggaaaggtggtggtcacaaaaaatccttgtcttcacccaggagacatcagagtccttgatgctatctacagtaaagaattagaggaaaacggtttgagggattgccttgtatttccacaaaaaggacataggcctcatccaaatgaatgctctggaggtgatcttgatggagatttgtttttcttaagttgggacaaagatctaatcccatgtcaaactgaggctccaatggactatacaggaaggaggcctcgtataatggaccataaggtgaccctagaggaaatccaacaattctttgttgattacatgatcaatgatactttgggtgctatctctactgcacatctcgttcatgctgaccgtgaacaagataaggccaagagtagaaaatgtctggaattggcagagcttcattccatggctgttgactttgcaaagactggagcacctgctgcaatgcctagagttctgaaaccaagagagtttccagatttcatggagagagttgacaagcctatgtacatctccaagggggtactgggaaaactttatcatgccataattgagtcacaaatgcaaataagatatagctttgtgtggtcagagaagcatgctgaagaagcatatgatcgtagccttgaagtgaatggttttgaggccttccttgagacagcatcaactcacaaagaaatgtatgcagagaagatgagcagtttaatggacttttatggtgcagagaccgaggatgaaatgctacttggtaacgtgcaaaaccgtgcttcatatttgcagcgtgataacaggagatatggtgatatgaaggatcggattctgctctcagtgaagaatcttcagcgtgaagctaaagaatggtttgaaactagttgccaaccgcgtgaatataagcctatggcatctgcatggtatcatgtgacctatcaccgcagccattattgccaggaaagcccatgttttctaagctttccatggatagttggtgacattttgctgcaaataaggtctgtgaactcctttgttaacagatgaattctttctctaatgatgtgcatttatttttgaaaaataaaataaaatctgaagccgtttgtggtggataaatgtcaatgcagacgttgattgaaggtaccaccatgtctaccagattttccttttgcaaaatattattgttattattattggcattataaatatttactagctgtacatgcgatgttgatactagtgggttgagttactccaaaaccaactcaccaaaattccgggtttgtgggacctggcttacaccctgtcaattactagtattagttcgagtttagtaaagtcaaatgaaaacaagtattgaaagagtgtctcactttcgtatctcaagtcatcatataaatttcaaatcctacacattataccacctatgaggagacaaagtttcttgggaagtaaattcagattattctgagattgtacaaatagaacatatt

SEQ ID NO: 122 - DNA, 3826 bp, Glycine max
cgaaaatttgccaggttttgtttgtgtttggaagaaaactgaacacatcacgagacccttttccaccaacagtcgctgtgcctgtgttacttacgctctcagtcactctagtagggagcatcatcatggggacgacaacgacgacaaccctttccaacacggttcgcgtgtccaacatcccccaatccgcgaccgcgaaggacctcctcgacttcctcgaatcgacggtgggtccctcgacggtgttcgccctcgaaatcttctccgacaaccccaactggaagtcccgcggcttcggccgcgtccagttcgagaccctcgacgccaggtcccgcgccctctcgctctcccaactcaaccacctcctcttccaccgccacttcctccgcctctccgaaaccgacgccgacatcatcttccgcccccaacaccgccttcataacggcgtcctctacgccggcttcgtgctctccgaccaccgcatgagcgtcctcgaatcctgggagggcgtcgcgggctgggtcctgcccctaaggaagaggctggacttctgggtgtggcataatggcgactgttacagactcgagtttttgtttgaggatattttggagtctcatggctattgtttgggagaagatgccaaactcaatgccctcctcttgaagatgaaatttgggccaaggatttataagaaaaagacgggggcagatgtggcagccaagtttaggggagatagataccgtttttgtaaggaggattttgaatttctttgggtgcggactaccgacttctcacctctcaagtcaattgggcactctacttcgttttgttgggaaattgtggaagaacatttagctttggatgtttttaaaagtttcccactctacaaggaaaatttgagagatctggctctggaagacggagaagaattctgttcttcgacagaagcagttccgcttgtaaagcgtgcttcacaatccaagttaccttatgaggctcttttccagctgaattctcttgttcatacccagaaaattagtcttgcttcggtggatgatgaattgattgacttgttagcaggcttagatgaagaaactagagctgtgatttttctgaaattgcacaagatgagcttcacctgttatgagcctctcaaatttgtcaagactcaattgcatgtgctgagtaacaagaaaaaaggtctgccacaatcgtcgcagaaaaggttgacagatagtaacattatgagctgtcatagagccttgattacccccacaaagatttattgccttggtcctgagcttgaaacctcaaatcatgtggtaaagcactttgcttcgcatgcatcggacttcatgaggattacctttgtcgaagagaattggaataagcttccaactaatgcagtatcaactggtgtgcaaaagggactcttttcaaagcctttgaaaactgaaatatataagcggatattgactattctccgagatgggattgtaattggctcaaagagatttgagttcctggccttctctgctagtcagctgcgatcaaattctgtttggttgtttgcttctaatgacaatctgaaagcagcagatatcagagaatggatgggatgcttcaacaatattcgcagtgtttctaaatgtgcagcgaggatgggtcagttgttcagttcttccatgcaaacttttgaagtggtctctcaagatgtggagataattccggatgttgaagttatttctgatggtgtaagctattgtttctcagatggtattggaaaaatttcccaatcttttgctaggcaagttgctcaaaagctaaaattggatcatactccatcagcatttcaaattcggtatggaggatttaaaggtgtcattgctgttgatcgccgttcctttaggaagttatcattgcgtagcagcatgcttaagtttgaatccaaaaacagcatgctttgtgtcactaaatggagtgagtcaatgccttgctttctcaatcgagagattatatccctgttgtctacattaggagtaaaagatgaggtgcttttggcaatgcaacatgaccaattggatttgttaggaaggatgctgactgatagtaaagcagctttggaagttttggaaagtttaaatggagctgattcaaagagcattctagtgaagatgttgcatgaatttaatgagccaaacagtgagccttacctatcaatgatgctcaaggcttattatgcataccaattatctgacttgaaaagtagatgccgaatatttgttcccaagggtcgggtcttggtaggttgcttggatgaaactggtcttttgaattatggccaagtatttgtccgcataaccgtgacaaaaactagggaaaaatttggagatgaaaacctaaggaaagtggatggggatgataacacatgtataatagtgggaaaggtggtggtcaccaaaaatccttgccttcacccaggagacatcagagtccttgatgctatctacagtgaagaattagaggagaagggtttgagggattgccttgtatttccacaaaaaggacataggcctcatccaaatgaatgctctggaggtgatctcgatggagatttgtttttcataagttgggacaaagatctaatcccatgtcaaactgaggctccaatggactacacaggaaggaggccccgtataatggaccataaagtgaccctagaggaaatccaacaattctttgttgattacatgatcaatgatactttgggtgctatctctactgctcatctagttcacgctgaccgtgaacaagataaggccaagagtagaaaatgtctggaattggcagagcttcattccatggctgtcgactttgcaaagactggagcacctgctgcaatgcctagagttctgaaaccaagagagtttccagatttcatggagagggttgacaagcctatgtacatctccaagggggtactgggaaaactttatcgcgccataattgagtcacaaatgcaaataagatatagctttgtgtggtcagagaagcatgctgaagaagcatatgaccgtagccttgaagtgaatggttttgaggccttccttgagacagcatcaactcacaaagaaatgtatgcagagaagatgagcagtttaatggacttctatggtgcagagaccgaggatgaaatgctacttggtaacttgcaaaaccgtgcttcatatttgcagcgtgataacaggagatatggtgatatgaaggatcggattctgctctcagtgaagaaccttcagcgtgaagctaaagaatggtttgaaactagttgcgaaccgcatgaatataagcctatggcatctgcatggtatcatgtgacctatcaccccagctattattgccgggaaagcccatgctttctaagctttccatggatagttggtgagattttgctgcaaataaggtctgtgagcaaaggagttcacaaatgaaggcttcctctaatgctgtgtgcatttttattttgaaaaaagaagaaaaaatctgaagccgtttgtggtggataacatgtatatgcagatgttgattgaaggtaccaccttgtctgcgagagtttccttttgcaaaatattattgttatcaatatttggcattataaaaatttactagccgtatatgtgatgttgatgccagtggcttcatctataaccaggttcagcgaatcaagtgggttgggttactccaaaaccgtttcaccaaaattccgggtttgtaggatctggttacaccctgttcgagtttattaaagtcaatttaaaacgagtat

SEQ ID NO: 123 - DNA, 3311 bp, Glycine max
ggtacgaatgtggggatgggagggacaagaaactttaagtgtgactaacaaagctctaaatcaaggatttgtcctatagtcggtcaaaaagactgaagcttgtgagggatatcttaggatcctgttagggtgtcaaaagccttacatacgatgaaatttgggccaaggatttataagaaaaagacgggggcagatgtggcagccaagtttaggggagatagataccgtttttgtaaggaggattttgaatttctttgggtgcggactaccgacttctcacctctcaagtcaattgggcactctacttcgttttgttgggaaattgtggaagaacatttagctttggatgtttttaaaagtttcccactctacaaggaaaatttgagagatctggctctggaagacggagaagaattctgttcttcgacagaagcagttccgcttgtaaagcgtgcttcacaatccaagttaccttatgaggctcttttccagctgaattctcttgttcatacccagaaaattagtcttgcttcggtggatgatgaattgattgacttgttagcaggcttagatgaagaaactagagctgtgatttttctgaaattgcacaagatgagcttcacctgttatgagcctctcaaatttgtcaagactcaattgcatgtgctgagtaacaagaaaaaaggtctgccacaatcgtcgcagaaaaggttgacagatagtaacattatgagctgtcatagagccttgattacccccacaaagatttattgccttggtcctgagcttgaaacctcaaatcatgtggtaaagcactttgcttcgcatgcatcggacttcatgaggattacctttgtcgaagagaattggaataagcttccaactaatgcagtatcaactggtgtgcaaaagggactcttttcaaagcctttgaaaactgaaatatataagcggatattgactattctccgagatgggattgtaattggctcaaagagatttgagttcctggccttctctgctagtcagctgcgatcaaattctgtttggttgtttgcttctaatgacaatctgaaagcagcagatatcagagaatggatgggatgcttcaacaatattcgcagtgtttctaaatgtgcagcgaggatgggtcagttgttcagttcttccatgcaaacttttgaagtggtctctcaagatgtggagataattccggatgttgaagttatttctgatggtgtaagctattgtttctcagatggtattggaaaaatttcccaatcttttgctaggcaagttgctcaaaagctaaaattggatcatactccatcagcatttcaaattcggtatggaggatttaaaggtgtcattgctgttgatcgccgttcctttaggaagttatcattgcgtagcagcatgcttaagtttgaatccaaaaacagcatgctttgtgtcactaaatggagtgagtcaatgccttgctttctcaatcgagagattatatccctgttgtctacattaggagtaaaagatgaggtgcttttggcaatgcaacatgaccaattggatttgttaggaaggatgctgactgatagtaaagcagctttggaagttttggaaagtttaaatggagctgattcaaagagcattctagtgaagatgttgcatgaatttaatgagccaaacagtgagccttacctatcaatgatgctcaaggcttattatgcataccaattatctgacttgaaaagtagatgccgaatatttgttcccaagggtcgggtcttggtaggttgcttggatgaaactggtcttttgaattatggccaagtatttgtccgcataaccgtgacaaaaactagggaaaaatttggagatgaaaacctaaggaaagtggatggggatgataacacatgtataatagtgggaaaggtggtggtcaccaaaaatccttgccttcacccaggagacatcagagtccttgatgctatctacagtgaagaattagaggagaagggtttgagggattgccttgtatttccacaaaaaggacataggcctcatccaaatgaatgctctggaggtgatctcgatggagatttgtttttcataagttgggacaaagatctaatcccatgtcaaactgaggctccaatggactacacaggaaggaggccccgtataatggaccataaagtgaccctagaggaaatccaacaattctttgttgattacatgatcaatgatactttgggtgctatctctactgctcatctagttcacgctgaccgtgaacaagataaggccaagagtagaaaatgtctggaattggcagagcttcattccatggctgtcgactttgcaaagactggagcacctgctgcaatgcctagagttctgaaaccaagagagtttccagatttcatggagagggttgacaagcctatgtacatctccaagggggtactgggaaaactttatcgcgccataattgagtcacaaatgcaaataagatatagctttgtgtggtcagagaagcatgctgaagaagcatatgaccgtagccttgaagtgaatggttttgaggccttccttgagacagcatcaactcacaaagaaatgtatgcagagaagatgagcagtttaatggacttctatggtgcagagaccgaggatgaaatgctacttggtaacttgcaaaaccgtgcttcatatttgcagcgtgataacaggagatatggtgatatgaaggatcggattctgctctcagtgaagaaccttcagcgtgaagctaaagaatggtttgaaactagttgcgaaccgcatgaatataagcctatggcatctgcatggtatcatgtgacctatcaccccagctattattgccgggaaagcccatgctttctaagctttccatggatagttggtgagattttgctgcaaataaggtctgtgagcaaaggagttcacaaatgaaggcttcctctaatgctgtgtgcatttttattttgaaaaaagaagaaaaaatctgaagccgtttgtggtggataacatgtatatgcagatgttgattgaaggtaccaccttgtctgcgagagtttccttttgcaaaatattattgttatcaatatttggcattataaaaatttactagccgtatatgtgatgttgatgccagtggcttcatctataaccaggttcagcgaatcaagtgggttgggttactccaaaaccgtttcaccaaaattccgggtttgtaggatctggttacaccctgttcgagtttattaaagtcaatttaaaacgagtat

SEQ ID NO: 124 - DNA, 4136 bp, Glycine max
gggcgaggacacatgcgtctttccgttacgagaaagtatttcacttcacttgggagttgggacaagtgaggaagtcaagagttggttctttaccccatatacccctccctatcacgccagaaacatttcatttctcttccagcaaatcgaaacggctcgcgttgttcacagtcacactctcactctcacactctctcactcacactcacactcacaccattgtatagaagattagagagagagaaccctaaactaaaaccctaaaattccattgcagcaagcaaaggcattgatcgatctgcatgggtcacgtaggttccagcaaggacggcaccgaggctgggccttccgccgccgcgatgggcatcgacgacgacgaagacatcgacctcggcgacgtcgatctcgacccgaccaacgccgaaatcctcgaagagctcggtgaagacattgtgaaatactggtgcaagaaagcgtcgatgctcttcttcaacgagtacggtctgatcagccaccagatcaactcctttaaccacttcatccacacaggcctccaaaaaaccttcgaatccttcggagacctagtcgtaacgcccgggttcgacccttccaagaagggagaaaacgaacacttccgttacgcctccgttaagttcggcaatgtgaagctcgataaacctatgttctggggcggtgaagggaacgcgcaggagtttaagatgcttcccagacacgcgagaatccagaggatgacctacgcttccaaagtcaaaatccaagttaaagttcaggtgtatgttccgaagaaggtacggagtgataagttcaagactgggaaagcggaattccttgacagggaggttatgaaggaagacgagagggaaatcatcattgggagattgccagtcatggtcaagtctgatttatgctggatgaaagaggcggagaaggaggatgatgaatttgaccatggaggttattttatcgttaagggtgcagagaagacttttattgcacaggagcaactgtatttaaagaggctatgggttatgaatagtccaggttggatgattgcctacaagtcacagatgaagagaaacaggatggttattaaactggtaggaaattccaggggtgaagaagtggagaatggggacatgtctcttgctgtatattttttgtctgttgaggttcctgtgtgggtactgtttttcgctctcggtgtctcatctgacaaagagattgtagatctcattggttgtggcaatgatgatgtcagaattcagaatattctctttgcatctgttcgggatgctgatgagaaatgtggagcatttcgaagaggtaggcatgcagttcaatatttagaaaaatgtgtaaaaagtgttcaatttccaccttcggagtctatgcaggagtgccttgaaatgtatgtcttccctggaattagtggtttgaatagaaaggcgcgcttccttgcatatatggtgaaaggtctcttgctggcttatactggccgccgaaaatgcgacaacagggatgattttcgaaataagaggcttgaattggccagtgagcttcttgaccgtgagttgaaagtgcacattgcacatgcccggaagcgaatggcaaaagctttgcagagagacctttatggagatagggatgtacgcccaattgagcattatctcgacgcgtccataattacaaatggcttgcaaagggcattttcaacaggagcgtggtctcatccatacaagaggatggaaaggatctcaggtgtggttgcaaatgttgggcgcactaatcccttacaaaccatggctgagttaagaagagcgaggcagcaggtccagtacacaggaaaagttggggatgctagatatccgcatccttctcactggggcaaggtttgtttcctctctaccccagatggtgaaaattgtggactagtaaaaaatttggctgtcacaggattagtaagtactgatgtatcggcagtatctgaatatatactgcctaaattgctggattgtggaatggaagaacttgttgatgatacttccactcatcttgggaacaaggacaaagttctcctaaatggcgattgggttggagtgtgtcctgattccagttcatttgtggcagagctacgaagcagaagacgtagaaatgaactgcctcatcaggtggaaatcaagagagaccaatctcaacatgaagtgcgcatatactcggatgcaggaaggattctacgtcctcttttggtggttggtaatctactcaagattaaaggatttaaatcagactgtaactctttccagtctctattggataaaggtgtgattgagctgattggaccggaagaagaggaagactgttgtacagcctggggtgttgagtatttatttggaaaagaaggaaaacgatctgtaaagtacactcattgtgaacttgatatgtcattcttattgggtttaagctgttcacttgtaccatttgctaatcatgaccatgcgaggagggtactctaccagtctcagaagcactcctcacaggcaattggcttttctacaacaaacccgaacattagagttgatactttgtctcaccagttacactatccccaaaagcccctttttcgaacaatggcttcagattgtcttggaaaaccagacaattcacttggtcaaaataaaataagtaaaatacctccaaaggcagaattctataatgggcagaatgcaattgtggctgttaatgtacatctgggatacaatcaagaggattcccttgtgatgaaccgtgcttcactgcagcgtggtatgttcaggtctgagcacataaggagttacaaatctgaaatcgataataaggaatcttcagataagaagcgaaaacctgaagacattgtaaattttgcaaagctacaaagtaaaattggccgagttgatagccttgatgatgatggctttccatatgttggtgctaatttgcagagcggtgatattattattgggaagggtgctgaatctggtgcagacaatagtgtaaagttaaagcacactgaaaggggttatgtgcaaaaggttgtgctgtcttcaaatgacgaagggaaaaattttgctgtggtttcattaagacaggttcgaagtcccgttcttggagacaagttctccagtatgcatggacaaaagggagttttgggatttctggagtctcaggaaaattttcctttcacaagacaaggcattgttcctgatattgtcataaatccacatgcatttccctcacgacaaactcctgggcaactcctagaggctgctttaggaaaggggattgcttgtggtggcatactgagacaagctacgcctttctccacaccttctgttgatgccattactgaacagcttcacagagctgggttttcaagatggggaaatgagagggtatacaatggaaggactggtgagatggttcgatcactcatttttatgggaccaacattttaccaacgtctgcaccatatgtctgaagacaaagtgaaattccggaacactggtccagttcacccgttgacccgacagcctgtagctgacagaaaacgatttggaggtatcaagttcggtgagatggagcgtgattgcctaatagctcatggtgcatcagccaacctgtatgaacgcctgtttacactcagtgactcctctcagattcatatctgcagcaaatgcaaaaatgttgcaaatgtgatcttgcggcctgtctctggtggccggaaaatacgaggaccttattgccgccactgtgaatctgcggatgacattgtggtggctcatgtcccgtatggagcaaagttattatgccaggagctctttagcatgggcataaatcttaaatttgaaacccaactttgctagacaaacactaatggtctcttttgttcatttctcccttaaatgaatttcagtgtagatattactttcgttcgccgatgtttctttgaatgcctggcaattagaagtactggatctcttttatcttgttactgatgcatgtttctctattatttacgggctagttagtgtatccttgtgaaaagttgaagacaagaaatttaaaaatgattattaaca

SEQ ID NO: 125 - DNA, 3780 bp, Glycine max
atgggtcacgtaggttccagcaaggacggcaccaaggtggggctgtccgctgctgcgatggacatcgacgacgacgacgacgacgacgacgacgacctcggcgacgtcgacctagaccctacgaactccgaaatccttgaagaactcggcgaagacatggtgaaatactggtgcaagaaagcgtcgatgctgttcttcgacgagtacggtctgatcagccaccagatcaactcctttaaccacttcgtcgccatcggcctccaaaacaccttcgactccttcggagacctagtcgtaactcccggttttgacccctccaagaagggagaaaacgaacacttccgttacgcctccgttaagttcggcaaggtgaagctcgacaagcccatgttctggggcggtgaagggaatgcgcaggagttcaagatgcttccgagacacgcgagaatccagaggatgacctacgcttccaaagtcaaaatccaagttaaagttcaggtgtatgttccgaagaaggttcggagtgataagttcaagactgggaaagaggagttccttgatagagagattatgaaggaagacgagagggaaatcatcattgggagattgccagtcatggtcaagtctgatttgtgctggatgaaagacgcggaaaaagatgatgatgaatttgaccatggaggttattttatcgttaagggtgcagagaagacttttattgcacaggagcaactgtatttaaagaggctatgggttatgaacagtccagggtggatgattgcctacaagtcacagatgaagagaaacaggatggttattaaactggtaggcaattccaggagtgaagaagtggagaatggggacatgtgtcttactgtatattttttgtctgttgaggttcctgtgtgggtactgttttttgctctcggtgtctcatctgacaaagagattgtagatctcattggttgtggcaatgatgatgtcagaattcagaatatcctctttgcatctgttcgtgatgctgatgagaaatgtggagcatttcgaagagttaggaatgctgttcaatatttagaaaaatgtgtaaaaagtgttcaatttccaccttcggaatctatgcaggagtgccttgaaatgtatgtctttcctggaattagtggtttaaatagaaaggcgcgcttccttgcatatatggtgaaaggtctcttgctggcttatactggccgcagaaaatgcgacaacagggatgattttcgaaataagaggcttgaattggccagtgagcttcttgaccgtgagttgaaagtgcatgttgcacatgctcggaagcgaatggcaaaggctttgcagagagacctttatggagatagggacgtacgcccaattgaacattatcttgacgcgtccataattacaaatggcttgcaaagggcattttcaacaggagcgtggtcacatccgtataagaggatggaaaggatctcaggtgtggttgcaaatgttgggcgcactaatcccttgcaaaccatggctgagttaagaagagcaaggcagcaggtccagtacacaggaaaagttggggatgctagatatccgcatccttctcactggggcaaggtttgtttcctcactaccccagatggtgaaaattgtggactagtaaaaaatttgtctgtcacaggattagtaagtactgatgtaactgacgtaactgaatctatactgctaaaattggtggattgtggaatgcaagaacttgttgatgatacttccactcatcttggcagcatggacaaagtcctcctaaatggtgattgggttggagtgtgtcccgattccagttcgtttgtggcagagctacgaagtagaagacgcagaaatgagctgcctcatcaggtggaaatcaagagagaccaatctcagcatgaagtgcgcatatactctgatgcaggaaggattctacgtcctcttttggttgttggtaatctactgaagattaaaggatttaaatcagaccgttactctttccagtctctattggacaaaggtgttattgagctgattggacctgaagaagaggaagactgttgtactgcctggggtgttgagtatttatttggaaaagaaggaaaacgatctgtaaagtacactcactgtgaacttgatatgtcattcttattgggtttaagctgttcacttgtaccatttgctaatcatgaccatgcaaggagggtgctctaccagtctcagaagcactcctcacaggcaattggcttttctacaacaaacccgaacattagagttgatactttgtctcaccagttacactatccccaaaagcccctttttcgaacaatgacttcagattgtcttggaaaaccagaccattcactgggtcaaagtaaaatacctccaaaggcagaattctataatgggcagaatgcaattgtggctgtcaatgtacatctgggatacaatcaagaggattccctggtgatgaaccgtgcttcactgcagcgtggtatgttcaggtctgagcacataaggagttacaaatctgaaattgacaataaggaatcttcagataagaagcgaaaacctgaagacattgtaaattttgcaaagctacaaagtaaaattggccgagttgatagccttgatgatgatggctttccatatgttggcgctaatctccaaagcggtgatattattattgggaagtgtgctgaatccggtgcagacaatagtgtaaagttaaagcacactgaaaggggttatgtgcaaaaggttgtgctgtcttcaaatgacgagggtaaaaattttgctgtggtttcattaagacaggttcgtagtccagttcttggagacaagttctccagtatgcatggtcaaaagggagttttgggatttctggagtctcaggaaaattttcctttcacaagacaaggcattgttcctgatattgtcataaatccgcatgcatttccctcacgacaaactcctgggcaactcctagaggctgctttaggaaaggggattgcttgtggtggtatactgaaacaagctacgcctttctccactccttctgttgatgccattactgaacagcttcacagagctgggttttcaagatggggaaatgagagggtatacaatggaaggactggtgagatggttcgatcactcatttttatgggaccaacattttaccaacgtctgcaccatatgtctgaagacaaagtgaaattccggaacactggtccagttcacccgttgacccgacagcctgtagctgacagaaaacgatttggaggtatcaagttcggtgagatggagcgtgattgcctaatagctcatggtgcatcagccaacctgtatgaacgcctgtttacactcagtgactcctctcagattcacatctgcagcaaatgcaaaaaagttgcaaatgtgatcttgcggccagtgtctggtggacggaaaatacgaggaccttattgccgtcactgtgaatctgcggatgacattgtggtggcccatgtcccgtatggggcaaagttattatgccaggagctctttagcatgggcataaatcttaaatttgaaacccaactttgttagacaacactattagtgtctcttttgtacatttcctttaacttaatgaattcagtgtagatatcactctcgttcgtggatgtttctttgaatgccagcgagttaggagtactgcatgatatcctgagcttaacttgaatgtcattgcatctcttttatcttgtt

SEQ ID NO: 126 - DNA, 5351 bp, Glycine max
cttttatcaaggcctgggtctacacaagtgccccttctcaactcggcgtttgtctcgtggtcgcgtggaaagtgaccggcggtgttccattttgctattcattcgtctttactttactgcgctttctctctcactcactcactccaattcgttcttgggtttcgattttggtcttcgcagagcattgccgcgtagctcgcacacacacacaccaccagtgtctgcgttcgtgctggttaagtcgatcattcgttcttttcactcaaattacttgaaattttctgccgagtgcaaggttaccaagtttgatggatgatgaccttttccagaggaacaaaacaccatctggtgtcataaaagcgataaagtttgatgtcttaactgaagaagatatagagaatatcgctgttttggagataaatgcagccgggcaggtcactgggtcaagtttgggtttcccaaatgcatctgatgagtgtgccacatgtggctctaaagacaaaaggttctgtgaaggtcattttggagtaatcaaatttcctactcccatactccatccatattttatgtcagaaattgcgcacatcttgaacaagatttgccctgtttgtaaatctattcgtcacaaatccaagggtgttcgattgatctatggaaccaagcggtctaatgattgcaattattgttctgcgtatccatcaatgaaattcagagtttcttccaacgatctctttagaagaactgcaattattgttgaagtaaaggcttcaaagaaaactttggggacagaaatacctgctgattattggaattttattccttgtgatgctcaacaagaagaaaactatgtaaatagaagggttttatctcctgcacaggttcttaatttgttgaatggtgttgatccagactttattgaaaaatatattccaagaaagaatttgctgtatcttaattgcttcccggtgactccaaattgtcatcgtgtgacagaagttccttatgcaatttctagtggaagccgattgagttttgatgacaggactcgatcttgtaagaaattggttgatttcaggggtacgcccaatgaattaagttctcgtgttttggattgcttgaggatctctaagctaaatcccgataaaacaccaaatagtatttttgctgatatccagcaaagaaagattggagaaaatgcttgcaattcttctggtttaagatggataaaagatgtggttcttggaaaacgcaatgatagttcattacgtactgtggttgttggtgatccagaccttgagcttagtgaagttggtataccttgtcatattgctgaaagtttgcaggtttctgagtatgtgaataggcagaatagggagaagctgctttattgttgtgagctacgcttgttagagaaggggaaaatagatgtctgcagaaatggtagtaaagttcatctgtataaaaaggaagatctacaaataggtgacaaaatttataggcctcttgctgatggggataaagtgctgataaataggcccccttccatacatcaacattctatgattgctctcacagttagggtccttccaatatcttctgtagtgtgtattaacccactctgttgttccccattacgtggggattttgatggtgattgccttcacgggtatattccacaatcagttactgcaagaattgagcttaatgagctggttgctttagataggcaattgattaacgggcaaagtggtagaaatctgctttcactttcccaggatagtttgactgctgcttatttgctaatggaagatggggtccttttgaatgtttatcaaatgcagcagcttcaaatgctttctatttctgacaaaagattaatacctcctgcagttgttaaagctccttcaagtaatagctcactttggagtgggaagcaaatattcagcatgctcttgccttatgattttgactattcttttccttcagatggtgttgttgttagtgatggggagcttgtatcttcttctgaggcttctggttggttacgcgattctgactacaatgttttccagagtcttgtggaacattatcaagggaagactctaaactttttgtatacagcgcaaaaagttctgtgtgagtggctgtctatgacaggttttagtgtttcactctcagatttgtacctttcttctgattcctatgcacggaaaaacatgatagaggaaatcttttatggcttacaagatgcagagcaggcttgtaatttcaagcagctattgttggattgttattgtgattttctgtcaggaagtatccaagagagtgaaaatgctatcactgttgatgctgatcgtctgaattatgaaagacaaatatctgctgctctcagtcaagcgtcagttgatgcttttaggcaagtttttcgcaatattcaaagtttagctgacaaatatgcatgtaaggacaatgctttccttgcaatgtttaaggctggaagcaagggtaatttgttgaaattagttcaacattccatgtgccttggcatgcaaaattctctggtccgcttgtcatacagattaccccgtcatctttcatgtgctgcttggaatagtcaaaagtggcttgattcaatccagatgtcttctggtacccttgaatctgttcagtcttacattccatatgctgtggttgaaagctcatttttaactgggttgaatccacttgaatgttttgttcattcagtgacaaatcgtgatagctctttcagtgaccatgcagaccttcctggaacactgacacgtagacttatgttcttcatgcgtgatttgcatgatgcatatgatggaactgtgagaaatttatatggtaatcaacttattcagttttcttatgatattgaagaggactcttcatgtgataaaggtttccaagagtatgctataggtggtgaaccagttggggcaatttctgcttgtgcaatttctgaagctgcatacagtgctttgggtcaaccagttagtctactcgaaacatcacctttgctgaatttgaaaaatgttttggagtgtggttcaaggaaaagaaatggtgatcagactgtgtctttatttttgtctgaaaagcttggtaaacagagacatgggtttgaatatgcagctttagaagtcaagaattatttggaaagattgttgttctcaaacattgtttctacagtgatgataatattcaccccacatgacggcagcagccaagaaaaatacagtccttgggtctgccactttcatttagacaaggaaattgtaactagaagaaaattgaaagtgcattctatcattgactctctctaccagagatattactcacagagaaaagactcaaaagtctgttttaccaatttgaaaatttcaagcaagaagtgttctgctgattccatggctaaggaaggtgaagacacttctatagataaaaaagagggtgatgattgcatcacagtcacaattgttgaaaactctaagaatcctatacaactggattctgttcgggatttggtgataccttttcttctaggaacagcaataaaaggatttctggatgtcaagaaggttgatgttctctggaataatcagtcaaaagtaaaaaattcttgtaatggtttttctggtgaactgtacttgagggtaactttgtccagcgagggtagcagaggaagattttggggtgtactcctaaatctttgtcacaagataatgcatataattgactggacacgcagtcatccagataacatcaatcatttctcatcagcatatggaattgatgcagggtggcaatactttttcaatagtttggcatctgcaacatctgataccggcaagtccatccttcctaagcatttgtgtcttgttgccaatagtctgtcatgtagtggagagtttgtgggattaaatgctaaaggcatggcactacaaagaaaacatgcgtcagtttcatcaccattcgtgcaagcatgctttgcgaatccaggtagttgctttataaaagctgctaagtctggagtcactgataatctccagggcagtctggatgcgttggcttggggaaactgtctatctatggggacaagtggaatgtttgatatcatatattcagagaaggtagctaagtctgggaatgtgtatgagctgctagaagccagttttgacaagccgaacaataaagctggtactcatttgcacaaatattcatctgacaaatgcggttctgagtttaggcataaaaatggttatgccttgaaagagggaaaacagtggaaaaccattttaagaaattttgtgacggtaaatgatatccagaagctgacttttgcttcgaggtgcatattgaacaagtattcaattgatgagctgctaagtgagagtgacaggtcaacaatgctaagggttttgaattttcatcctcgtaaaagtgagaagtttggcattggaccacaggacattaaggttggatggcatccaaaatacaaggatagccggtgcttccatatagtaagaattgatgggacggttgaagatttttcataccgcaaatgcattcttggtgctcttgatatcgttgatccaaaaaagtcaaagatccaggagaaaaaatggtcaggacatggtaacacgtaatatctatgcatgtccaagcataataagtgactatcatttgatctggtgacagtcacagactataaaaatagagtcggaagggtaatagtagtgccacaactctacaatcacaaaaagcaacgttgtttttctacctttgatttagaaggatgtccggaatcagtggtagagagcactgttctcttttgcgagtttagagttatgttattggcattactccagctaattggtggaaatagtttgcagccttcttttgttgtattttactatcttcaaggctagactgggtgatagcttactcaaatgttgctcgatggatttagaggcagagcagcgaatccagcgtaaagtcataacattttgaaagaagaaaggagaagatgcatagaagggaggatacaagatggaacaatgatagtatatattttttcaatatgaacaaattaaattttattttatatgttaaaagatggcgtgggttcttaccctgagcttctttttgcttcttccactaatactttatttgccaacgattacgtaaggcaaagaaagatctagtggaagcagcaacgagaagcttgtaaagacttatacccccagaccatttgtattgatgcggcagttaaatataagatatgtttaggttatgccgggttcaaatgtcatgcgtatctctgc

SEQ ID NO: 127 - DNA, 5252 bp, Glycine max
cttttatcaaggcctgggtctacacaagtgccccttctcaactcggcgtttgtctcgtggtcgcgtggaaagtgaccggcgagcattgccgcgtagctcgcacacacacacaccaccagtgtctgcgttcgtgctggttaagtcgatcattcgttcttttcactcaaattacttgaaattttctgccgagtgcaaggttaccaagtttgatggatgatgaccttttccagaggaacaaaacaccatctggtgtcataaaagcgataaagtttgatgtcttaactgaagaagatatagagaatatcgctgttttggagataaatgcagccgggcaggtcactgggtcaagtttgggtttcccaaatgcatctgatgagtgtgccacatgtggctctaaagacaaaaggttctgtgaaggtcattttggagtaatcaaatttcctactcccatactccatccatattttatgtcagaaattgcgcacatcttgaacaagatttgccctgtttgtaaatctattcgtcacaaatccaagggtgttcgattgatctatggaaccaagcggtctaatgattgcaattattgttctgcgtatccatcaatgaaattcagagtttcttccaacgatctctttagaagaactgcaattattgttgaagtaaaggcttcaaagaaaactttggggacagaaatacctgctgattattggaattttattccttgtgatgctcaacaagaagaaaactatgtaaatagaagggttttatctcctgcacaggttcttaatttgttgaatggtgttgatccagactttattgaaaaatatattccaagaaagaatttgctgtatcttaattgcttcccggtgactccaaattgtcatcgtgtgacagaagttccttatgcaatttctagtggaagccgattgagttttgatgacaggactcgatcttgtaagaaattggttgatttcaggggtacgcccaatgaattaagttctcgtgttttggattgcttgaggatctctaagctaaatcccgataaaacaccaaatagtatttttgctgatatccagcaaagaaagattggagaaaatgcttgcaattcttctggtttaagatggataaaagatgtggttcttggaaaacgcaatgatagttcattacgtactgtggttgttggtgatccagaccttgagcttagtgaagttggtataccttgtcatattgctgaaagtttgcaggtttctgagtatgtgaataggcagaatagggagaagctgctttattgttgtgagctacgcttgttagagaaggggaaaatagatgtctgcagaaatggtagtaaagttcatctgtataaaaaggaagatctacaaataggtgacaaaatttataggcctcttgctgatggggataaagtgctgataaataggcccccttccatacatcaacattctatgattgctctcacagttagggtccttccaatatcttctgtagtgtgtattaacccactctgttgttccccattacgtggggattttgatggtgattgccttcacgggtatattccacaatcagttactgcaagaattgagcttaatgagctggttgctttagataggcaattgattaacgggcaaagtggtagaaatctgctttcactttcccaggatagtttgactgctgcttatttgctaatggaagatggggtccttttgaatgtttatcaaatgcagcagcttcaaatgctttctatttctgacaaaagattaatacctcctgcagttgttaaagctccttcaagtaatagctcactttggagtgggaagcaaatattcagcatgctcttgccttatgattttgactattcttttccttcagatggtgttgttgttagtgatggggagcttgtatcttcttctgaggcttctggttggttacgcgattctgactacaatgttttccagagtcttgtggaacattatcaagggaagactctaaactttttgtatacagcgcaaaaagttctgtgtgagtggctgtctatgacaggttttagtgtttcactctcagatttgtacctttcttctgattcctatgcacggaaaaacatgatagaggaaatcttttatggcttacaagatgcagagcaggcttgtaatttcaagcagctattgttggattgttattgtgattttctgtcaggaagtatccaagagagtgaaaatgctatcactgttgatgctgatcgtctgaattatgaaagacaaatatctgctgctctcagtcaagcgtcagttgatgcttttaggcaagtttttcgcaatattcaaagtttagctgacaaatatgcatgtaaggacaatgctttccttgcaatgtttaaggctggaagcaagggtaatttgttgaaattagttcaacattccatgtgccttggcatgcaaaattctctggtccgcttgtcatacagattaccccgtcatctttcatgtgctgcttggaatagtcaaaagtggcttgattcaatccagatgtcttctggtacccttgaatctgttcagtcttacattccatatgctgtggttgaaagctcatttttaactgggttgaatccacttgaatgttttgttcattcagtgacaaatcgtgatagctctttcagtgaccatgcagaccttcctggaacactgacacgtagacttatgttcttcatgcgtgatttgcatgatgcatatgatggaactgtgagaaatttatatggtaatcaacttattcagttttcttatgatattgaagaggactcttcatgtgataaaggtttccaagagtatgctataggtggtgaaccagttggggcaatttctgcttgtgcaatttctgaagctgcatacagtgctttgggtcaaccagttagtctactcgaaacatcacctttgctgaatttgaaaaatgttttggagtgtggttcaaggaaaagaaatggtgatcagactgtgtctttatttttgtctgaaaagcttggtaaacagagacatgggtttgaatatgcagctttagaagtcaagaattatttggaaagattgttgttctcaaacattgtttctacagtgatgataatattcaccccacatgacggcagcagccaagaaaaatacagtccttgggtctgccactttcatttagacaaggaaattgtaactagaagaaaattgaaagtgcattctatcattgactctctctaccagagatattactcacagagaaaagactcaaaagtctgttttaccaatttgaaaatttcaagcaagaagtgttctgctgattccatggctaaggaaggtgaagacacttctatagataaaaaagagggtgatgattgcatcacagtcacaattgttgaaaactctaagaatcctatacaactggattctgttcgggatttggtgataccttttcttctaggaacagcaataaaaggatttctggatgtcaagaaggttgatgttctctggaataatcagtcaaaagtaaaaaattcttgtaatggtttttctggtgaactgtacttgagggtaactttgtccagcgagggtagcagaggaagattttggggtgtactcctaaatctttgtcacaagataatgcatataattgactggacacgcagtcatccagataacatcaatcatttctcatcagcatatggaattgatgcagggtggcaatactttttcaatagtttggcatctgcaacatctgataccggcaagtccatccttcctaagcatttgtgtcttgttgccaatagtctgtcatgtagtggagagtttgtgggattaaatgctaaaggcatggcactacaaagaaaacatgcgtcagtttcatcaccattcgtgcaagcatgctttgcgaatccaggtagttgctttataaaagctgctaagtctggagtcactgataatctccagggcagtctggatgcgttggcttggggaaactgtctatctatggggacaagtggaatgtttgatatcatatattcagagaaggtagctaagtctgggaatgtgtatgagctgctagaagccagttttgacaagccgaacaataaagctggtactcatttgcacaaatattcatctgacaaatgcggttctgagtttaggcataaaaatggttatgccttgaaagagggaaaacagtggaaaaccattttaagaaattttgtgacggtaaatgatatccagaagctgacttttgcttcgaggtgcatattgaacaagtattcaattgatgagctgctaagtgagagtgacaggtcaacaatgctaagggttttgaattttcatcctcgtaaaagtgagaagtttggcattggaccacaggacattaaggttggatggcatccaaaatacaaggatagccggtgcttccatatagtaagaattgatgggacggttgaagatttttcataccgcaaatgcattcttggtgctcttgatatcgttgatccaaaaaagtcaaagatccaggagaaaaaatggtcaggacatggtaacacgtaatatctatgcatgtccaagcataataagtgactatcatttgatctggtgacagtcacagactataaaaatagagtcggaagggtaatagtagtgccacaactctacaatcacaaaaagcaacgttgtttttctacctttgatttagaaggatgtccggaatcagtggtagagagcactgttctcttttgcgagtttagagttatgttattggcattactccagctaattggtggaaatagtttgcagccttcttttgttgtattttactatcttcaaggctagactgggtgatagcttactcaaatgttgctcgatggatttagaggcagagcagcgaatccagcgtaaagtcataacattttgaaagaagaaaggagaagatgcatagaagggaggatacaagatggaacaatgatagtatatattttttcaatatgaacaaattaaattttattttatatgttaaaagatggcgtgggttcttaccctgagcttctttttgcttcttccactaatactttatttgccaacgattacgtaaggcaaagaaagatctagtggaagcagcaacgagaagcttgtaaagacttatacccccagaccatttgtattgatgcggcagttaaatataagatatgtttaggttatgccgggttcaaatgtcatgcgtatctctgc

SEQ ID NO: 128 - DNA, 5419 bp, Glycine max
ttatcgcgtcctcggtctacacaaagtgccccttctcaactcggcgtttgtctcgtggtcgcgtggaaagtgatcagcggtgttccatttcgctattcattcgtctttactttactgcgctctctctctctccaattctctcttcggtttcgattttggtcttcgcagagcattgccgcgtagctcacacgcaccaccaccattgtctgcgtgctggtttagtcgatcattcgttcctttcactcaagttaccttgaaattctgagtgcgcgaatttcttcgcacacgtgtggtgctattggcggcacaaaccggggagcgcagcttatcactgtgcccaaccctttttgattacttgaaattttctgccgagtgcaaggttaccaagtttcatggatgatgaccttttacagaggaacaaaacaccatctgttgtcataaaagcgataaagttcgatgtcttaactgaagaagatatagagaatatctctgttttggagataaatgcagccgggcaggtcactgggtcaaatttgggattgccaaatgcatctgatgagtgtgccacatgtggcactaaagacaaaaagttctgtgaaggtcattttggagtaatcaaatttcctactcccatactccatccatattttatgttagaaattgcgcacatcttgaacaagatttgccctgtttgtaaatctattcgtcacaaatccaagggtgctcgattaatctatggaaccaagcggtctaatgattgcaattattgttctgtgtatccatcaatgcaatttagagtttcctccaacgatctctttagaagaactgcaattattgttgaagtaaaggcttcaaagaaaactttgggaacagaaatacctgctgatttttggaattttattccttgtgatgctcaacaagaagaaaattatgtaaatagaagggttttatcacctgtgcaggttaattatttgttgaatgatgttgatccagactttattgaaaaatatattccaagaaagaatttgctgtgtcttaattgcttcccggtgactccaaattgtcatcgtgtgacagaagtcccttatgcaatttctagtggaagccggttgagttttgatgacaggactcgatcttgtaagaaattggttgatttcaggggtacagctaatgaattaagttctcgtgttttggattgcctgaggatctctaagctaaatcctgataaaaccccaaatagtatttttgctgatatccagcaaagaaagattggagaaaatgctttcaattcttctggtttaagatggataaaagatgtggttcttggaaaacgcaatgacagttcattccgtactgtggttgttggtgatccagaccttgagcttagtgaaattggtataccttgtcatattgctgaaagtttgcaggtttctgagtatgtgaataggcagaatagggagaagctgctttattgttgtgagctacacttgttagagaaggggaaaataaatgtctgcagaaagggtagtatagttcatctgtataaaaaggaagatctacaaataggtgacaaattttataggcctcttgctgatggggataaagtgctgataaataggcccccttctatacatcaacattctatgatttctctcacagttagggtccttccaatatcttctgtagtgtgtattaacccactctgttgttccccactacgtggggattttgatggtgattgccttcacgggtatattccacaatcggttactgcaagaattgagcttaatgagctggttgctttagataggcaattgattaatgggcaaagtggtagaaatcttctttcactttcccaagatagtttgactgctgcatatttgctaatggaagatggggtccttttgaatgtttatcaaatgcagcagcttcaaatgctttctatttctaacaaaagattaatacctcctgcagttgttaaagctccctctagtaatagctcactttggaatgggaagcaattattcagcatgcttttgccgtatgattttgactattcttttccttcagatggtgttgttgttagtgatggagagcttgtatcttcttctgaggcttctggttggttacgcgattctgactacaatgtttttcagagtcttgtggaacattatcaagggaagactctaaactttttgtatgcagcacaaaaagttctgtgtgagtggctgtctatgacaggttttagtgtttcactctctgatttgtacctttcttctgattcgtatgcacgggaaaacatgatagaggaaatcttttatggcttacaagatgcagagcgggcttgtaatttcaagcagctattgttggattattattgtgattttctgtcaggaagtcttcaagagagtgaaaatgctatcactgttaatgcagatcgtctgaattatgaaagacaaatatctgcttctctcagtcaagcgtcagttgatgcttttaggcaagtttttcgcaatattcaaagtttagctgataaatatgcatgcaagggaaattctttccttgcaatgtttaaggctggaagcaagggtaatttgctgaaattagttcaacattccatgtgccttggcatgcaaaattctctggtccgcttgtcatacagactaccccgtcatctttcatgtgctgactggaatagtcaaaagtgggttgattcaatccagatgtcttctggtacccttgaatctgttcagtcatacattccatatgctgtagttgaaagttcttttttaactgggttgaatccacttgaatgttttgttcattcagtgacaaatcgtgatagctctttcagtgaccatgcggaccttcctggtacactgacacgtagacttatgttcttcatgcgtgatttgtatgatgcatatgatggaacggtgagaaatttatatggtaatcaacttattcagttttcttatgatattgaagaggactcttcatgcaataaaggtttccagcagtatgctttaggtggtgaatcagttggggctatttctgcctgtgcaatttctgaagctgcatacagtgctttgggtcaaccagttagtctactcgaaacatcacctttgctgaatttgaaaaatgttctggagtgtggttcaaggaaaagaaatggtgatcagactgtgtctttatttttgtctgaaaagcttggtaaacagagacatgggtttgaatatgcagctttagaagtcaagaattatttggaaagattgttgttctcaaacattgtttctaaagtgatgataatattcaccccacatgacagcaggagccaagaaaaatacagtccttgggtctgccactttcatttagacaaggaaattgtaacaagaagaaaattgaaagtgcattctatcattgactctctctatcagagatattactctcagagaaaagactcaaaagtctgttttaccaatttgaaaatttcaagcaggaagtgttctgctgattccatggttaaggaaggtgaagacacttctatagataaagaagagggtgatgattgcatcatggtcacaattgttgaaaactctaagaatcctatacaactggattctgttcgggacttggtgataccttttcttctaggaacagcaatacaaggatttctggatgtcaagaaggttgatattctctggaataatcagtcaaaagtaacaaattctcgtaatggtttttctggtgaactgtacttgagggtaactttgtccagcgagggtagcagaggaagattttggggtgtcctcctaaagctttgtcacaagataatgcatataattgactggacacgaagtcatacagataacatcaatcatttctcatcagcatatggaattgatgcagggtggcaatactttttcaatagtttggcatgtgcaacatctgataccggcaagtccatccttcctaagcatttgtgtcttgttgccaatagtctgtcatgtagtggagagtttgtaggattaaatgctaaaggcatggcactacaaagaaaacatgcgtccgtttcatcaccatttgtgcaagcatgctttgcgaatccaggtagttgctttataaaagctgctaagtctggagccacggataatctccagggcagcctggatgggttggcttggggaaactgtctatctatggggacaagtggaatgtttgatgtcatatattcagagaagggacatcaggtagctaagtctgtagatgtgtatgagctgctagaagccagttttgacaagccgaacaataaaattggtactcatttgcacaaatattcatctgacaaatgcggttctgagtttaggcataaaaatggttatgccttgaaagagggaaaacagtggaaaaccattttaagaaattttgtgacagtaaatgatattcagaagctgacttttgcatcgaggtgcatattgaacaagtattcaattgatgagctgctaagtgagagtgacaggtcaacaatgctaagggttttgaattttcatcctcataaaagtgagaagtttggcattggaccacaggacattaaggttggatggcatccaaaatacaaggatagccggtgcttccatataataagaactgatgggacggttgaagatttttcataccgcaaatgcattcttggtgctcttgatatcgttgatccaaaaaaatcaaagatccaggagaaaaaatggtcaggacatggtgacacgtaatatctatgcatatccaagcataataagtgactgtcatttgatctggtgacagtcacagactctataaaatatgaagtgatgttttcgccgaagaaatcgttgtaaaaatacagtgggaagggtaatagtagtgccacaactctacaatcacaaaaagcaacgttgtttttctgcctttgttgtattatactatctcaaggctagactgggtgatagcttattcaaatgtcgctcgatggatttagctcgtctgatagaggtagtgcagcaaatcaagagtaaagtcataacttttgtgcagcagcacattttgaaagaaaggagataattcatagatgggagtatacaagatggaacaatggtagtattttttttttcttttcaatctgaacaatttaaattttattttgtataataaagatggagtgggttcttacccttagcttctttttgcttcttccactaatactttatttgccaacgattacgtaaggcaaagaaagatctagtggaagcagcaacgagaagcttgtaaaaacttgtacccccagaccatttgtattgatgaatatgtggcagttaaatataagatatgcctgattcaaatgtcatgcttatctctgcatatctctaacgcgcatattgaatgcgag

SEQ ID NO: 129 - DNA, 5410 bp, Glycine max
ttatcgcgtcctcggtctacacaaagtgccccttctcaactcggcgtttgtctcgtggtcgcgtggaaagtgatcagcggtgttccatttcgctattcattcgtctttactttactgcgctctctctctctccaattctctcttcggtttcgattttggtcttcgcagagcattgccgcgtagctcacacgcaccaccaccattgtctgcgtgctggtttagtcgatcattcgttcctttcactcaagttaccttgaaattctgagtgcgcgaatttcttcgcacacgtgtggtgctattggcggcacaaaccggggagcgcagcttatcactgtgcccaaccctttttgattacttgaaattttctgccgagtgcaaggttaccaagtttcatggatgatgaccttttacagaggaacaaaacaccatctgttgtcataaaagcgataaagttcgatgtcttaactgaagaagatatagagaatatctctgttttggagataaatgcagccgggcaggtcactgggtcaaatttgggattgccaaatgcatctgatgagtgtgccacatgtggcactaaagacaaaaagttctgtgaaggtcattttggagtaatcaaatttcctactcccatactccatccatattttatgttagaaattgcgcacatcttgaacaagatttgccctgtttgtaaatctattcgtcacaaatccaagggtgctcgattaatctatggaaccaagcggtctaatgattgcaattattgttctgtgtatccatcaatgcaatttagagtttcctccaacgatctctttagaagaactgcaattattgttgaagtaaaggcttcaaagaaaactttgggaacagaaatacctgctgatttttggaattttattccttgtgatgctcaacaagaagaaaattatgtaaatagaagggttttatcacctgtgcaggttaattatttgttgaatgatgttgatccagactttattgaaaaatatattccaagaaagaatttgctgtgtcttaattgcttcccggtgactccaaattgtcatcgtgtgacagaagtcccttatgcaatttctagtggaagccggttgagttttgatgacaggactcgatcttgtaagaaattggttgatttcaggggtacagctaatgaattaagttctcgtgttttggattgcctgaggatctctaagctaaatcctgataaaaccccaaatagtatttttgctgatatccagcaaagaaagattggagaaaatgctttcaattcttctggtttaagatggataaaagatgtggttcttggaaaacgcaatgacagttcattccgtactgtggttgttggtgatccagaccttgagcttagtgaaattggtataccttgtcatattgctgaaagtttgcaggtttctgagtatgtgaataggcagaatagggagaagctgctttattgttgtgagctacacttgttagagaaggggaaaataaatgtctgcagaaagggtagtatagttcatctgtataaaaaggaagatctacaaataggtgacaaattttataggcctcttgctgatggggataaagtgctgataaataggcccccttctatacatcaacattctatgatttctctcacagttagggtccttccaatatcttctgtagtgtgtattaacccactctgttgttccccactacgtggggattttgatggtgattgccttcacgggtatattccacaatcggttactgcaagaattgagcttaatgagctggttgctttagataggcaattgattaatgggcaaagtggtagaaatcttctttcactttcccaagatagtttgactgctgcatatttgctaatggaagatggggtccttttgaatgtttatcaaatgcagcagcttcaaatgctttctatttctaacaaaagattaatacctcctgcagttgttaaagctccctctagtaatagctcactttggaatgggaagcaattattcagcatgcttttgccgtatgattttgactattcttttccttcagatggtgttgttgttagtgatggagagcttgtatcttcttctgaggcttctggttggttacgcgattctgactacaatgtttttcagagtcttgtggaacattatcaagggaagactctaaactttttgtatgcagcacaaaaagttctgtgtgagtggctgtctatgacaggttttagtgtttcactctctgatttgtacctttcttctgattcgtatgcacgggaaaacatgatagaggaaatcttttatggcttacaagatgcagagcgggcttgtaatttcaagcagctattgttggattattattgtgattttctgtcaggaagtcttcaagagagtgaaaatgctatcactgttaatgcagatcgtctgaattatgaaagacaaatatctgcttctctcagtcaagcgtcagttgatgcttttaggcaagtttttcgcaatattcaaagtttagctgataaatatgcatgcaagggaaattctttccttgcaatgtttaaggctggaagcaagggtaatttgctgaaattagttcaacattccatgtgccttggcatgcaaaattctctggtccgcttgtcatacagactaccccgtcatctttcatgtgctgactggaatagtcaaaagtgggttgattcaatccagatgtcttctggtacccttgaatctgttcagtcatacattccatatgctgtagttgaaagttcttttttaactgggttgaatccacttgaatgttttgttcattcagtgacaaatcgtgatagctctttcagtgaccatgcggaccttcctggtacactgacacgtagacttatgttcttcatgcgtgatttgtatgatgcatatgatggaacggtgagaaatttatatggtaatcaacttattcagttttcttatgatattgaagaggactcttcatgcaataaaggtttccagcagtatgctttaggtggtgaatcagttggggctatttctgcctgtgcaatttctgaagctgcatacagtgctttgggtcaaccagttagtctactcgaaacatcacctttgctgaatttgaaaaatgttctggagtgtggttcaaggaaaagaaatggtgatcagactgtgtctttatttttgtctgaaaagcttggtaaacagagacatgggtttgaatatgcagctttagaagtcaagaattatttggaaagattgttgttctcaaacattgtttctaaagtgatgataatattcaccccacatgacagcaggagccaagaaaaatacagtccttgggtctgccactttcatttagacaaggaaattgtaacaagaagaaaattgaaagtgcattctatcattgactctctctatcagagatattactctcagagaaaagactcaaaagtctgttttaccaatttgaaaatttcaagcaggaagtgttctgctgattccatggttaaggaaggtgaagacacttctatagataaagaagagggtgatgattgcatcatggtcacaattgttgaaaactctaagaatcctatacaactggattctgttcgggacttggtgataccttttcttctaggaacagcaatacaaggatttctggatgtcaagaaggttgatattctctggaataatcagtcaaaagtaacaaattctcgtaatggtttttctggtgaactgtacttgagggtaactttgtccagcgagggtagcagaggaagattttggggtgtcctcctaaagctttgtcacaagataatgcatataattgactggacacgaagtcatacagataacatcaatcatttctcatcagcatatggaattgatgcagggtggcaatactttttcaatagtttggcatgtgcaacatctgataccggcaagtccatccttcctaagcatttgtgtcttgttgccaatagtctgtcatgtagtggagagtttgtaggattaaatgctaaaggcatggcactacaaagaaaacatgcgtccgtttcatcaccatttgtgcaagcatgctttgcgaatccaggtagttgctttataaaagctgctaagtctggagccacggataatctccagggcagcctggatgggttggcttggggaaactgtctatctatggggacaagtggaatgtttgatgtcatatattcagagaaggtagctaagtctgtagatgtgtatgagctgctagaagccagttttgacaagccgaacaataaaattggtactcatttgcacaaatattcatctgacaaatgcggttctgagtttaggcataaaaatggttatgccttgaaagagggaaaacagtggaaaaccattttaagaaattttgtgacagtaaatgatattcagaagctgacttttgcatcgaggtgcatattgaacaagtattcaattgatgagctgctaagtgagagtgacaggtcaacaatgctaagggttttgaattttcatcctcataaaagtgagaagtttggcattggaccacaggacattaaggttggatggcatccaaaatacaaggatagccggtgcttccatataataagaactgatgggacggttgaagatttttcataccgcaaatgcattcttggtgctcttgatatcgttgatccaaaaaaatcaaagatccaggagaaaaaatggtcaggacatggtgacacgtaatatctatgcatatccaagcataataagtgactgtcatttgatctggtgacagtcacagactctataaaatatgaagtgatgttttcgccgaagaaatcgttgtaaaaatacagtgggaagggtaatagtagtgccacaactctacaatcacaaaaagcaacgttgtttttctgcctttgttgtattatactatctcaaggctagactgggtgatagcttattcaaatgtcgctcgatggatttagctcgtctgatagaggtagtgcagcaaatcaagagtaaagtcataacttttgtgcagcagcacattttgaaagaaaggagataattcatagatgggagtatacaagatggaacaatggtagtattttttttttcttttcaatctgaacaatttaaattttattttgtataataaagatggagtgggttcttacccttagcttctttttgcttcttccactaatactttatttgccaacgattacgtaaggcaaagaaagatctagtggaagcagcaacgagaagcttgtaaaaacttgtacccccagaccatttgtattgatgaatatgtggcagttaaatataagatatgcctgattcaaatgtcatgcttatctctgcatatctctaacgcgcatattgaatgcgag

SEQ ID NO: 130 - DNA, 6907 bp, Glycine max
aaaaaaatttaatttttcatttcatttcacactcactcgcttactcacttcattccatttctctccgaaaaccctctttctctcacgctcgttgttgtttcgatcggtttcgtgtaatgatggttttgcggtgagctaagtgagacgctcgaattgaacagcttttgtttcgctcctgaggcactataattgatcacgaaagtaatggaggataatcccccttcaagtgttttagatgggaccgttgttgggatcaaatttggtatggctacacgtcaggaaatttgtacagcatccattagtgagtcttcaattagtcatgctagtcagctgtcaaatccattccttgggctgccccttgaatttggcagatgtgaatcttgtggtacctctgaagttggaaaatgcgaaggtcattttggatatgtggaactaccggttcctatataccatccgagccatatcagtgaattgaaacggatgctgagcgtggtctgcttaaattgcttaaaaatgaggaaaaccaagtttccagcttcaagcagtggcttagcacaaagattaatatctccatgttgccaggatgttaatgctgctctagtttctattcgggaagttaaaacaagtgacggggcttgttatttggcgctgaaagtatccaaatccaagattcatgatggtttttggagtttcttagaaaaatatggctatcgctatgagggtgatgaaactcgagccttgcttccttgtgaggcaatggaaattattaagagaattccgatagagacaaaaaaaaagcttgctggaaaaggattttttcctcaagatggatatgttttgaagtatcttccggtgccaccaaattgcttgtctgtgccagaagtttcagacggtgccagtgtcatgtcgtcggatccttccatgacaattctcagaaaattgctcaggaaggttgaaatcataaaaagctctagatctggtgaaccaaatttcgagtctcatcacgtggaagcaaatgatttgcagtctgtggttgatcaatattttcaaattaggggcacttctaagccagcacgtgatatagagacacattttggggtcaataaagagcttactgcatcctcaacaaaagcatggcttgagaaaatgaggacattatttataagaaagggttcaggtttttcgtcccggaatgtaattactggagattgttataagaggataaatgaagtaggaattccggttgaagttgcccagcggataacatttgaggagagagttaacatccacaacatcagatatttacagaagttggttgatgaacatttgtgcctgacctacaaggaaggtgtgtcaacttattcactcagggagggctctaaggggcacatatatctcaagcctggtcagatagtgcatcggaggattatggatggggatattgtcttcatcaacagaccacctacaacacacaaacattccttacaagccctttatgtttacatccatgaagaccacactgtgaagattaatcctttaatttgtggaccgcttggggctgattttgatggtgactgtgtccatctgttttatccgcagtcacttgctgctaaagctgaagttgtggagctatttgctgtggagaatcagctgctcagctctcacagtggtaatttgaacctacagttatccacagactcattgttggcactgaagatgttggtcaagagatgttttttgggtagagcggcagctaatcaattggcgatgtttcttttgcttcctttgcctcggcctgctttgctcaaggccagttctgatgatgcttgttggacttccatccaaattttacagggtgcattacctatgggttttgattgcactgggggacgatatttgattaggcagagtgaaatcttagaatttgatttcagcagggatgctctgcctgcaaccataaatgaaatagcagcttcaattttctttggcaagggtcccatggaggcacttaaattcttcgatgtattgcaaccctttttgatggaaagcttatttgcggaagggtttagtgttagcctggaagagttttcaatatccagggcaatcaaaaggataataagaagaagcattggaaaggcttcttctctgctgtatcagctgaggtccttatacaatgagctggtggcgcagcaactggagaagcacattcaagatgttgaacttcctatcattaattttgctctaaagtcgactaaattaggagatttaattgattcgaagagtaaatctactattgataaggttgttcagcaggttgggttcttagggcagcaactttttgataggggaagattctactcaaagggattggtagatgatgtggcatcacattttcatgcaaagtgttgttatgatggggatggttatccctctgctgagtatggactgctcaaagggtgtttttttaatggtttggatccatatgaagagatggtgcattcaatttcaactagggaaataatggtgcgttcttcaagaggattatctgaaccaggaactctctttaagaatttgatggccatccttcgggatgttgttatctgttatgatggaactgtcagaaacatttgtagtaattccatcatccagtttgaatatgggatacaagctggagacaaaactgagcacttattccctgctggtgagcctgtaggtgtcttggcagcaactgctatgtcgaatcctgcttacaaggctgttcttgatgctagtcctaatagcaactcttcatgggagttgatgaaggaaatattactctgcaaggttaattttaggaatgaacctgttgatcggcgtgtcattttgtacttgaatgactgtgattgtggagggagttgttgccgagaaaatgcagcatattcagttaaaaatcaattgagaaaagtcagtctcaagaatgcagctgtggagttcattattgaataccaacaacagcgaactcaaaaggaaaattctgaaactgatgctggacttgttggtcatatttatctggatgagatgatgttagaggagctgaagatcagcatggccaatgtttttgaaaaatgcctagaaagactcaagtcttttagtcggaaaaagaaagttaatcaatatttgaagaacattgaattatcatttagtgagtcttgctcatcttcacatcctgctgcaccatgtttaacattttggctaaagaatcatgatagtgatttagataatgctgtaaaggtcctgtctgaaaatatctgccctgttctgttcgaaacaataatcaaaggagacccgcgcattagctctgcaagtataatctgggttagtccagatacaaacacatgggtccgaaacccttataaatcatctaatggtgaattggcacttgacatcgttcttgaggaggaagctgtcaagcagagtggcgatgcttggagaattgtacttgattcctgccttcctgttcttcacttgattgataccaggcgttccatcccttacgctattaagcagattcaggaattactggggatatcatgtacttttgatcaagcgattcagcgtgttgcagcatctgtgaaaatggtggcgaaaggtgtacttagggagcatctaattctgttagctagtagtatgacatgtggtgggaacttggttggctttaatacaggtggatataaagctctctctcgtcaattaaatatacaagtaccgttcacagatgcaacactctttacacctaaaaagtgttttgagagagctgctgagaaatgccatactgattctctgtcaagcatagttgcctcctgttcctggggtaaacatgtggcagttggtacaggatcaaaatttgacattgtttgggattcaagtgagataaaatcaaatgaaattgaagggatggatgtttacagttttcttcacatggtgaaaagtgtaaccaatggggaagaagaaactgatgcttgtttgggtgaagatattgatgatttgctggaagaagaatatatggacttgggcatgtccccacaacacaactctggttttgaagctgtatttgaagagaatcctgaagtactgaatggttcaacatccaatggttgggatgtaagttcaaatcagactcaatcaaaaaccaatgagtggtcaggttgggcaagtagtaacaaagatggtagatctgaaactgcccaagagaattcttgggggaaaactgtcaaccaagaagactcttccaagtctaacgcttggaatacaagcaccacagcagatcagacaaaaactaaatctaatgaatggtctgactggggtagtaacaagtctgaaataccagctggtggatctaaagcagttcaagaagactcttccaagtctaacgcttggaatacaagcaccacatcaaatcagacaaaaactaaatctaaggaatggtctgcctggggaagtaacaagtctgaaataccagcttgtggatctaaagcagttcaagaagactcttccaagtctaacacttggaatacaagcaccacagcagatcagacaaaaactaaatctaatgaatggtctgcctggggaagtaacaagtctgaaataccagctggtggatctaaagcagttcaagaggactcttccaagtctaacgcttggaatagaagcaccacagcagatcagacaaaaactaaatctaatgaatggtctgcctggggaagtaacaagtctgaaataccagctggtggatctaaagcagttcaagaggactcttccaagtctaatgcttggaatacaagcaccacagcagatcagacaaaaactaaatctaatgaatggtctgcctggggaagtaacaagtctgaaataccagctggtggatctaaagcagttcaagaagattcttccaaagcttggaatacaagcaccacagcagatcagacaaaaactaaatctaatgaatggtctgcccgggtaagtaacaagtctgaaataccagctggtggatctaaagcagttcaagaagattcttggggctccagtaagtggaaggctgatgttgcccaagaagacaattccaggcttggtgcttgggatgcaaatgcagcagatcagacaaaatctaatgaatggtcgggctggggaaagaagaaagatgttacccaagaagacaatgtgcaacattcttggggctctggtaagaggaaagacaaagttacccaagaagacaattctggctctggtgattggggtgccaacagaacagatctggcaattaccaaatctagtgaatggtccagctggggaaagaacaagactgaaataccagctggtggatctgcaaatgtgcagaatgactcatggggcttgggtaaattgaatgatacccaaaaagataattctggttgtggtgcttggggtgaaaattctgggtctgcatgggtgagaaataaagctgaaacaatagatggtggatcagaaaagccccaagaggatgcttggaactctggcaattggaaagctgaatcaaaagttggcaataccacttggggaaaacccaagtcttcagaaagtcatgcatgggattcccataatcagtcaaatcaaaattcaagttcacaggggtgggaatcacatattgcttcagctaattcagaaaatgagaaaggttttcagtggggaaaaggtagagactcgtttaagaaaaatcgatttgaaggttcgcaaggtcggggttcaaatgctggtgactggaaaaataggaatcgcccgcctagagcacctggacagagattggacatttactcatctgaggagcaggatgttctgaaggatattgaacccattatgcagtctatcagacgaatcatgcaacaacaggggtacagtgatggggatccactggctgctgaagatcaactttttgtacttgagaatgtctttgagcaccacccagataaagaaaccaaaatgggtgctggaattgattatgtcatggttaacaaacacagtagcttccaggaaagtagatgcttttatgtggtttgtaaagatggtcaaagcaaagacttttcctaccggaagtgtttggccaactatataagcaagaagtatcctgaccttgctgaatcattccttggcaaatattttcggaaacctcgtgctaggggggaccagactgcaacactagggggagaccagactgcaacaccagcgcaggatgaagcagccacttcgggtgagtagattagggttgtgtccataatattgtacagaaacggtgtagttgaggccactgaatagttcgtcatagctgaccaattttcctgtaggaaagtgttcctctttttggtgacagttagatggtaattttttttcacatgcgaatgatgatagcaaacacccttttgccgatgttaatattgttctaatgattacagcacttatgatgtgcctagcaaactttgctcatcattttatttaaaccatcaattgcacctgggtttcagacattgattggaccactgatacaaaaatggcatccttctgattagagtttcatgaatcagttgtggcttatatttttgtttaataggtttctaggcatttccgagttatatttaaaccggtagaatttctttgatttagttttttcttgtctcatctttgtaatacagactgcgatggtttagtatctcgatttttaaaggtcctggtcaaaggcaggaatgactttaactgcccattttgttaaccacactgttctttataattcctggtaaatttttttttcaaaatatcatttagcgtaacgaaaccttttgggtgtaatttctatgatgacaagtattgctcaaatttatgtgaaagaacgagttggcttcgg

SEQ ID NO: 131 - DNA, 6910 bp, Glycine max
aaaaaaatttaatttttcatttcatttcacactcactcgcttactcacttcattccatttctctccgaaaaccctctttctctcacgctcgttgttgtttcgatcggtttcgtgtaatgatggttttgcggtgagctaagtgagacgctcgaattgaacagcttttgtttcgctcctgagcaggcactataattgatcacgaaagtaatggaggataatcccccttcaagtgttttagatgggaccgttgttgggatcaaatttggtatggctacacgtcaggaaatttgtacagcatccattagtgagtcttcaattagtcatgctagtcagctgtcaaatccattccttgggctgccccttgaatttggcagatgtgaatcttgtggtacctctgaagttggaaaatgcgaaggtcattttggatatgtggaactaccggttcctatataccatccgagccatatcagtgaattgaaacggatgctgagcgtggtctgcttaaattgcttaaaaatgaggaaaaccaagtttccagcttcaagcagtggcttagcacaaagattaatatctccatgttgccaggatgttaatgctgctctagtttctattcgggaagttaaaacaagtgacggggcttgttatttggcgctgaaagtatccaaatccaagattcatgatggtttttggagtttcttagaaaaatatggctatcgctatgagggtgatgaaactcgagccttgcttccttgtgaggcaatggaaattattaagagaattccgatagagacaaaaaaaaagcttgctggaaaaggattttttcctcaagatggatatgttttgaagtatcttccggtgccaccaaattgcttgtctgtgccagaagtttcagacggtgccagtgtcatgtcgtcggatccttccatgacaattctcagaaaattgctcaggaaggttgaaatcataaaaagctctagatctggtgaaccaaatttcgagtctcatcacgtggaagcaaatgatttgcagtctgtggttgatcaatattttcaaattaggggcacttctaagccagcacgtgatatagagacacattttggggtcaataaagagcttactgcatcctcaacaaaagcatggcttgagaaaatgaggacattatttataagaaagggttcaggtttttcgtcccggaatgtaattactggagattgttataagaggataaatgaagtaggaattccggttgaagttgcccagcggataacatttgaggagagagttaacatccacaacatcagatatttacagaagttggttgatgaacatttgtgcctgacctacaaggaaggtgtgtcaacttattcactcagggagggctctaaggggcacatatatctcaagcctggtcagatagtgcatcggaggattatggatggggatattgtcttcatcaacagaccacctacaacacacaaacattccttacaagccctttatgtttacatccatgaagaccacactgtgaagattaatcctttaatttgtggaccgcttggggctgattttgatggtgactgtgtccatctgttttatccgcagtcacttgctgctaaagctgaagttgtggagctatttgctgtggagaatcagctgctcagctctcacagtggtaatttgaacctacagttatccacagactcattgttggcactgaagatgttggtcaagagatgttttttgggtagagcggcagctaatcaattggcgatgtttcttttgcttcctttgcctcggcctgctttgctcaaggccagttctgatgatgcttgttggacttccatccaaattttacagggtgcattacctatgggttttgattgcactgggggacgatatttgattaggcagagtgaaatcttagaatttgatttcagcagggatgctctgcctgcaaccataaatgaaatagcagcttcaattttctttggcaagggtcccatggaggcacttaaattcttcgatgtattgcaaccctttttgatggaaagcttatttgcggaagggtttagtgttagcctggaagagttttcaatatccagggcaatcaaaaggataataagaagaagcattggaaaggcttcttctctgctgtatcagctgaggtccttatacaatgagctggtggcgcagcaactggagaagcacattcaagatgttgaacttcctatcattaattttgctctaaagtcgactaaattaggagatttaattgattcgaagagtaaatctactattgataaggttgttcagcaggttgggttcttagggcagcaactttttgataggggaagattctactcaaagggattggtagatgatgtggcatcacattttcatgcaaagtgttgttatgatggggatggttatccctctgctgagtatggactgctcaaagggtgtttttttaatggtttggatccatatgaagagatggtgcattcaatttcaactagggaaataatggtgcgttcttcaagaggattatctgaaccaggaactctctttaagaatttgatggccatccttcgggatgttgttatctgttatgatggaactgtcagaaacatttgtagtaattccatcatccagtttgaatatgggatacaagctggagacaaaactgagcacttattccctgctggtgagcctgtaggtgtcttggcagcaactgctatgtcgaatcctgcttacaaggctgttcttgatgctagtcctaatagcaactcttcatgggagttgatgaaggaaatattactctgcaaggttaattttaggaatgaacctgttgatcggcgtgtcattttgtacttgaatgactgtgattgtggagggagttgttgccgagaaaatgcagcatattcagttaaaaatcaattgagaaaagtcagtctcaagaatgcagctgtggagttcattattgaataccaacaacagcgaactcaaaaggaaaattctgaaactgatgctggacttgttggtcatatttatctggatgagatgatgttagaggagctgaagatcagcatggccaatgtttttgaaaaatgcctagaaagactcaagtcttttagtcggaaaaagaaagttaatcaatatttgaagaacattgaattatcatttagtgagtcttgctcatcttcacatcctgctgcaccatgtttaacattttggctaaagaatcatgatagtgatttagataatgctgtaaaggtcctgtctgaaaatatctgccctgttctgttcgaaacaataatcaaaggagacccgcgcattagctctgcaagtataatctgggttagtccagatacaaacacatgggtccgaaacccttataaatcatctaatggtgaattggcacttgacatcgttcttgaggaggaagctgtcaagcagagtggcgatgcttggagaattgtacttgattcctgccttcctgttcttcacttgattgataccaggcgttccatcccttacgctattaagcagattcaggaattactggggatatcatgtacttttgatcaagcgattcagcgtgttgcagcatctgtgaaaatggtggcgaaaggtgtacttagggagcatctaattctgttagctagtagtatgacatgtggtgggaacttggttggctttaatacaggtggatataaagctctctctcgtcaattaaatatacaagtaccgttcacagatgcaacactctttacacctaaaaagtgttttgagagagctgctgagaaatgccatactgattctctgtcaagcatagttgcctcctgttcctggggtaaacatgtggcagttggtacaggatcaaaatttgacattgtttgggattcaagtgagataaaatcaaatgaaattgaagggatggatgtttacagttttcttcacatggtgaaaagtgtaaccaatggggaagaagaaactgatgcttgtttgggtgaagatattgatgatttgctggaagaagaatatatggacttgggcatgtccccacaacacaactctggttttgaagctgtatttgaagagaatcctgaagtactgaatggttcaacatccaatggttgggatgtaagttcaaatcagactcaatcaaaaaccaatgagtggtcaggttgggcaagtagtaacaaagatggtagatctgaaactgcccaagagaattcttgggggaaaactgtcaaccaagaagactcttccaagtctaacgcttggaatacaagcaccacagcagatcagacaaaaactaaatctaatgaatggtctgactggggtagtaacaagtctgaaataccagctggtggatctaaagcagttcaagaagactcttccaagtctaacgcttggaatacaagcaccacatcaaatcagacaaaaactaaatctaaggaatggtctgcctggggaagtaacaagtctgaaataccagcttgtggatctaaagcagttcaagaagactcttccaagtctaacacttggaatacaagcaccacagcagatcagacaaaaactaaatctaatgaatggtctgcctggggaagtaacaagtctgaaataccagctggtggatctaaagcagttcaagaggactcttccaagtctaacgcttggaatagaagcaccacagcagatcagacaaaaactaaatctaatgaatggtctgcctggggaagtaacaagtctgaaataccagctggtggatctaaagcagttcaagaggactcttccaagtctaatgcttggaatacaagcaccacagcagatcagacaaaaactaaatctaatgaatggtctgcctggggaagtaacaagtctgaaataccagctggtggatctaaagcagttcaagaagattcttccaaagcttggaatacaagcaccacagcagatcagacaaaaactaaatctaatgaatggtctgcccgggtaagtaacaagtctgaaataccagctggtggatctaaagcagttcaagaagattcttggggctccagtaagtggaaggctgatgttgcccaagaagacaattccaggcttggtgcttgggatgcaaatgcagcagatcagacaaaatctaatgaatggtcgggctggggaaagaagaaagatgttacccaagaagacaatgtgcaacattcttggggctctggtaagaggaaagacaaagttacccaagaagacaattctggctctggtgattggggtgccaacagaacagatctggcaattaccaaatctagtgaatggtccagctggggaaagaacaagactgaaataccagctggtggatctgcaaatgtgcagaatgactcatggggcttgggtaaattgaatgatacccaaaaagataattctggttgtggtgcttggggtgaaaattctgggtctgcatgggtgagaaataaagctgaaacaatagatggtggatcagaaaagccccaagaggatgcttggaactctggcaattggaaagctgaatcaaaagttggcaataccacttggggaaaacccaagtcttcagaaagtcatgcatgggattcccataatcagtcaaatcaaaattcaagttcacaggggtgggaatcacatattgcttcagctaattcagaaaatgagaaaggttttcagtggggaaaaggtagagactcgtttaagaaaaatcgatttgaaggttcgcaaggtcggggttcaaatgctggtgactggaaaaataggaatcgcccgcctagagcacctggacagagattggacatttactcatctgaggagcaggatgttctgaaggatattgaacccattatgcagtctatcagacgaatcatgcaacaacaggggtacagtgatggggatccactggctgctgaagatcaactttttgtacttgagaatgtctttgagcaccacccagataaagaaaccaaaatgggtgctggaattgattatgtcatggttaacaaacacagtagcttccaggaaagtagatgcttttatgtggtttgtaaagatggtcaaagcaaagacttttcctaccggaagtgtttggccaactatataagcaagaagtatcctgaccttgctgaatcattccttggcaaatattttcggaaacctcgtgctaggggggaccagactgcaacactagggggagaccagactgcaacaccagcgcaggatgaagcagccacttcgggtgagtagattagggttgtgtccataatattgtacagaaacggtgtagttgaggccactgaatagttcgtcatagctgaccaattttcctgtaggaaagtgttcctctttttggtgacagttagatggtaattttttttcacatgcgaatgatgatagcaaacacccttttgccgatgttaatattgttctaatgattacagcacttatgatgtgcctagcaaactttgctcatcattttatttaaaccatcaattgcacctgggtttcagacattgattggaccactgatacaaaaatggcatccttctgattagagtttcatgaatcagttgtggcttatatttttgtttaataggtttctaggcatttccgagttatatttaaaccggtagaatttctttgatttagttttttcttgtctcatctttgtaatacagactgcgatggtttagtatctcgatttttaaaggtcctggtcaaaggcaggaatgactttaactgcccattttgttaaccacactgttctttataattcctggtaaatttttttttcaaaatatcatttagcgtaacgaaaccttttgggtgtaatttctatgatgacaagtattgctcaaatttatgtgaaagaacgagttggcttcgg

SEQ ID NO: 132 - DNA, 6963 bp, Glycine max
tcatgttcatttcacactcactcgcttactcactctcagtctcacacactctctctcatttcatttctctccggaaaacctttccccttcgaaaccctctttctctctcgctctttgttgtttcgatcggtttcgcgcaacgaggttctttgcattttctagggttttgcgagctgagcgagacgtttgaattgaacagcttttgtttcgctcctgaggtagaatcaggcactgtaattgaccacgaaagtaatggaggataatcccccttcaagtgttttagatgggaccgttgttgggatcaaatttggtatggctacacgccaggaaatttgtacagcatccattagtgactcttcaattagtcatgctagtcagctgtcaaatccattccttgggctgccccttgagtttggcagatgtgaatcttgtggtacttctgaagttggaaaatgcgaaggtcacttcggatatattgagttgccaattccaatatatcacccaagtcatatcagtgacttgaaacggatgctgagcatggtctgcttaaactgcctaaaattaaggaaaaccaagcttccagcttcaagcagtggtttagcccagagattaatatctccttgttgtcaggaggataaggctgctctagtttctattcgggaagttaaaacaagtgatggggcttgttatctggcgttgaaagtatccaaatccaagatgcaaaatggtttttggagtttcttagaaaaatatggttatcgctatgggggtgatcacactcgagccttgcttccttgtgaggcaatggaaattattaagagaattccgatagagacaaaaaaaaagcttgctggaaaaggatattttcctcaagatggatatgttttgaagtatcttccggtgccaccaaattgcttgtctgtgccagaagtttcagacggtgtcagtgtcatgtcgtcggatccttccataacaattctcagaaaattgctcaggaaggttgaaatcataaaaagctctagatctggtgaaccaaatttcgagtctcatcacgtagaagcaaatgatttgcagtctgtggttgatcaatattttcaaattagaggaacttctaagccagcacgtgatatagagacacattttggggtcaataaagagcttactgcatcctcaacaaaagcatggcttgagaaaatgaggacattatttataagaaagggttcaggtttttcttcccggaatgtaattactggagattgttataagaggataaatgaagtaggaattccggttgaagttgcccaacggataacgtttgaggagagagttaacatccacaacatcagatatttacagaagttggttgatgaacatttgtgcctgacctacaaggaaggtgggtcaacttattcactcagggagggctcaaaggggcacatatatctcaagcctggtcagatagtgcatcggaggattatggatggggatattgtcttcatcaacagaccacctacaacacacaagcactccttacaagccctttatgtttacatccatgaagaccacactgtgaagataaatcctttaatttgtggaccacttggggctgattttgatggtgactgtgtccatctgttttatccgcaatcacttgctgctaaagctgaagttgtggagctattttctgtggagaatcaactgctcagctctcacagtggtaatttgaacctacagttatccacagactcgttgttgtcactgaagatgttggtcaagagatgtttttttgatagagcagcagctaatcaattggcgatgtttattttgcttcctttgcctcggcctgctttgctcaaggccagttctggtgatgcttgttggacttccatccaaattttacagtgtgctttacctttgggttttgattgcactgggggacggtatttgattaggcagagtgagatcttagaatttgaattcagcagggatgttctgcctgcaaccgtaaatgaaatagcagcttcagttttctttggcaagggtcccaaggaggcacttaatttctttgatgtattgcaaccctttttgatggaaagcttatttgcggaagggtttagtgttagcctggaagagttttcaatatccagggcaattaaaaggataataagaaaaagcattggaaaagtttcttctctgctgtatcagctgaggtccttgtacaatgagctggtggcgcagcaactggagaagcacattcgagatgttgaacttcctatcattaattttgctctaaagtcaactaaattaggagatttaattgattcaaagagtaaatctgctattgataaggttgttcagcagattgggtttttagggcagcaactttttgataggggaagattctactcaaagggattggtagatgatgtggcatcacattttcatgcaaagtgttgttatgacggggatggttatccctctgctgagtatggactgctcaaagggtgtttttttaatggtttggatccatacgaagagatggtgcattcgatttcaacaagggaaataatggtgcgttcttcgagaggattatctgaaccaggaacactctttaagaatttgatggccatccttcgggatgttgttatctgttatgatggaactgtcagaaacatttgtagtaattccatcatccagtttgaatacgggatacaagctggagacaaaagtgagcacttattccctgctggtgagcctgtaggtgtgttggctgcaactgctatgtcaaatcctgcttacaaggctgtccttgatgctagtcctagtagcaactcttcatgggagttgatgaaggaaatattactctgcaaggttaattttaggaatgaacttgttgatcggcgtgtcattttgtacttgaatgactgtgattgtggagggagttattgccgagaaaatgcagcatattcagttaaagatcaattgagaaaagtcagtctcaaggatgcagctgtggagttcattattgaataccaacaacagcgaactcaaaaggaaaattctgaaactgatgttggacttgttggtcatatttatttggatgagatgatgttagaggagctgaagatcagcatggcctatgttttcgacaaatgccatgaaagactcaagtcttttagtcagaaaaagaaagttaatcaatctttgaagaacattgaattatcatttagtttatttgttggtctatatcactttctgattatgttccatcttagcagtgagtcttgctcatcttcacatcctgctgcaccatgtttaacattttggctaaagaattatgatagtgatttggataatgctgtaaaggtcctggctgaaaagatctgccctgttctgtttaaaacaataatccaaggagacccgcgcattagctctgcgagtataatctgggttagtccagatacaaacacatgggtccgaaacccttataaatcttctaatggtgaattggcacttgacatcattctcgagaaggaagctgtcaagcagagtggcgatgcttggagagttgtacttgatgcctgccttcctgttcttcacttgattgataccaggcgttccatcccttacgctattaagcagattcaggaattactggggatatcatgtacttttgatcaagcgattcagcgtgttgcagcatctgtgaaaatggtggcgaaaggtgtacttagggagcatctaattctgttagctagtagtatgacttgtggtgggaacttggttggctttaatataggtggatataaagctctgtctcgtcaattaaatatacaagtaccattcacagatgcaacactctttacacctaaaaagtgttttgagagagctgctgagaaatgccatactgattctctgtcaagcatagttgcctcctgttcctggggtaaacatgtggcagttggtacaggatcaaaatttgatgttgtttgggatgcaaatgagataaaatcaaatgaaattgaagggatggatgtttacagttttcttcacatggtgaaaagctttaccaatggcgaagaagaaaccgatgcttgtttgggtgaagatattgatgatttgctggaagaagaatatatggacttgggcatgtccccacaacataactctggttttgaagctgtctttgaagagaatcctgaagtactgaatggttcaacatccaatggttgggatgtaagttcaaatcagggtgaatcaaaaaccaatgagtggtcaggttgggcaagtagtaacaaagctgaaataaaagatggtagatctgaaattgcccccaagaattcttgggggaaaactgtcaaccaagaagactcttccaagtctaacccttggagtacaagcaccatagcagatcagacaaaaactaaatctaatgaatggtctgcctggggaagtaacaagtctgaaataccagttggttgggcaagtagtaacaaaactgaaataaaagatggtagatctgaaactgcccaagagaattcttgggggaaaactgtcaaccaagaagactcttccaagtctaatgcttggaatacaagcaccacagtagatcatgcaaacactaaatctaatgaatggtctgcctggggaagtaaccagtctgaaataccagctggtggatctaaagcagttcaagaagattcttggggctcaagtaagtggaaggctgatgttgcccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatgcagcagatcagacaaaatctagagactggtcgggttggggaaagaagaaagatattacccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatacagcagatcagacaaaatctaatgaatggtcaggttggggaaagaagaaagaagttacccaagaagacaattccaggcttggtgcttgggatgcaaatacagcagatcagacaaaatctaatgaatggtcaggttggggaaagaagaaagaagttacccaagaagacaattccaggtttggtgcttgggatgcaaatgcagaagatcagacaaaatctaatgaatggtcaggttggggaaagaagaaagatgttacccaagaagacaattccaggcttggtgcttgggatgcaaatgcagcagatcagacaaaatctaatgaatggtcagactggggaaagaagaaagaagttacccaagaagacaatgtccaagattcttggggctccggtaagaggaaagacaaagttacccaagaagacaattctgggtctggtggttggggtgccaacagaacagatctggcaaaatccaaatctagtgaatggtccagctggggaaagaacaagtctgaaataccagctggtggatctgaaaatgtgcagaatgactcatggggctcgggtaaattggaagatgatacccaaaaagaaaattctgggtctgcatgggtgagaaataaagctgaaacaatagatggtgggtcagaaaagccccaagaggatgcttggaattctggtaattggaaagctgaatcaaaagtcggcaatgcctcttggggaaaacccaaatcctcagaaagtcaagcatgggattcccataatcagtcaaatcaaaattcaagttcacagggatgggaatcacatattgcttcagctaattcagaaagtgaaaaaggttttcagtggggaaagcaaggtagagactcgtttaagaaaaatcgatttgaaggttcgcaaggccggggttcaaatgctggtgactggaaaaataggaatcgcccacctagagcccctggacagagattggacatttattcatctggtgagcaggatgttctgaaggatattgaacccattatgcagtctatcagacgaatcatgcaacaacaggggtacaatgatggggacccactggctgctgaagatcaactttttgtactggagaatgtctttgagcaccacccagataaagaaaccaaaatgggcactggaattgattatgtcatggttaacaaacacagtagtttccaggaaagtagatgcttttatgtggtttgtaaagatggtgaaagcaaggacttttcctaccggaagtgtttggccaactatataagcaagaagtatcctgaccttgctgaatcattccttggaaaatattttcggaaacctcgtgcacggggggaccagactgcaacaccagggcgggatgaagcagccactccgggcgagcagacagcaacgccaggccgggatgaagcagcaactccggctgagcagatctcaacacccacccctatggaaaccaatgagtagattacagttgtgtccataatattgtacagaaacagtgcagttgaggccactgaatagtttgtcatagctgaccaattttcctgtaggaaagtgttcctctttttggtgaacagttagatggtaatttttttagcatgtgaatgatgatagcaaacacccttgtgcagatgttaatattgttctgatgattacagcacatatgatgtgcctagcaaactttgctcatcattttgtttaatcatcaatggcacctgggtttcagaccttgattggaccactgatgcaaaaatggcatccttgtgattagagtttcatgaatcagattgtggcttatattctgtttaataggttactaagcatttccgagttatatttaaactggtaaaatttctttgatttagttttttcttgtct

SEQ ID NO: 133 - DNA, 6943 bp, Glycine max
aaaaaagaagtaaaatttcatttcatgttcatgttcatttcacactcactcgcttactcactctcagtctcacacactctctctcatttcatttctctccggaaaacctttccccttcgaaaccctctttctctctcgctctttgttgtttcgatcggtttcgcgcaacgaggttctttgcattttctagggttttgcgagctgagcgagacgtttgaattgaacagcttttgtttcgctcctgaggtagaatcaggcactgtaattgaccacgaaagtaatggaggataatcccccttcaagtgttttagatgggaccgttgttgggatcaaatttggtatggctacacgccaggaaatttgtacagcatccattagtgactcttcaattagtcatgctagtcagctgtcaaatccattccttgggctgccccttgagtttggcagatgtgaatcttgtggtacttctgaagttggaaaatgcgaaggtcacttcggatatattgagttgccaattccaatatatcacccaagtcatatcagtgacttgaaacggatgctgagcatggtctgcttaaactgcctaaaattaaggaaaaccaagcttccagcttcaagcagtggtttagcccagagattaatatctccttgttgtcaggaggataaggctgctctagtttctattcgggaagttaaaacaagtgatggggcttgttatctggcgttgaaagtatccaaatccaagatgcaaaatggtttttggagtttcttagaaaaatatggttatcgctatgggggtgatcacactcgagccttgcttccttgtgaggcaatggaaattattaagagaattccgatagagacaaaaaaaaagcttgctggaaaaggatattttcctcaagatggatatgttttgaagtatcttccggtgccaccaaattgcttgtctgtgccagaagtttcagacggtgtcagtgtcatgtcgtcggatccttccataacaattctcagaaaattgctcaggaaggttgaaatcataaaaagctctagatctggtgaaccaaatttcgagtctcatcacgtagaagcaaatgatttgcagtctgtggttgatcaatattttcaaattagaggaacttctaagccagcacgtgatatagagacacattttggggtcaataaagagcttactgcatcctcaacaaaagcatggcttgagaaaatgaggacattatttataagaaagggttcaggtttttcttcccggaatgtaattactggagattgttataagaggataaatgaagtaggaattccggttgaagttgcccaacggataacgtttgaggagagagttaacatccacaacatcagatatttacagaagttggttgatgaacatttgtgcctgacctacaaggaaggtgggtcaacttattcactcagggagggctcaaaggggcacatatatctcaagcctggtcagatagtgcatcggaggattatggatggggatattgtcttcatcaacagaccacctacaacacacaagcactccttacaagccctttatgtttacatccatgaagaccacactgtgaagataaatcctttaatttgtggaccacttggggctgattttgatggtgactgtgtccatctgttttatccgcaatcacttgctgctaaagctgaagttgtggagctattttctgtggagaatcaactgctcagctctcacagtggtaatttgaacctacagttatccacagactcgttgttgtcactgaagatgttggtcaagagatgtttttttgatagagcagcagctaatcaattggcgatgtttattttgcttcctttgcctcggcctgctttgctcaaggccagttctggtgatgcttgttggacttccatccaaattttacagtgtgctttacctttgggttttgattgcactgggggacggtatttgattaggcagagtgagatcttagaatttgaattcagcagggatgttctgcctgcaaccgtaaatgaaatagcagcttcagttttctttggcaagggtcccaaggaggcacttaatttctttgatgtattgcaaccctttttgatggaaagcttatttgcggaagggtttagtgttagcctggaagagttttcaatatccagggcaattaaaaggataataagaaaaagcattggaaaagtttcttctctgctgtatcagctgaggtccttgtacaatgagctggtggcgcagcaactggagaagcacattcgagatgttgaacttcctatcattaattttgctctaaagtcaactaaattaggagatttaattgattcaaagagtaaatctgctattgataaggttgttcagcagattgggtttttagggcagcaactttttgataggggaagattctactcaaagggattggtagatgatgtggcatcacattttcatgcaaagtgttgttatgacggggatggttatccctctgctgagtatggactgctcaaagggtgtttttttaatggtttggatccatacgaagagatggtgcattcgatttcaacaagggaaataatggtgcgttcttcgagaggattatctgaaccaggaacactctttaagaatttgatggccatccttcgggatgttgttatctgttatgatggaactgtcagaaacatttgtagtaattccatcatccagtttgaatacgggatacaagctggagacaaaagtgagcacttattccctgctggtgagcctgtaggtgtgttggctgcaactgctatgtcaaatcctgcttacaaggctgtccttgatgctagtcctagtagcaactcttcatgggagttgatgaaggaaatattactctgcaaggttaattttaggaatgaacttgttgatcggcgtgtcattttgtacttgaatgactgtgattgtggagggagttattgccgagaaaatgcagcatattcagttaaagatcaattgagaaaagtcagtctcaaggatgcagctgtggagttcattattgaataccaacaacagcgaactcaaaaggaaaattctgaaactgatgttggacttgttggtcatatttatttggatgagatgatgttagaggagctgaagatcagcatggcctatgttttcgacaaatgccatgaaagactcaagtcttttagtcagaaaaagaaagttaatcaatctttgaagaacattgaattatcatttagtgagtcttgctcatcttcacatcctgctgcaccatgtttaacattttggctaaagaattatgatagtgatttggataatgctgtaaaggtcctggctgaaaagatctgccctgttctgtttaaaacaataatccaaggagacccgcgcattagctctgcgagtataatctgggttagtccagatacaaacacatgggtccgaaacccttataaatcttctaatggtgaattggcacttgacatcattctcgagaaggaagctgtcaagcagagtggcgatgcttggagagttgtacttgatgcctgccttcctgttcttcacttgattgataccaggcgttccatcccttacgctattaagcagattcaggaattactggggatatcatgtacttttgatcaagcgattcagcgtgttgcagcatctgtgaaaatggtggcgaaaggtgtacttagggagcatctaattctgttagctagtagtatgacttgtggtgggaacttggttggctttaatataggtggatataaagctctgtctcgtcaattaaatatacaagtaccattcacagatgcaacactctttacacctaaaaagtgttttgagagagctgctgagaaatgccatactgattctctgtcaagcatagttgcctcctgttcctggggtaaacatgtggcagttggtacaggatcaaaatttgatgttgtttgggatgcaaatgagataaaatcaaatgaaattgaagggatggatgtttacagttttcttcacatggtgaaaagctttaccaatggcgaagaagaaaccgatgcttgtttgggtgaagatattgatgatttgctggaagaagaatatatggacttgggcatgtccccacaacataactctggttttgaagctgtctttgaagagaatcctgaagtactgaatggttcaacatccaatggttgggatgtaagttcaaatcagggtgaatcaaaaaccaatgagtggtcaggttgggcaagtagtaacaaagctgaaataaaagatggtagatctgaaattgcccccaagaattcttgggggaaaactgtcaaccaagaagactcttccaagtctaacccttggagtacaagcaccatagcagatcagacaaaaactaaatctaatgaatggtctgcctggggaagtaacaagtctgaaataccagttggttgggcaagtagtaacaaaactgaaataaaagatggtagatctgaaactgcccaagagaattcttgggggaaaactgtcaaccaagaagactcttccaagtctaatgcttggaatacaagcaccacagtagatcatgcaaacactaaatctaatgaatggtctgcctggggaagtaaccagtctgaaataccagctggtggatctaaagcagttcaagaagattcttggggctcaagtaagtggaaggctgatgttgcccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatgcagcagatcagacaaaatctagagactggtcgggttggggaaagaagaaagatattacccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatacagcagatcagacaaaatctaatgaatggtcaggttggggaaagaagaaagaagttacccaagaagacaattccaggcttggtgcttgggatgcaaatacagcagatcagacaaaatctaatgaatggtcaggttggggaaagaagaaagaagttacccaagaagacaattccaggtttggtgcttgggatgcaaatgcagaagatcagacaaaatctaatgaatggtcaggttggggaaagaagaaagatgttacccaagaagacaattccaggcttggtgcttgggatgcaaatgcagcagatcagacaaaatctaatgaatggtcagactggggaaagaagaaagaagttacccaagaagacaatgtccaagattcttggggctccggtaagaggaaagacaaagttacccaagaagacaattctgggtctggtggttggggtgccaacagaacagatctggcaaaatccaaatctagtgaatggtccagctggggaaagaacaagtctgaaataccagctggtggatctgaaaatgtgcagaatgactcatggggctcgggtaaattggaagatgatacccaaaaagaaaattctgggtctgcatgggtgagaaataaagctgaaacaatagatggtgggtcagaaaagccccaagaggatgcttggaattctggtaattggaaagctgaatcaaaagtcggcaatgcctcttggggaaaacccaaatcctcagaaagtcaagcatgggattcccataatcagtcaaatcaaaattcaagttcacagggatgggaatcacatattgcttcagctaattcagaaagtgaaaaaggttttcagtggggaaagcaaggtagagactcgtttaagaaaaatcgatttgaaggttcgcaaggccggggttcaaatgctggtgactggaaaaataggaatcgcccacctagagcccctggacagagattggacatttattcatctggtgagcaggatgttctgaaggatattgaacccattatgcagtctatcagacgaatcatgcaacaacaggggtacaatgatggggacccactggctgctgaagatcaactttttgtactggagaatgtctttgagcaccacccagataaagaaaccaaaatgggcactggaattgattatgtcatggttaacaaacacagtagtttccaggaaagtagatgcttttatgtggtttgtaaagatggtgaaagcaaggacttttcctaccggaagtgtttggccaactatataagcaagaagtatcctgaccttgctgaatcattccttggaaaatattttcggaaacctcgtgcacggggggaccagactgcaacaccagggcgggatgaagcagccactccgggcgagcagacagcaacgccaggccgggatgaagcagcaactccggctgagcagatctcaacacccacccctatggaaaccaatgagtagattacagttgtgtccataatattgtacagaaacagtgcagttgaggccactgaatagtttgtcatagctgaccaattttcctgtaggaaagtgttcctctttttggtgaacagttagatggtaatttttttagcatgtgaatgatgatagcaaacacccttgtgcagatgttaatattgttctgatgattacagcacatatgatgtgcctagcaaactttgctcatcattttgtttaatcatcaatggcacctgggtttcagaccttgattggaccactgatgcaaaaatggcatccttgtgattagagtttcatgaatcagattgtggcttatattctgtttaataggttactaagcatttccgagttatatttaaactggtaaaatttctttgatttagttttttcttgtct

SEQ ID NO: 134 - DNA, 6933 bp, Glycine max
aaaaaagaagtaaaatttcatttcatgttcatgttcatttcacactcactcgcttactcactctcagtctcacacactctctctcatttcatttctctccggaaaacctttccccttcgaaaccctctttctctctcgctctttgttgtttcgatcggtttcgcgcaacgaggttctttgcattttctagggttttgcgagctgagcgagacgtttgaattgaacagcttttgtttcgctcctgaggcactgtaattgaccacgaaagtaatggaggataatcccccttcaagtgttttagatgggaccgttgttgggatcaaatttggtatggctacacgccaggaaatttgtacagcatccattagtgactcttcaattagtcatgctagtcagctgtcaaatccattccttgggctgccccttgagtttggcagatgtgaatcttgtggtacttctgaagttggaaaatgcgaaggtcacttcggatatattgagttgccaattccaatatatcacccaagtcatatcagtgacttgaaacggatgctgagcatggtctgcttaaactgcctaaaattaaggaaaaccaagcttccagcttcaagcagtggtttagcccagagattaatatctccttgttgtcaggaggataaggctgctctagtttctattcgggaagttaaaacaagtgatggggcttgttatctggcgttgaaagtatccaaatccaagatgcaaaatggtttttggagtttcttagaaaaatatggttatcgctatgggggtgatcacactcgagccttgcttccttgtgaggcaatggaaattattaagagaattccgatagagacaaaaaaaaagcttgctggaaaaggatattttcctcaagatggatatgttttgaagtatcttccggtgccaccaaattgcttgtctgtgccagaagtttcagacggtgtcagtgtcatgtcgtcggatccttccataacaattctcagaaaattgctcaggaaggttgaaatcataaaaagctctagatctggtgaaccaaatttcgagtctcatcacgtagaagcaaatgatttgcagtctgtggttgatcaatattttcaaattagaggaacttctaagccagcacgtgatatagagacacattttggggtcaataaagagcttactgcatcctcaacaaaagcatggcttgagaaaatgaggacattatttataagaaagggttcaggtttttcttcccggaatgtaattactggagattgttataagaggataaatgaagtaggaattccggttgaagttgcccaacggataacgtttgaggagagagttaacatccacaacatcagatatttacagaagttggttgatgaacatttgtgcctgacctacaaggaaggtgggtcaacttattcactcagggagggctcaaaggggcacatatatctcaagcctggtcagatagtgcatcggaggattatggatggggatattgtcttcatcaacagaccacctacaacacacaagcactccttacaagccctttatgtttacatccatgaagaccacactgtgaagataaatcctttaatttgtggaccacttggggctgattttgatggtgactgtgtccatctgttttatccgcaatcacttgctgctaaagctgaagttgtggagctattttctgtggagaatcaactgctcagctctcacagtggtaatttgaacctacagttatccacagactcgttgttgtcactgaagatgttggtcaagagatgtttttttgatagagcagcagctaatcaattggcgatgtttattttgcttcctttgcctcggcctgctttgctcaaggccagttctggtgatgcttgttggacttccatccaaattttacagtgtgctttacctttgggttttgattgcactgggggacggtatttgattaggcagagtgagatcttagaatttgaattcagcagggatgttctgcctgcaaccgtaaatgaaatagcagcttcagttttctttggcaagggtcccaaggaggcacttaatttctttgatgtattgcaaccctttttgatggaaagcttatttgcggaagggtttagtgttagcctggaagagttttcaatatccagggcaattaaaaggataataagaaaaagcattggaaaagtttcttctctgctgtatcagctgaggtccttgtacaatgagctggtggcgcagcaactggagaagcacattcgagatgttgaacttcctatcattaattttgctctaaagtcaactaaattaggagatttaattgattcaaagagtaaatctgctattgataaggttgttcagcagattgggtttttagggcagcaactttttgataggggaagattctactcaaagggattggtagatgatgtggcatcacattttcatgcaaagtgttgttatgacggggatggttatccctctgctgagtatggactgctcaaagggtgtttttttaatggtttggatccatacgaagagatggtgcattcgatttcaacaagggaaataatggtgcgttcttcgagaggattatctgaaccaggaacactctttaagaatttgatggccatccttcgggatgttgttatctgttatgatggaactgtcagaaacatttgtagtaattccatcatccagtttgaatacgggatacaagctggagacaaaagtgagcacttattccctgctggtgagcctgtaggtgtgttggctgcaactgctatgtcaaatcctgcttacaaggctgtccttgatgctagtcctagtagcaactcttcatgggagttgatgaaggaaatattactctgcaaggttaattttaggaatgaacttgttgatcggcgtgtcattttgtacttgaatgactgtgattgtggagggagttattgccgagaaaatgcagcatattcagttaaagatcaattgagaaaagtcagtctcaaggatgcagctgtggagttcattattgaataccaacaacagcgaactcaaaaggaaaattctgaaactgatgttggacttgttggtcatatttatttggatgagatgatgttagaggagctgaagatcagcatggcctatgttttcgacaaatgccatgaaagactcaagtcttttagtcagaaaaagaaagttaatcaatctttgaagaacattgaattatcatttagtgagtcttgctcatcttcacatcctgctgcaccatgtttaacattttggctaaagaattatgatagtgatttggataatgctgtaaaggtcctggctgaaaagatctgccctgttctgtttaaaacaataatccaaggagacccgcgcattagctctgcgagtataatctgggttagtccagatacaaacacatgggtccgaaacccttataaatcttctaatggtgaattggcacttgacatcattctcgagaaggaagctgtcaagcagagtggcgatgcttggagagttgtacttgatgcctgccttcctgttcttcacttgattgataccaggcgttccatcccttacgctattaagcagattcaggaattactggggatatcatgtacttttgatcaagcgattcagcgtgttgcagcatctgtgaaaatggtggcgaaaggtgtacttagggagcatctaattctgttagctagtagtatgacttgtggtgggaacttggttggctttaatataggtggatataaagctctgtctcgtcaattaaatatacaagtaccattcacagatgcaacactctttacacctaaaaagtgttttgagagagctgctgagaaatgccatactgattctctgtcaagcatagttgcctcctgttcctggggtaaacatgtggcagttggtacaggatcaaaatttgatgttgtttgggatgcaaatgagataaaatcaaatgaaattgaagggatggatgtttacagttttcttcacatggtgaaaagctttaccaatggcgaagaagaaaccgatgcttgtttgggtgaagatattgatgatttgctggaagaagaatatatggacttgggcatgtccccacaacataactctggttttgaagctgtctttgaagagaatcctgaagtactgaatggttcaacatccaatggttgggatgtaagttcaaatcagggtgaatcaaaaaccaatgagtggtcaggttgggcaagtagtaacaaagctgaaataaaagatggtagatctgaaattgcccccaagaattcttgggggaaaactgtcaaccaagaagactcttccaagtctaacccttggagtacaagcaccatagcagatcagacaaaaactaaatctaatgaatggtctgcctggggaagtaacaagtctgaaataccagttggttgggcaagtagtaacaaaactgaaataaaagatggtagatctgaaactgcccaagagaattcttgggggaaaactgtcaaccaagaagactcttccaagtctaatgcttggaatacaagcaccacagtagatcatgcaaacactaaatctaatgaatggtctgcctggggaagtaaccagtctgaaataccagctggtggatctaaagcagttcaagaagattcttggggctcaagtaagtggaaggctgatgttgcccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatgcagcagatcagacaaaatctagagactggtcgggttggggaaagaagaaagatattacccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatacagcagatcagacaaaatctaatgaatggtcaggttggggaaagaagaaagaagttacccaagaagacaattccaggcttggtgcttgggatgcaaatacagcagatcagacaaaatctaatgaatggtcaggttggggaaagaagaaagaagttacccaagaagacaattccaggtttggtgcttgggatgcaaatgcagaagatcagacaaaatctaatgaatggtcaggttggggaaagaagaaagatgttacccaagaagacaattccaggcttggtgcttgggatgcaaatgcagcagatcagacaaaatctaatgaatggtcagactggggaaagaagaaagaagttacccaagaagacaatgtccaagattcttggggctccggtaagaggaaagacaaagttacccaagaagacaattctgggtctggtggttggggtgccaacagaacagatctggcaaaatccaaatctagtgaatggtccagctggggaaagaacaagtctgaaataccagctggtggatctgaaaatgtgcagaatgactcatggggctcgggtaaattggaagatgatacccaaaaagaaaattctgggtctgcatgggtgagaaataaagctgaaacaatagatggtgggtcagaaaagccccaagaggatgcttggaattctggtaattggaaagctgaatcaaaagtcggcaatgcctcttggggaaaacccaaatcctcagaaagtcaagcatgggattcccataatcagtcaaatcaaaattcaagttcacagggatgggaatcacatattgcttcagctaattcagaaagtgaaaaaggttttcagtggggaaagcaaggtagagactcgtttaagaaaaatcgatttgaaggttcgcaaggccggggttcaaatgctggtgactggaaaaataggaatcgcccacctagagcccctggacagagattggacatttattcatctggtgagcaggatgttctgaaggatattgaacccattatgcagtctatcagacgaatcatgcaacaacaggggtacaatgatggggacccactggctgctgaagatcaactttttgtactggagaatgtctttgagcaccacccagataaagaaaccaaaatgggcactggaattgattatgtcatggttaacaaacacagtagtttccaggaaagtagatgcttttatgtggtttgtaaagatggtgaaagcaaggacttttcctaccggaagtgtttggccaactatataagcaagaagtatcctgaccttgctgaatcattccttggaaaatattttcggaaacctcgtgcacggggggaccagactgcaacaccagggcgggatgaagcagccactccgggcgagcagacagcaacgccaggccgggatgaagcagcaactccggctgagcagatctcaacacccacccctatggaaaccaatgagtagattacagttgtgtccataatattgtacagaaacagtgcagttgaggccactgaatagtttgtcatagctgaccaattttcctgtaggaaagtgttcctctttttggtgaacagttagatggtaatttttttagcatgtgaatgatgatagcaaacacccttgtgcagatgttaatattgttctgatgattacagcacatatgatgtgcctagcaaactttgctcatcattttgtttaatcatcaatggcacctgggtttcagaccttgattggaccactgatgcaaaaatggcatccttgtgattagagtttcatgaatcagattgtggcttatattctgtttaataggttactaagcatttccgagttatatttaaactggtaaaatttctttgatttagttttttcttgtct

SEQ ID NO: 135 - DNA, 6864 bp, Glycine max
tcatgttcatttcacactcactcgcttactcactctcagtctcacacactctctctcatttcatttctctccggaaaacctttccccttcgaaaccctctttctctctcgctctttgttgtttcgatcggtttcgcgcaacgaggttctttgcattttctagggttttgcgagctgagcgagacgtttgaattgaacagcttttgtttcgctcctgaggtagaatcaggcactgtaattgaccacgaaagtaatggaggataatcccccttcaagtgttttagatgggaccgttgttgggatcaaatttggtatggctacacgccaggaaatttgtacagcatccattagtgactcttcaattagtcatgctagtcagctgtcaaatccattccttgggctgccccttgagtttggcagatgtgaatcttgtggtacttctgaagttggaaaatgcgaaggtcacttcggatatattgagttgccaattccaatatatcacccaagtcatatcagtgacttgaaacggatgctgagcatggtctgcttaaactgcctaaaattaaggaaaaccaagcttccagcttcaagcagtggtttagcccagagattaatatctccttgttgtcaggaggataaggctgctctagtttctattcgggaagttaaaacaagtgatggggcttgttatctggcgttgaaagtatccaaatccaagatgcaaaatggtttttggagtttcttagaaaaatatggttatcgctatgggggtgatcacactcgagccttgcttccttgtgaggcaatggaaattattaagagaattccgatagagacaaaaaaaaagcttgctggaaaaggatattttcctcaagatggatatgttttgaagtatcttccggtgccaccaaattgcttgtctgtgccagaagtttcagacggtgtcagtgtcatgtcgtcggatccttccataacaattctcagaaaattgctcaggaaggttgaaatcataaaaagctctagatctggtgaaccaaatttcgagtctcatcacgtagaagcaaatgatttgcagtctgtggttgatcaatattttcaaattagaggaacttctaagccagcacgtgatatagagacacattttggggtcaataaagagcttactgcatcctcaacaaaagcatggcttgagaaaatgaggacattatttataagaaagggttcaggtttttcttcccggaatgtaattactggagattgttataagaggataaatgaagtaggaattccggttgaagttgcccaacggataacgtttgaggagagagttaacatccacaacatcagatatttacagaagttggttgatgaacatttgtgcctgacctacaaggaaggtgggtcaacttattcactcagggagggctcaaaggggcacatatatctcaagcctggtcagatagtgcatcggaggattatggatggggatattgtcttcatcaacagaccacctacaacacacaagcactccttacaagccctttatgtttacatccatgaagaccacactgtgaagataaatcctttaatttgtggaccacttggggctgattttgatggtgactgtgtccatctgttttatccgcaatcacttgctgctaaagctgaagttgtggagctattttctgtggagaatcaactgctcagctctcacagtggtaatttgaacctacagttatccacagactcgttgttgtcactgaagatgttggtcaagagatgtttttttgatagagcagcagctaatcaattggcgatgtttattttgcttcctttgcctcggcctgctttgctcaaggccagttctggtgatgcttgttggacttccatccaaattttacagtgtgctttacctttgggttttgattgcactgggggacggtatttgattaggcagagtgagatcttagaatttgaattcagcagggatgttctgcctgcaaccgtaaatgaaatagcagcttcagttttctttggcaagggtcccaaggaggcacttaatttctttgatgtattgcaaccctttttgatggaaagcttatttgcggaagggtttagtgttagcctggaagagttttcaatatccagggcaattaaaaggataataagaaaaagcattggaaaagtttcttctctgctgtatcagctgaggtccttgtacaatgagctggtggcgcagcaactggagaagcacattcgagatgttgaacttcctatcattaattttgctctaaagtcaactaaattaggagatttaattgattcaaagagtaaatctgctattgataaggttgttcagcagattgggtttttagggcagcaactttttgataggggaagattctactcaaagggattggtagatgatgtggcatcacattttcatgcaaagtgttgttatgacggggatggttatccctctgctgagtatggactgctcaaagggtgtttttttaatggtttggatccatacgaagagatggtgcattcgatttcaacaagggaaataatggtgcgttcttcgagaggattatctgaaccaggaacactctttaagaatttgatggccatccttcgggatgttgttatctgttatgatggaactgtcagaaacatttgtagtaattccatcatccagtttgaatacgggatacaagctggagacaaaagtgagcacttattccctgctggtgagcctgtaggtgtgttggctgcaactgctatgtcaaatcctgcttacaaggctgtccttgatgctagtcctagtagcaactcttcatgggagttgatgaaggaaatattactctgcaaggttaattttaggaatgaacttgttgatcggcgtgtcattttgtacttgaatgactgtgattgtggagggagttattgccgagaaaatgcagcatattcagttaaagatcaattgagaaaagtcagtctcaaggatgcagctgtggagttcattattgaataccaacaacagcgaactcaaaaggaaaattctgaaactgatgttggacttgttggtcatatttatttggatgagatgatgttagaggagctgaagatcagcatggcctatgttttcgacaaatgccatgaaagactcaagtcttttagtcagaaaaagaaagttaatcaatctttgaagaacattgaattatcatttagtttatttgttggtctatatcactttctgattatgttccatcttagcagtgagtcttgctcatcttcacatcctgctgcaccatgtttaacattttggctaaagaattatgatagtgatttggataatgctgtaaaggtcctggctgaaaagatctgccctgttctgtttaaaacaataatccaaggagacccgcgcattagctctgcgagtataatctgggttagtccagatacaaacacatgggtccgaaacccttataaatcttctaatggtgaattggcacttgacatcattctcgagaaggaagctgtcaagcagagtggcgatgcttggagagttgtacttgatgcctgccttcctgttcttcacttgattgataccaggcgttccatcccttacgctattaagcagattcaggaattactggggatatcatgtacttttgatcaagcgattcagcgtgttgcagcatctgtgaaaatggtggcgaaaggtgtacttagggagcatctaattctgttagctagtagtatgacttgtggtgggaacttggttggctttaatataggtggatataaagctctgtctcgtcaattaaatatacaagtaccattcacagatgcaacactctttacacctaaaaagtgttttgagagagctgctgagaaatgccatactgattctctgtcaagcatagttgcctcctgttcctggggtaaacatgtggcagttggtacaggatcaaaatttgatgttgtttgggatgcaaatgagataaaatcaaatgaaattgaagggatggatgtttacagttttcttcacatggtgaaaagctttaccaatggcgaagaagaaaccgatgcttgtttgggtgaagatattgatgatttgctggaagaagaatatatggacttgggcatgtccccacaacataactctggttttgaagctgtctttgaagagaatcctgaagtactgaatggttcaacatccaatggttgggatgtaagttcaaatcagggtgaatcaaaaaccaatgagtggtcaggttgggcaagtagtaacaaagctgaaataaaagatggtagatctgaaattgcccccaagaattcttgggggaaaactgtcaaccaagaagactcttccaagtctaacccttggagtacaagcaccatagcagatcagacaaaaactaaatctaatgaatggtctgcctggggaagtaacaagtctgaaataccagttggttgggcaagtagtaacaaaactgaaataaaagatggtagatctgaaactgcccaagagaattcttgggggaaaactgtcaaccaagaagactcttccaagtctaatgcttggaatacaagcaccacagtagatcatgcaaacactaaatctaatgaatggtctgcctggggaagtaaccagtctgaaataccagctggtggatctaaagcagttcaagaagattcttggggctcaagtaagtggaaggctgatgttgcccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatgcagcagatcagacaaaatctagagactggtcgggttggggaaagaagaaagatattacccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatacagcagatcagacaaaatctaatgaatggtcaggttggggaaagaagaaagaagttacccaagaagacaattccaggcttggtgcttgggatgcaaatacagcagatcagacaaaatctaatgaatggtcaggttggggaaagaagaaagaagttacccaagaagacaattccaggcttggtgcttgggatgcaaatgcagcagatcagacaaaatctaatgaatggtcagactggggaaagaagaaagaagttacccaagaagacaatgtccaagattcttggggctccggtaagaggaaagacaaagttacccaagaagacaattctgggtctggtggttggggtgccaacagaacagatctggcaaaatccaaatctagtgaatggtccagctggggaaagaacaagtctgaaataccagctggtggatctgaaaatgtgcagaatgactcatggggctcgggtaaattggaagatgatacccaaaaagaaaattctgggtctgcatgggtgagaaataaagctgaaacaatagatggtgggtcagaaaagccccaagaggatgcttggaattctggtaattggaaagctgaatcaaaagtcggcaatgcctcttggggaaaacccaaatcctcagaaagtcaagcatgggattcccataatcagtcaaatcaaaattcaagttcacagggatgggaatcacatattgcttcagctaattcagaaagtgaaaaaggttttcagtggggaaagcaaggtagagactcgtttaagaaaaatcgatttgaaggttcgcaaggccggggttcaaatgctggtgactggaaaaataggaatcgcccacctagagcccctggacagagattggacatttattcatctggtgagcaggatgttctgaaggatattgaacccattatgcagtctatcagacgaatcatgcaacaacaggggtacaatgatggggacccactggctgctgaagatcaactttttgtactggagaatgtctttgagcaccacccagataaagaaaccaaaatgggcactggaattgattatgtcatggttaacaaacacagtagtttccaggaaagtagatgcttttatgtggtttgtaaagatggtgaaagcaaggacttttcctaccggaagtgtttggccaactatataagcaagaagtatcctgaccttgctgaatcattccttggaaaatattttcggaaacctcgtgcacggggggaccagactgcaacaccagggcgggatgaagcagccactccgggcgagcagacagcaacgccaggccgggatgaagcagcaactccggctgagcagatctcaacacccacccctatggaaaccaatgagtagattacagttgtgtccataatattgtacagaaacagtgcagttgaggccactgaatagtttgtcatagctgaccaattttcctgtaggaaagtgttcctctttttggtgaacagttagatggtaatttttttagcatgtgaatgatgatagcaaacacccttgtgcagatgttaatattgttctgatgattacagcacatatgatgtgcctagcaaactttgctcatcattttgtttaatcatcaatggcacctgggtttcagaccttgattggaccactgatgcaaaaatggcatccttgtgattagagtttcatgaatcagattgtggcttatattctgtttaataggttactaagcatttccgagttatatttaaactggtaaaatttctttgatttagttttttcttgtct

SEQ ID NO: 136 - DNA, 6834 bp, Glycine max
aaaaaagaagtaaaatttcatttcatgttcatgttcatttcacactcactcgcttactcactctcagtctcacacactctctctcatttcatttctctccggaaaacctttccccttcgaaaccctctttctctctcgctctttgttgtttcgatcggtttcgcgcaacgaggttctttgcattttctagggttttgcgagctgagcgagacgtttgaattgaacagcttttgtttcgctcctgaggcactgtaattgaccacgaaagtaatggaggataatcccccttcaagtgttttagatgggaccgttgttgggatcaaatttggtatggctacacgccaggaaatttgtacagcatccattagtgactcttcaattagtcatgctagtcagctgtcaaatccattccttgggctgccccttgagtttggcagatgtgaatcttgtggtacttctgaagttggaaaatgcgaaggtcacttcggatatattgagttgccaattccaatatatcacccaagtcatatcagtgacttgaaacggatgctgagcatggtctgcttaaactgcctaaaattaaggaaaaccaagcttccagcttcaagcagtggtttagcccagagattaatatctccttgttgtcaggaggataaggctgctctagtttctattcgggaagttaaaacaagtgatggggcttgttatctggcgttgaaagtatccaaatccaagatgcaaaatggtttttggagtttcttagaaaaatatggttatcgctatgggggtgatcacactcgagccttgcttccttgtgaggcaatggaaattattaagagaattccgatagagacaaaaaaaaagcttgctggaaaaggatattttcctcaagatggatatgttttgaagtatcttccggtgccaccaaattgcttgtctgtgccagaagtttcagacggtgtcagtgtcatgtcgtcggatccttccataacaattctcagaaaattgctcaggaaggttgaaatcataaaaagctctagatctggtgaaccaaatttcgagtctcatcacgtagaagcaaatgatttgcagtctgtggttgatcaatattttcaaattagaggaacttctaagccagcacgtgatatagagacacattttggggtcaataaagagcttactgcatcctcaacaaaagcatggcttgagaaaatgaggacattatttataagaaagggttcaggtttttcttcccggaatgtaattactggagattgttataagaggataaatgaagtaggaattccggttgaagttgcccaacggataacgtttgaggagagagttaacatccacaacatcagatatttacagaagttggttgatgaacatttgtgcctgacctacaaggaaggtgggtcaacttattcactcagggagggctcaaaggggcacatatatctcaagcctggtcagatagtgcatcggaggattatggatggggatattgtcttcatcaacagaccacctacaacacacaagcactccttacaagccctttatgtttacatccatgaagaccacactgtgaagataaatcctttaatttgtggaccacttggggctgattttgatggtgactgtgtccatctgttttatccgcaatcacttgctgctaaagctgaagttgtggagctattttctgtggagaatcaactgctcagctctcacagtggtaatttgaacctacagttatccacagactcgttgttgtcactgaagatgttggtcaagagatgtttttttgatagagcagcagctaatcaattggcgatgtttattttgcttcctttgcctcggcctgctttgctcaaggccagttctggtgatgcttgttggacttccatccaaattttacagtgtgctttacctttgggttttgattgcactgggggacggtatttgattaggcagagtgagatcttagaatttgaattcagcagggatgttctgcctgcaaccgtaaatgaaatagcagcttcagttttctttggcaagggtcccaaggaggcacttaatttctttgatgtattgcaaccctttttgatggaaagcttatttgcggaagggtttagtgttagcctggaagagttttcaatatccagggcaattaaaaggataataagaaaaagcattggaaaagtttcttctctgctgtatcagctgaggtccttgtacaatgagctggtggcgcagcaactggagaagcacattcgagatgttgaacttcctatcattaattttgctctaaagtcaactaaattaggagatttaattgattcaaagagtaaatctgctattgataaggttgttcagcagattgggtttttagggcagcaactttttgataggggaagattctactcaaagggattggtagatgatgtggcatcacattttcatgcaaagtgttgttatgacggggatggttatccctctgctgagtatggactgctcaaagggtgtttttttaatggtttggatccatacgaagagatggtgcattcgatttcaacaagggaaataatggtgcgttcttcgagaggattatctgaaccaggaacactctttaagaatttgatggccatccttcgggatgttgttatctgttatgatggaactgtcagaaacatttgtagtaattccatcatccagtttgaatacgggatacaagctggagacaaaagtgagcacttattccctgctggtgagcctgtaggtgtgttggctgcaactgctatgtcaaatcctgcttacaaggctgtccttgatgctagtcctagtagcaactcttcatgggagttgatgaaggaaatattactctgcaaggttaattttaggaatgaacttgttgatcggcgtgtcattttgtacttgaatgactgtgattgtggagggagttattgccgagaaaatgcagcatattcagttaaagatcaattgagaaaagtcagtctcaaggatgcagctgtggagttcattattgaataccaacaacagcgaactcaaaaggaaaattctgaaactgatgttggacttgttggtcatatttatttggatgagatgatgttagaggagctgaagatcagcatggcctatgttttcgacaaatgccatgaaagactcaagtcttttagtcagaaaaagaaagttaatcaatctttgaagaacattgaattatcatttagtgagtcttgctcatcttcacatcctgctgcaccatgtttaacattttggctaaagaattatgatagtgatttggataatgctgtaaaggtcctggctgaaaagatctgccctgttctgtttaaaacaataatccaaggagacccgcgcattagctctgcgagtataatctgggttagtccagatacaaacacatgggtccgaaacccttataaatcttctaatggtgaattggcacttgacatcattctcgagaaggaagctgtcaagcagagtggcgatgcttggagagttgtacttgatgcctgccttcctgttcttcacttgattgataccaggcgttccatcccttacgctattaagcagattcaggaattactggggatatcatgtacttttgatcaagcgattcagcgtgttgcagcatctgtgaaaatggtggcgaaaggtgtacttagggagcatctaattctgttagctagtagtatgacttgtggtgggaacttggttggctttaatataggtggatataaagctctgtctcgtcaattaaatatacaagtaccattcacagatgcaacactctttacacctaaaaagtgttttgagagagctgctgagaaatgccatactgattctctgtcaagcatagttgcctcctgttcctggggtaaacatgtggcagttggtacaggatcaaaatttgatgttgtttgggatgcaaatgagataaaatcaaatgaaattgaagggatggatgtttacagttttcttcacatggtgaaaagctttaccaatggcgaagaagaaaccgatgcttgtttgggtgaagatattgatgatttgctggaagaagaatatatggacttgggcatgtccccacaacataactctggttttgaagctgtctttgaagagaatcctgaagtactgaatggttcaacatccaatggttgggatgtaagttcaaatcagggtgaatcaaaaaccaatgagtggtcaggttgggcaagtagtaacaaagctgaaataaaagatggtagatctgaaattgcccccaagaattcttgggggaaaactgtcaaccaagaagactcttccaagtctaacccttggagtacaagcaccatagcagatcagacaaaaactaaatctaatgaatggtctgcctggggaagtaacaagtctgaaataccagttggttgggcaagtagtaacaaaactgaaataaaagatggtagatctgaaactgcccaagagaattcttgggggaaaactgtcaaccaagaagactcttccaagtctaatgcttggaatacaagcaccacagtagatcatgcaaacactaaatctaatgaatggtctgcctggggaagtaaccagtctgaaataccagctggtggatctaaagcagttcaagaagattcttggggctcaagtaagtggaaggctgatgttgcccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatgcagcagatcagacaaaatctagagactggtcgggttggggaaagaagaaagatattacccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatacagcagatcagacaaaatctaatgaatggtcaggttggggaaagaagaaagaagttacccaagaagacaattccaggcttggtgcttgggatgcaaatacagcagatcagacaaaatctaatgaatggtcaggttggggaaagaagaaagaagttacccaagaagacaattccaggcttggtgcttgggatgcaaatgcagcagatcagacaaaatctaatgaatggtcagactggggaaagaagaaagaagttacccaagaagacaatgtccaagattcttggggctccggtaagaggaaagacaaagttacccaagaagacaattctgggtctggtggttggggtgccaacagaacagatctggcaaaatccaaatctagtgaatggtccagctggggaaagaacaagtctgaaataccagctggtggatctgaaaatgtgcagaatgactcatggggctcgggtaaattggaagatgatacccaaaaagaaaattctgggtctgcatgggtgagaaataaagctgaaacaatagatggtgggtcagaaaagccccaagaggatgcttggaattctggtaattggaaagctgaatcaaaagtcggcaatgcctcttggggaaaacccaaatcctcagaaagtcaagcatgggattcccataatcagtcaaatcaaaattcaagttcacagggatgggaatcacatattgcttcagctaattcagaaagtgaaaaaggttttcagtggggaaagcaaggtagagactcgtttaagaaaaatcgatttgaaggttcgcaaggccggggttcaaatgctggtgactggaaaaataggaatcgcccacctagagcccctggacagagattggacatttattcatctggtgagcaggatgttctgaaggatattgaacccattatgcagtctatcagacgaatcatgcaacaacaggggtacaatgatggggacccactggctgctgaagatcaactttttgtactggagaatgtctttgagcaccacccagataaagaaaccaaaatgggcactggaattgattatgtcatggttaacaaacacagtagtttccaggaaagtagatgcttttatgtggtttgtaaagatggtgaaagcaaggacttttcctaccggaagtgtttggccaactatataagcaagaagtatcctgaccttgctgaatcattccttggaaaatattttcggaaacctcgtgcacggggggaccagactgcaacaccagggcgggatgaagcagccactccgggcgagcagacagcaacgccaggccgggatgaagcagcaactccggctgagcagatctcaacacccacccctatggaaaccaatgagtagattacagttgtgtccataatattgtacagaaacagtgcagttgaggccactgaatagtttgtcatagctgaccaattttcctgtaggaaagtgttcctctttttggtgaacagttagatggtaatttttttagcatgtgaatgatgatagcaaacacccttgtgcagatgttaatattgttctgatgattacagcacatatgatgtgcctagcaaactttgctcatcattttgtttaatcatcaatggcacctgggtttcagaccttgattggaccactgatgcaaaaatggcatccttgtgattagagtttcatgaatcagattgtggcttatattctgtttaataggttactaagcatttccgagttatatttaaactggtaaaatttctttgatttagttttttcttgtct

SEQ ID NO: 137 - DNA, 6844 bp, Glycine max
aaaaaagaagtaaaatttcatttcatgttcatgttcatttcacactcactcgcttactcactctcagtctcacacactctctctcatttcatttctctccggaaaacctttccccttcgaaaccctctttctctctcgctctttgttgtttcgatcggtttcgcgcaacgaggttctttgcattttctagggttttgcgagctgagcgagacgtttgaattgaacagcttttgtttcgctcctgaggtagaatcaggcactgtaattgaccacgaaagtaatggaggataatcccccttcaagtgttttagatgggaccgttgttgggatcaaatttggtatggctacacgccaggaaatttgtacagcatccattagtgactcttcaattagtcatgctagtcagctgtcaaatccattccttgggctgccccttgagtttggcagatgtgaatcttgtggtacttctgaagttggaaaatgcgaaggtcacttcggatatattgagttgccaattccaatatatcacccaagtcatatcagtgacttgaaacggatgctgagcatggtctgcttaaactgcctaaaattaaggaaaaccaagcttccagcttcaagcagtggtttagcccagagattaatatctccttgttgtcaggaggataaggctgctctagtttctattcgggaagttaaaacaagtgatggggcttgttatctggcgttgaaagtatccaaatccaagatgcaaaatggtttttggagtttcttagaaaaatatggttatcgctatgggggtgatcacactcgagccttgcttccttgtgaggcaatggaaattattaagagaattccgatagagacaaaaaaaaagcttgctggaaaaggatattttcctcaagatggatatgttttgaagtatcttccggtgccaccaaattgcttgtctgtgccagaagtttcagacggtgtcagtgtcatgtcgtcggatccttccataacaattctcagaaaattgctcaggaaggttgaaatcataaaaagctctagatctggtgaaccaaatttcgagtctcatcacgtagaagcaaatgatttgcagtctgtggttgatcaatattttcaaattagaggaacttctaagccagcacgtgatatagagacacattttggggtcaataaagagcttactgcatcctcaacaaaagcatggcttgagaaaatgaggacattatttataagaaagggttcaggtttttcttcccggaatgtaattactggagattgttataagaggataaatgaagtaggaattccggttgaagttgcccaacggataacgtttgaggagagagttaacatccacaacatcagatatttacagaagttggttgatgaacatttgtgcctgacctacaaggaaggtgggtcaacttattcactcagggagggctcaaaggggcacatatatctcaagcctggtcagatagtgcatcggaggattatggatggggatattgtcttcatcaacagaccacctacaacacacaagcactccttacaagccctttatgtttacatccatgaagaccacactgtgaagataaatcctttaatttgtggaccacttggggctgattttgatggtgactgtgtccatctgttttatccgcaatcacttgctgctaaagctgaagttgtggagctattttctgtggagaatcaactgctcagctctcacagtggtaatttgaacctacagttatccacagactcgttgttgtcactgaagatgttggtcaagagatgtttttttgatagagcagcagctaatcaattggcgatgtttattttgcttcctttgcctcggcctgctttgctcaaggccagttctggtgatgcttgttggacttccatccaaattttacagtgtgctttacctttgggttttgattgcactgggggacggtatttgattaggcagagtgagatcttagaatttgaattcagcagggatgttctgcctgcaaccgtaaatgaaatagcagcttcagttttctttggcaagggtcccaaggaggcacttaatttctttgatgtattgcaaccctttttgatggaaagcttatttgcggaagggtttagtgttagcctggaagagttttcaatatccagggcaattaaaaggataataagaaaaagcattggaaaagtttcttctctgctgtatcagctgaggtccttgtacaatgagctggtggcgcagcaactggagaagcacattcgagatgttgaacttcctatcattaattttgctctaaagtcaactaaattaggagatttaattgattcaaagagtaaatctgctattgataaggttgttcagcagattgggtttttagggcagcaactttttgataggggaagattctactcaaagggattggtagatgatgtggcatcacattttcatgcaaagtgttgttatgacggggatggttatccctctgctgagtatggactgctcaaagggtgtttttttaatggtttggatccatacgaagagatggtgcattcgatttcaacaagggaaataatggtgcgttcttcgagaggattatctgaaccaggaacactctttaagaatttgatggccatccttcgggatgttgttatctgttatgatggaactgtcagaaacatttgtagtaattccatcatccagtttgaatacgggatacaagctggagacaaaagtgagcacttattccctgctggtgagcctgtaggtgtgttggctgcaactgctatgtcaaatcctgcttacaaggctgtccttgatgctagtcctagtagcaactcttcatgggagttgatgaaggaaatattactctgcaaggttaattttaggaatgaacttgttgatcggcgtgtcattttgtacttgaatgactgtgattgtggagggagttattgccgagaaaatgcagcatattcagttaaagatcaattgagaaaagtcagtctcaaggatgcagctgtggagttcattattgaataccaacaacagcgaactcaaaaggaaaattctgaaactgatgttggacttgttggtcatatttatttggatgagatgatgttagaggagctgaagatcagcatggcctatgttttcgacaaatgccatgaaagactcaagtcttttagtcagaaaaagaaagttaatcaatctttgaagaacattgaattatcatttagtgagtcttgctcatcttcacatcctgctgcaccatgtttaacattttggctaaagaattatgatagtgatttggataatgctgtaaaggtcctggctgaaaagatctgccctgttctgtttaaaacaataatccaaggagacccgcgcattagctctgcgagtataatctgggttagtccagatacaaacacatgggtccgaaacccttataaatcttctaatggtgaattggcacttgacatcattctcgagaaggaagctgtcaagcagagtggcgatgcttggagagttgtacttgatgcctgccttcctgttcttcacttgattgataccaggcgttccatcccttacgctattaagcagattcaggaattactggggatatcatgtacttttgatcaagcgattcagcgtgttgcagcatctgtgaaaatggtggcgaaaggtgtacttagggagcatctaattctgttagctagtagtatgacttgtggtgggaacttggttggctttaatataggtggatataaagctctgtctcgtcaattaaatatacaagtaccattcacagatgcaacactctttacacctaaaaagtgttttgagagagctgctgagaaatgccatactgattctctgtcaagcatagttgcctcctgttcctggggtaaacatgtggcagttggtacaggatcaaaatttgatgttgtttgggatgcaaatgagataaaatcaaatgaaattgaagggatggatgtttacagttttcttcacatggtgaaaagctttaccaatggcgaagaagaaaccgatgcttgtttgggtgaagatattgatgatttgctggaagaagaatatatggacttgggcatgtccccacaacataactctggttttgaagctgtctttgaagagaatcctgaagtactgaatggttcaacatccaatggttgggatgtaagttcaaatcagggtgaatcaaaaaccaatgagtggtcaggttgggcaagtagtaacaaagctgaaataaaagatggtagatctgaaattgcccccaagaattcttgggggaaaactgtcaaccaagaagactcttccaagtctaacccttggagtacaagcaccatagcagatcagacaaaaactaaatctaatgaatggtctgcctggggaagtaacaagtctgaaataccagttggttgggcaagtagtaacaaaactgaaataaaagatggtagatctgaaactgcccaagagaattcttgggggaaaactgtcaaccaagaagactcttccaagtctaatgcttggaatacaagcaccacagtagatcatgcaaacactaaatctaatgaatggtctgcctggggaagtaaccagtctgaaataccagctggtggatctaaagcagttcaagaagattcttggggctcaagtaagtggaaggctgatgttgcccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatgcagcagatcagacaaaatctagagactggtcgggttggggaaagaagaaagatattacccaagaagacaattccaggcttggtgcttgggatgcaaatgcagcagatcagacaaaatctagtgaatggtcgggttggggaaagaagaaagatgttacccaagaagacaattccaggcttggtgcttgggatgcaaatacagcagatcagacaaaatctaatgaatggtcaggttggggaaagaagaaagaagttacccaagaagacaattccaggcttggtgcttgggatgcaaatacagcagatcagacaaaatctaatgaatggtcaggttggggaaagaagaaagaagttacccaagaagacaattccaggcttggtgcttgggatgcaaatgcagcagatcagacaaaatctaatgaatggtcagactggggaaagaagaaagaagttacccaagaagacaatgtccaagattcttggggctccggtaagaggaaagacaaagttacccaagaagacaattctgggtctggtggttggggtgccaacagaacagatctggcaaaatccaaatctagtgaatggtccagctggggaaagaacaagtctgaaataccagctggtggatctgaaaatgtgcagaatgactcatggggctcgggtaaattggaagatgatacccaaaaagaaaattctgggtctgcatgggtgagaaataaagctgaaacaatagatggtgggtcagaaaagccccaagaggatgcttggaattctggtaattggaaagctgaatcaaaagtcggcaatgcctcttggggaaaacccaaatcctcagaaagtcaagcatgggattcccataatcagtcaaatcaaaattcaagttcacagggatgggaatcacatattgcttcagctaattcagaaagtgaaaaaggttttcagtggggaaagcaaggtagagactcgtttaagaaaaatcgatttgaaggttcgcaaggccggggttcaaatgctggtgactggaaaaataggaatcgcccacctagagcccctggacagagattggacatttattcatctggtgagcaggatgttctgaaggatattgaacccattatgcagtctatcagacgaatcatgcaacaacaggggtacaatgatggggacccactggctgctgaagatcaactttttgtactggagaatgtctttgagcaccacccagataaagaaaccaaaatgggcactggaattgattatgtcatggttaacaaacacagtagtttccaggaaagtagatgcttttatgtggtttgtaaagatggtgaaagcaaggacttttcctaccggaagtgtttggccaactatataagcaagaagtatcctgaccttgctgaatcattccttggaaaatattttcggaaacctcgtgcacggggggaccagactgcaacaccagggcgggatgaagcagccactccgggcgagcagacagcaacgccaggccgggatgaagcagcaactccggctgagcagatctcaacacccacccctatggaaaccaatgagtagattacagttgtgtccataatattgtacagaaacagtgcagttgaggccactgaatagtttgtcatagctgaccaattttcctgtaggaaagtgttcctctttttggtgaacagttagatggtaatttttttagcatgtgaatgatgatagcaaacacccttgtgcagatgttaatattgttctgatgattacagcacatatgatgtgcctagcaaactttgctcatcattttgtttaatcatcaatggcacctgggtttcagaccttgattggaccactgatgcaaaaatggcatccttgtgattagagtttcatgaatcagattgtggcttatattctgtttaataggttactaagcatttccgagttatatttaaactggtaaaatttctttgatttagttttttcttgtct

SEQ ID NO: 138 - DNA, 5601 bp, Glycine max
atgcactaagtaatccaaaatcctatgaaggtggaagggaaattccaaaatgcaatgaccattttgatttccatgtaagttttgtaaccaaagcttttgcaattttccttttctaattttcaaatttgctaaaatttcagtttgagggttcatgagcggcaaacaaacaaaaaaccctccctccctccctcccaaaatttgggtccctcccgccaaagaaaatggtccaatcttaaataggtgtgtagaggtaaccctaaattcaaaatatgcccgtgcaacccatttcctctgaaaccctaaactgaggttctttgctcagtgctagccctaatttgttcaggcagatggagcagtagcaagagggtggtgacagaggtttttcccggagacgcagactgagtagtagccgcaaagcccggaacacgccgtgaaggtagcgcgacaactgcgactgcctctattttcatttctgtttctttcgactcgcaggggatcgccgatctcactatcgagcgagcgcggaagatcgtggaagacatgggttccgcttctcttctgaatccttctcaaccaggcgttaagaagaacagcaagagcaaacagaaatctgttgtttccaaaaccgaagagaaagttatggttaaagataaacaaaagaagcggagtttgttggagagcagtgagcagcctgctgctacacgcaaaatgccaaaacgtgctgcagcgtgtaaaaatttgaaggagaaatcctttttgatatctgagaagtcctgcctcattgaaatggagaaagatcagattgtagaagaagaaagtctagctgtccgcatgacagctggacaggatgatggtcgtccaaataggcgcatcacggagttcattcttcatgatgcaactggtaaagcccagccacttgaggtgctggaggttaatgaattatttatcactggacttatattgccgcttgaagtcagcacaggcaagaaaaaagagaaaggtgttaagtgtgaaggctttggtcgagtggaatcatgggatatatctggctatgaagatggctctccagtgatatggctttctactgatattgctgattatgattgccagaaacctgctgctagttacaaaaaagtttatgatcttttccttgaaaaggcccgtgcatgtatcgaagtatacctgaaacttgcgaagtcctctgggggtgaccctgatatcagtcttgatgagttacttgctggcatggtgcggtctatgagtggtagcaaatgcttttctggaactgcatctataaaggattttgttatttctcatggtgagttcatttataagcaactaattggtttggacatgacatccaaggccaatgacaggacgtttgcagatatccctgctcttattgctcttagagatgagagtaagaaacaagcaaactatgtacatgcacaagtaatgccctcaaatgggagtttaaggattgattcaggagttggagatgaagaaaacaagaatcagatggattcagtagcttctgtaaacgaggaagatgaggatgcaaagctggcacgactgttgcaggaagaagagtattggcaatctatgaagcagaagaaaaactctagaccaacctctgtatcgaacaaatactatataaaaattaatgaagatgagattgccaatgattatcctctacctgcttattataaaacctcccttcaagaaacagatgagtttatagtctttgataatgactatgacatatatgacactcaagatctccctcgaagcatgctgcataattggtctttatacaactcagatgcaagattggtttccttggaacttctgcctatgaaaccttgttcagatattgatgttgcaatctttggatcaggtataatgacttcagatgatgggagtgggtttcatcttgatactgaggctggccaatcttcttctgttggttctggagcccaggttgctgatggaatgccaatttatctgagtgccataaaggaatggatgattgaatttggatcagctatgattttcatatccatccgaactgatttggcctggtatagacttggcaaaccagcaaagcagtatgctccttggtatgacacagtattgaaaactgcaaggcttgctataagcattatcaccttgctgaaggagcagagccgagtatcacgcctttcctttggagatgtcatcaggaaagtatctgagtttaatcagaaagatggttcttacatttcttctgatccattgactgttgagagatatgttgttgtccatggacagataattctgcaactgtttgcagaatttcctgatgataatatcagaaagtcttcatttgtgactggtcttacaaataaaatggaagagcgccaccataccaaatggttagtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaagattcaaaagagggaattgctagtgagttaaaggatgaggatgaagtggaggaacaagaagaaaatgaagatgatgataatgaggaggaaacaatacttttggagggaactccaaaggcacattcagcttcaaagcaaaccaaaaaaatttctgctgacacagaaataagatgggaaggggaacctgaagggaagactagttctggatatcctgtttataaacaggcaattattcgtggtgaagttatttctgtaggaagatctgtgttggtggaagttgacgaaacagatgaatttccagatatatattatgttgaatatatgtttgaatcaaagattggaagaaaaatgttccatggtaggatgatgcaatgtggttgtcagactgttcttggcaatgctgctaatgagagagaggtgtttttgactaatgagtgcagggatttgggactgcatgatgtcaaacagacagttgttgtaaatatccaaaataggccttgggggcatcagcatcgaaaggataatatcattgcagatagagttgacaggactcaagcagaagaaaggaagaagaaaggactacctactgactattactgtaaaagcttgtactggcctgaaagaggtgctttcttcacccttccacatgatacattgggtctagggtctggtgtctgcccatcttgcaaaatacaggatgctgaaaaggagaaggatgttttcaaagtaaattcctccaagtctggtttcctatttaatggaactgagtattctcttgatgattatgtttatgtaagtccttttgaatttgaggaaaagatagagcaaggaactcataaaagtgggaggaatgtggggttgaaagcttatgttgtgtgccaagtgcttgagattgttgtcaaaaaggaaataaaacaagctgaaataaaatctacacaagtcaaaatcaggaggttcttccgaccagaagatttatcaaatgagaaggcatattgctctgatatacgagaggtgtattacagtgatgaaacatatataatctctgtagaatccatagaagggaaatgtcaagtcagaaaaaagaatgatattcccgaatgcagtgctcttggtggaatcttccaaaatgtttttttctgcgagctcttgtatgatcctgccactgggtcactgaagaagttgccggctcatataaaagtaaaatattcaagtggacaaacatctgatgctgcagctagaaagaggaaaggaaaatgtatagagggagatggtgtttcagagtccacaaaggaaggaaaaacattaaatgataaacgtttagcaaccttggacatttttgcaggctgtggtggcttatcagaggggttgcagcagtcaggagtttcatcaactaaatgggctattgagtatgaagaaccagccggggatgcatttaaagctaatcatcctgaggcattggtgttcattaacaattgcaatgttattcttagggctgtaatggagaagtgtggggacacagatgattgtatctcaacatctgaggctgcagaattggctgcaaagcttgatgagaaggaaataagtagtttaccaatgcctggacaagttgatttcattaatggtggtcctccatgccagggtttctctgggatgaataggtttaaccagagcagttggagtaaagtccagtgtgagatgatattggcattcttatcctttgctgattatttccggccaaggtatttcttgttggagaatgtgaggaactttgtgtctttcaataaaggacagacattccgtttaactttggcttcacttcttgagatgggttatcaggtgaggtttggtatccttgaggctggagcatttggggtttctcagtcaagaaaaagggcattcatatgggctgcttctcctgaggatgtgcttcctgaatggccagaaccagtgcacgtcttttcggcccctgagttgaagatcacattatcagaaaatgtccagtatgctgctgtccgcagtactgcaaatggtgctcctttacgtgcaataactgttcgagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaacgaattgaacttgattcgatgccagaaaattcccaagagaccaggtgctgattggcgtgaccttccagaagaaaagataaaactgtctagtggacaagttgttgatttgataccatggtgcttgccaaacacggctaagcggcacaatcaatggaagggactgtttggcaggttggattggcaaggaaatttcccaacttccgttacagaccctcagccaatggggaaggttggaatgtgcttccaccctgaccaagataggattcttactgttcgtgaatgtgctcggtctcaaggcttcccagatagctatgaatttgctggcaatatcatacacaagcaccggcagattggtaatgctgtgcctcctcctctagcatcagcattggggagaaagctcaaggaagcagtggacagtaagagctccacttagaagatgggccttctacattaggtcatgcttattgtattcataacagtcaccaagatattgcaaatcatcattccgggttccaaaaactagaaacccttgtatatagtgatatccattggtcatttgttgaggctaattccttgtttaactttcctcaaccaaggaattgaatggatgatgctcattttctatcaactaggattttcttgattagatggtattttggctgtttatgaaagaaatggttgggaattgattacctcccaatgtgtagttgaaaattgagaccaattttttttaacctgttatgaatatttgttgttgcaactatttggctaagaactaccaaaaaaaactatttacctaggaaacttgcataatatttaatcgagg

SEQ ID NO: 139 - DNA, 5375 bp, Glycine max
atttttaaattcctaaaatttcagtttgaggggcgggaaaaaaaaaaattctctcttccaaaatttgcgtccctcccgccaaagaaaatggtccaatcttatatagttgtgtggaggtaaccctaaattcaaaatatgcccctgcaacccaaatcttctgaaatcctaaactaagtttctgtgctaagtgctaaccctaattcgttatggcagatggagcggtagcaagagggaggtgacggacgcttttcggagacgcaaattgaggagtagccgcaaagcccagaaaacgccctgaaccctaattcgtggaagacatgggttcagcttctcttctaaatccttctcaaccaggcgttaagaagaatgacaagagcaaacagaaatcggtcgtttccaaaactgaagaggaagttatgtttaaagataaacaaaagaaacggagtttgtcggagagcagtgagcagactgctgctatgcgcaaaatgccaaaacgtgctgcggcatgtaaaaatttgaaggagaaatcctttttgatatatgagaagtcctgcctcattgaaacagagaaggatcatattgtagaagaagaaagtctggctgtccgcatgacagctggacaggataatggttgtccaaataggcgcattacagagtttatccttcatgatgaaactggtaaatcccagccacttgaggtgctggaggttgatgatttgtttatcactggacttgtattgccacttgaagccagctctggcaagaaaaaagagaaaggtgttaagtgtgaaggctttggtcgaattgaatcatgggatatatctggttatgaagatggctctccagtgatatggctttctactgaagttgctgattatgattgccagaaacctgctgctagttacaaaaaagtttacgatcttttccttgaaaaggcccgtgcatgtgtagaagtatacaagaaacttgcaaagtcctctggtggtgaccctgatataagtcttgatgagttacttgctggcatggtgcggtctatgagtggtagcaaatgcttttctggagctgcatctataaaggattttgttatttcacagggtgagttcatttataagcaacttgttggtttggatatgacatccaaggcaaatgacaggatgtttgcagatattcctgctcttattgctcttagagatgagagtaagaaacaagtacatgcacaggtaatgccctcaaatgggagtttaaggattgattcaggagttggagatgaagaaaacaagaatcagatggattcagtagcttctgtaaacgaggaagatgaggatgcaaagctggcacggctgttgcaggaagaagagtattggcaatctatgaaccagaagaaaaactccagatcagcctctgcatcgaacaaatactatatcaaaattaatgaagatgagattgccaatgattatcctctacctgtttattataaaacctcccttcaagaaacagatgagtttatagtttttgataatgactatgacatatatgacactcaagatctccctcgaagcatgctgcataattggtctttatacaactcagatgcaagattggtttccttggaacttctgcctatgaaaccttgttcagatatcgatgttgcaatctttggatcaggtataatgacttcagatgatggaagtgggtttcatcttgatactgaggctggcaaatcttcttccgttggttctggagcacaggttgctgatggaatgccaatttatctgagtgccataaaggaatggatgattgaatttggatcatctatgattttcatatccatccgaactgatttggcctggtatagacttggcaaaccagcaaagcagtatgctccttggtatgacacagtattgaaaactgcaaggcttgctataagcattatcaccttgctgaaggagcagagccgagtatcacgactttcctttggagatgtcatcaggaaagtatctgagtttgataagaaagacggttcttacatttcttctgatccattgactgttgagagatatgttgttgtccatggacagataattctgcaactgtttgcagaatttcctgatgataagatcagaaagtctgcatttgtgacgggtcttacaaacaaaatggaagagcgccaccataccaaatggttggtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaggatgcaaaagagggaattgctagtgagttaaaggatgaggatgaagtggaggaacaagaagaaaatgaagatgatgacaatgaggagacaatacttttggagggaaccccaaaggcacattcagcttcaaagcaaaccaaaaaattttctgctgaaacagaaataaggtgggaaggggaacctgaagggaagactagttctggatatcctgtttataaacaggcaattattcgtggggaagttatttctgtaggaagatctgtgttggtggaggttgatgaaacagatgaatttccagacatatattatgttgaatatatgtttgaatcaaagatcggaagaaaaatgttccatggtaggatgatgcagcgtggttgtcagactgttcttggcaatgctgctaatgagagagaggtgtttttgactaatgagtgcagggatttgggactgcatgatgtcaatcagacagttgttgtaaatattcaaaataggccttggggacatcagcatcgaaaggataatatcattgcagatagagttgacagggctcaagcagaagaaaggaagaagaaaggactacctactgaatattactgtaaaagcctgtactggcctgaaagaggtgctttctttagccttccacttgatactttggggctagggtctggtgtttgcccatcttgcaaaatacaggatgctgaaaaggagaaggatgttttcaaagtaaattcctccaagtctggtttcctattgaaaggaactgagtattctcttaatgattatatttatgtaagtcccttcgaatttgaggaaatgatagagcaaggaactcataagagtgggaggaatgtggggttgaaagcttatgttgtgtgccaagtgcttgagattgttgtcaaaaaggaaattaaagaagctgaaataaagtctacacaagtcaaaatcaggaggttcttccgaccagaagatgtatcaaatgagaaggcatactgttctgatatacaagaggtgtattacagtgatgaaacacatataatctctgtagaatccatagaagggaaatgtcaagtcagaaaaaagaatgatattcccgaatgcagtgcccttggcagaatgttccaaaatgtttttttctgcgagctcttgtatgatcctgccactgggtcactgaagaagttgccggctcatgtaaaagtaaaatattcaagtggacaaacatctgatgctgcagctagaaagaggaaaggaaaatgtatagagggagatgatgttttagagtccccaaatgaaggaaaaacattaaatgaaaaacgtttagcaaccttggacatttttgcaggttgtggtggcttatcagaggggttgcagcagtcaggagtttcatcaactaaatgggctattgagtatgaagaacctgctggggatgcatttaaagctaatcatcctgaggcattggtgtttattaacaattgcaatgttattcttagggctgtaatggagaagtgtggggacacagatgattgtatctcaacatccgaagctgcagaattggctgcaaagcttgatgagaaggaaataagtagtttaccaatgcctggacaagttgatttcatcaatggtggtcctccatgtcagggtttctctgggatgaataggtttaaccagagcagttggagtaaagtccagtgtgagatgatattggcattcttatcctttgccgattatttccggccaaggtatttcttgttggagaatgtgaggaactttgtgtctttcaataaagggcagacattccgtttaactttggcttcacttcttgagatgggctatcaggtgaggtttggtatccttgaggctggagcatatggggtttcccagtcaagaaaaagggcattcatatgggcagcctctcctgaggatgtgcttcctgaatggcctgaaccaatgcatgtcttttcggcccctgagttgaagattacattatcagaaaatgtccagtatgctgctgtccgcagtactgcaaatggtgctccattacgttcaataactgttcaagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaatgaattgaacttgattcgatgccagaaaattcccaagagaccaggcgctgattggcgtgaccttccagaagaaaagataaaattgtctactggacaagttgttgatttgataccatggtgcttgccaaacacggctaagcggcacaatcagtggaagggactgtttggcaggttggattggcaagggaatttcccaacttccattactgaccctcagccaatggggaaggttggaatgtgcttccaccctgaccaagataggattcttactgttcgtgaatgtgctcggtctcaaggcttcccagatagctatcaatttgctggcaatatcatacacaagcaccggcagattggtaatgctgtgcctcctcctctggcatctgcattggggagaaagctcaaggaagcagtggacagtaagagctccacttagaagatggggcttctacattttttgaaatatcatgcttattgtattcatatcagtcaccaagatattgcaaatcattattcagggttccagaaactagaaacccttgtatatagtgatatccattggtcatttgttttgaggctaattccttgtttaactttcctcaaccaaggaattgtatggatgatgttatgatgttcattttctatcaactagtattttcttgattagataatattttggctgtttatgacagaaatggctgggaatttagaattacctcccaatgtatatagttgacaattgagaccaattttgtcattttttttaacttgttatgaatatttgttgttgcaagtatttggctaagaactaaaaaaaaggtaataccttctttccata

SEQ ID NO: 140 - DNA, 3154 bp, Glycine max
aataagtattatgcttggttggggatacatactgcccaacaaaaatgcacccaaggcaacatttgtgtgggatcttatgaaagaagttggtggtgaaatggatggtggtatggtgcacagtggtgtggtctctatggtcacagaaaatttctgttttttaaggatggaaacattgatggtgaacaggtatgggagatgtttgaagtccatttgtggtcatggttgtcaaggaaaacaaaggactttaacttgtcgttctatgaatggtcaacaatccctttgaaaggtttgtaggtggctcaatgaaaattcaagtagcagttcatggttacagtgatatcaagactgaagcagcagcagagccttgcacaacaaggcttccttttgttctctgtgatggaaggaagttacatgtcaatactggcagcatagtccatggtaataggacaaattcaatattcatgtccagcaacatcataaagaattctgtttcggtattaagagggaatgactcaactgagatgatatattgctacctgggcgaaatattggggtggttggctttacaagataaatttcagaaagttgtcatttgttggttggttggaatttttgggagatgaagcaaaagggaatgaattcacgaggaacatgttgggatgtctggtagacgagaacgagtccgggagtctgactttgaatactatgaacgcgtgtattatgaagacttgaagagtggttactataagctcaaaatctccaagtcatcatataagtgtcccttttgccaggacaagcgggaatactcattgaatgagctttcgaagcatgcagtaagatttgaaagggactcacggagcatgaagataaaagatttagccaagcactctgctcttcaattgtacattaaaaagtatcttgatgtctatgataaagtaggaagtgttgtccatgataaagtagaaagtgttatccatgataaagcaggaagtgttgttcatgatagaccaggaaaagtggtcctagatagatccggaaaagttgtcaatgatggatccggaaatgtttacagtgatagatttggaaaagttgtgaatgatagaccaagaaatgttgtcattgccaatgatagatcagaaaaagttggcaaagatcaactatttgtctggccttgggtgggcattgttgcaaacattgccactgaatttaaaaacggaatgcgtattggagacagtggttccaaactaagggatgagtttactttgaaaggatttcatcctttgaaagttcaaccattatggaaccgttatggacattcaggctttgccattgtagaattctccaaagactgggatggtttcaccaatgcaatgaactttgaaagaagttttgaggcagaacattgtgctaagagggactacgacaatttaagagaccgaggaggtagactgtatggatgggtagctcgtgatgatgattaccactccaagagtataattggtgatcaccttcggaagacgggggatttgcaatctgtttctggaaaacaagcagaggaaaaaaggaaaacaacgctgcttgtctcagatttagctaaaaccttgatagtgagaaatgagaaattggagcaggtatgcagcaaatatgatgatattagtgtgtccctgaacagagttatggatgagaaagaagcaatgattgaatcatataataatgaaataaaaaagatgcatcaaattacccggaaatattgggaggtgttttatagggatcgtgaaaaggccggattgaaactacatgcgcagaggaaaaaactagagagccgtgagaaggatctgcagagaaatcaagtgcagaatgagaatgagagaaaaaaactgtaccttgaaaggaaaaataatgagatggcaataatggagcaaaacaaagccgatgagaaagtgatgcatttggccgaagaacacaagaaagaaaaggagaaaatgcacaaaaaaattcttgaactacaaaatgaacttgatgccaaacaaaaattggaattggagattcaacaattgaaaggaaatcttcaagtaaggaatcaaataggagaggatgacgaggaggagaaaaataaattggatgcaattaaaacggaactagaagataaggaggaggaattagaagatctggaagcacttcaacaagctctcgttgtcaaggaacgtaaaaccaatgatgagttgcaagatgcccgcaaggagttaatacgttggctgaggaagacaaacagtagtcgggcttttattggtgtcaaaagaatgggggagcttgatgaaaaaccctttttgagtgcagcaaagagaaaatattctggtgatgaagtgaatctgaaagcagtggagttgtgctcacaatacgaggcttatcttagagacccaacctggtttccatttaaagttttaatagataaggaagggaaggccaaggaagtgttagatgaagaagatgaaaaactgagaactttaaaggatgagtttggtgacgatgtctttcaagcagtggttacagctctgaaggagttgaatgagtacaaccctagtggtagatacccgttaccggagttatggcattctaaggaaggaaggaaagccttgttaaaggagggttgttcttttataatcaggcaatggaaagcattaaagcagcgaaagaagtaggactgatgcggaacttacattttcggttcttattccatcaaacctactgttgtcatcgtcaacatcatggtgaaattgatttagttcaactctagtgccaaaggttggttatagtatgttacatgcaatactgatatcatataatgtacttttttcccgtgtgatagaggtttcttctattgccttggaacatttttgtttagaatctatttgaagttatatcagaccttgcttgaaattgaagtggcatattatgttgtttagatttatatttttagttaacactgctatttataaatatactgtactattcaacaatgtcagaaaattgggggttgaattgaaactgactctgccgtcagttattctcttattacgggttcggtgcagtatacccatcattatgggtctgttatcaggtttataaaacagtttgttaatagagattgggaggt

SEQ ID NO: 141 - DNA, 2600 bp, Glycine max
taatcggacagcaaaagtgactatttgccccgtaatacaacccaatcgcccaaccggagtatgcgcgcaatcgcatagcagcacctgcaatgcaacaactttgaagcaaaacacctctctctcaacctctttagcttccaattcaaagtagaaaccctaccagttttgtgctcttagtcgagacaaaggttgatcgacgtccgaactcgtcatcgtcaaagctcagttgctattcttccagcgcaagatgtccggtggacgagaacgagttcgggagtctgactttgaatattatgaacgtgaatattataaagacttgaagagtgattactataagctcaaaatctccaagtcatcgtataagtgtcccttttgccaggacaagcgggaatactcattgaatgagcttttgaagcatgcagtaagatttgaaagggactcacggagcatgaagacaaaggatttagctaagcactctgctcttcaattgtacattaaaaagtatcttgatgaaaatgataggccaggaagtgttgtccatgataaagcaggaagcgttgtccttgatagaccaggaaaagtggtccatgatagatccggaaaagtggtcattgatggatctggaaacgtttacaatgatagatttgggaaagttgtgaatgatagaccaggaaatgttgtcattgtcaatgatagatcagaaaaagttggcaaagatcaactatttgtctggccttggatgggcattgttgcaaacattgccactgaatttaaagacggaaggcgtactggagatagtggttccaaactaagggatgagtttactttgaaaggatttcatcctttgaaagttcaaccattatggaaccgttatggacattcaggctttgccattgtagaattctccaaagactgggagggtttcaccaatgcaatgaactttggaagaagttttgaggcagaacattgtggtaagagggattacaacaaattaagagaccgaggggatagactgtatggatgggtagctcgtgatgatgactaccactccaagagtataattggtgatcagcttcggaagacgggggatttgcaatctgtttctggaaaacaagcagaggaaaaaaggaaaacatcgctgcttgtcttagatttagctaaaaccttgaaagtgagaaatgagacattggagcaggtttgcagcaaatatgatgatattagtgtgtccctgaacagagttatggatgagaaagaagcgatgattgaatcatataataatgaaataaaaaagatgcatcaaactacccagaaatattgggaggtgttttataggggtcgtgaaaaggccagattggaactgcatgctcagaggaaagaactagagggccgtgagaaggatctacagagaagtcaagtgaagaatgagaatgagaggagaaaactgtaccttgaaaggaaaaataatgagatggcaataatggagcagaacaaagccgatgagagagtgatgcatttggcagaagaacacaaggaagaaaaggagaaaatgcacaaaaaaattcttgaactacaaaatgaacttgatgccaaacaaaaattggaattagggattcaacaattgaaaggaaatcttcaagtaaggaaacaaataggagaggatgacgaggaggagaaaaataaattggatgcaattaaaacagaactagaagataaggaggaggaattagaaggactggaagcacttcaacaagctcttgttgtcaaggagcgtaaaaccaatgacgagttgcaagatgctcgcaaggagttaatacgttggctggggaagacaaatagtagtcgggcttttattggtgtcaaaagaatgggggagcttgatggaaagccctttttgagtgcagcaaagagaaaatattctggtgatgaagtgaatctgaaagcagtggagttgtgttcacagtacgaggcttatcttagagatccaaactggtttccatttaaagttttaatagatagggaagggaaagccaaggaagttttagatgaagaagatgaaaaactgagaactttaaaggatgagtttggtgacgatgtctttcaagctgtggttacagctctgaaggagttgaatgagttcaaccctagtggtagatacccattacgggagttatggcattctaaagaaggaaggaaagcttccttaaaggagggttgttcttatataatcaagcaatggaaaacgttaaagcgaaagaagtaggactgatgcggaacttaaattttcggttcttattccaatgaggctaatgtagttgtcatcgacatcatggtgaaattgatttagttcaactctatagtgccccaaaggttggttatagacttatagtatgttacatgcaatactgatatcatattgttttttcccttgtgatcgggttcttttattgccttagaacatttttgtttagaatctgtttcaaattaatatcagaccttgcttgaaattgaagtggcatattagatttatatttttagttaacattgttatttgtaaatatactatactattcaacaatgtcagtaaattgtgggttgaattg

SEQ ID NO: 142 - DNA, 1911 bp, Glycine max
tttttctctatctctgttccttaaaagcaaactcatacttcacgttcttctgtttcaactctcaattaacaaacccaaaacatgtttctcctttgatcttgttcttctctagtacgcctcatgcagttccacaactacgtgggttcagaaggtgatgatagctctcccagtgactatgattggaacactgatgatgagcttgaggtgtttggaatacctccctcggatccaaccatttctagtcaagagagctgtgaagatagtgtgggggagagtagtgcaagttgctcgagcgctaaacattccaagctgattcatctcttcgtgggaatgggattttccagagagacagtgatcaaagcaattgatgaaaatggaagagataatgaggaggacattatggaagctctgctaacacttactgctgaaaaacccttaacagtagagaaagatgaggcattgtccgtacttgtcaatatgggatacccttttgaggaggctttgacagctatagacaaatgtggtcctaaggcccatatcagtgagctagcggatttcattagtgcttctcagttagaaaagggtcttcactcaccgcaagagtcacctaacaataaacatgatgcatctgattatacgcatgaaaagccctgtcaaccaagtggtgaatattatcttcatacaagtaagaaagtaaaacttggattgggtatatttaatgaagccagtcaagtgatttcaagaaagttcccaagagaagtagcaaataaaccatacttctattttgaaaacgtggctcttgctcctaaaggagtttggaaaactatatcacgttttctttatgagattgaaccagaatatgttgattccaaatacttttgtgctgcaacaagaaaaagaggatatatccataatcttcccacccacaaccgctcccccctgcttcctatcccaccactaactatccaagaggcttttcctacaactaaaaaatggtggccttcatgggatagaagaacaaagctcaattgccttctaactagagtagcccctggcccagttacagagagaataaggaaactccttgagaaatttggtgatgaacctcctctacatgtccaagaaaatgtacttgtagagattagaaagtggaacttggtgtgggttggaaaaaacaaattggcacctcttgaacctgatgaatatgagatgttgctgggattcccaagggatcacaccagaggtggtggagtcacccggacagagagatacaagtcacttggaaatgcatttcaggttaatacagttgcctaccacctttcagtgttgaagggtcgttttccaaatggcatcaatgtcctgtctcttttttctggcatcggaggtgccgaggttgctctgcatcgacttgggatgatgcttaaaaatgtggtatctgtggaaatagctgaggtgaacagaaacatcattcgcagttggtgggaacagactaaccagaggggaaacttaattgaggttgaagatgtacagaaagtctcttcaaatgagctgagccagtggataaccaagtttggtggatttgacctcatcattggaggcagcccctgcaacaacatttctggcagtaatagagttagtagacatggactagagggagagcaatcttcactattttacgaatattttaggattgttgaggcagtaatggaaatacagagagatgagcttctgtgaaacaaaaaaaagtacatcagtggattttgttaattcccatttttgtatggaacaactaaaaattatgtacacataataggaggaggagaatccaatagatccaagaaatgtaacaaaacatttgtaatttcgaatttatcttatattggtaatgtttttatgttctttttgtcacac

SEQ ID NO: 143 - DNA, 1973 bp, Glycine max
tttttctctatctctgttccttaaaagcaaactcatacttcacgttcttctgtttcaactctcaattaacaaacccaaaacatgtttctcctttgatcttgttcttctctagtacgcctcatgcagttccacaactacgtgtgctacgaacataggaaacttgtttgtggagtcgagagttcttacttatctgctaagtcatgggttcagaaggtgatgatagctctcccagtgactatgattggaacactgatgatgagcttgaggtgtttggaatacctccctcggatccaaccatttctagtcaagagagctgtgaagatagtgtgggggagagtagtgcaagttgctcgagcgctaaacattccaagctgattcatctcttcgtgggaatgggattttccagagagacagtgatcaaagcaattgatgaaaatggaagagataatgaggaggacattatggaagctctgctaacacttactgctgaaaaacccttaacagtagagaaagatgaggcattgtccgtacttgtcaatatgggatacccttttgaggaggctttgacagctatagacaaatgtggtcctaaggcccatatcagtgagctagcggatttcattagtgcttctcagttagaaaagggtcttcactcaccgcaagagtcacctaacaataaacatgatgcatctgattatacgcatgaaaagccctgtcaaccaagtggtgaatattatcttcatacaagtaagaaagtaaaacttggattgggtatatttaatgaagccagtcaagtgatttcaagaaagttcccaagagaagtagcaaataaaccatacttctattttgaaaacgtggctcttgctcctaaaggagtttggaaaactatatcacgttttctttatgagattgaaccagaatatgttgattccaaatacttttgtgctgcaacaagaaaaagaggatatatccataatcttcccacccacaaccgctcccccctgcttcctatcccaccactaactatccaagaggcttttcctacaactaaaaaatggtggccttcatgggatagaagaacaaagctcaattgccttctaactagagtagcccctggcccagttacagagagaataaggaaactccttgagaaatttggtgatgaacctcctctacatgtccaagaaaatgtacttgtagagattagaaagtggaacttggtgtgggttggaaaaaacaaattggcacctcttgaacctgatgaatatgagatgttgctgggattcccaagggatcacaccagaggtggtggagtcacccggacagagagatacaagtcacttggaaatgcatttcaggttaatacagttgcctaccacctttcagtgttgaagggtcgttttccaaatggcatcaatgtcctgtctcttttttctggcatcggaggtgccgaggttgctctgcatcgacttgggatgatgcttaaaaatgtggtatctgtggaaatagctgaggtgaacagaaacatcattcgcagttggtgggaacagactaaccagaggggaaacttaattgaggttgaagatgtacagaaagtctcttcaaatgagctgagccagtggataaccaagtttggtggatttgacctcatcattggaggcagcccctgcaacaacatttctggcagtaatagagttagtagacatggactagagggagagcaatcttcactattttacgaatattttaggattgttgaggcagtaatggaaatacagagagatgagcttctgtgaaacaaaaaaaagtacatcagtggattttgttaattcccatttttgtatggaacaactaaaaattatgtacacataataggaggaggagaatccaatagatccaagaaatgtaacaaaacatttgtaatttcgaatttatcttatattggtaatgtttttatgttctttttgtcacac

SEQ ID NO: 144 - DNA, 2392 bp, Glycine max
tttctttccatttcttttccttactcctcccgaaaacaaaaccagctctagagctggtgttgcaatcaaacggttcagatcaaaacacgtggactgatttgtgagaaactttgtccctgattaacgtgtccccagcgggagtggaacacagaaattttcacagaaaaaactgcgcgagtatggaaagtttttccatgcttgtgttgttgcattgtccctgaatttgtacttgattctgggacgtcactcagtctgagtctgtttctgcaaatttcaaaaccctctctctcgttactcgccatcactagcgagtgctccttcttcctcttcgcgaaattcgtatgcgaagaaggaggtagggattcgcgctcctgctttctcagactgcctaattatcttttattctgcgaagtaactgagagattgaagatgggaggagatgattctggtttggagagtgacaattttgattggaacactgaagatgagcttgaaattcagaactataactcgtcgtcttcatgtttaacccttcctaatggagatgctgttactggctctggagaggcaagctcgtctgcagttttggctaattccaaggtgcttgatcacttcgtcagcatgggattttctagagaaatggtttctaaagtaattcaggaatatggtgaggaaaatgaagataaactacttgaagaacttctcacatacaaggctctagaaagttcttcccgtccacagcagcgaattgagccagatccttgttcttcagagaatgcagggagttcttgggatgatttctcagatactgatattttttctgatgatgaagaaattgcaaaaactatgtctgagaatgatgataccttacggtctttggtgaaaatggggtacaagcaggtggaggctttaattgccatagaaagattaggcccaaacgcctcacttgaagaattggtagattttataggtgttgctcaaatggcaaaggctgaagatgctcttctgcctcctcaagaaaagttacaatacaatgactatgctaagtccaataaacgaagattatatgattatgaagtgctgggaaggaaaaagcctaggggatgtgagaagaaaatcctcaatgaagatgacgaggatgctgaagctcttcatcttccaaatccgatgattgggtttggtgtacctacagagtcaagcttcataacacacagaaggcttccagaagatgccattgggcctccttacttctattacgagaatgtagccttagcaccaaaaggtgtttggcaaacaatttcaagattcttgtatgatgttgaacctgagtttgtagattcgaagtttttctgtgctgcagccaggaaaaggggatatattcacaatctccccatccaaaataggttcccacttctaccacttccaccgcgcacaatacatgaggcttttcccctaacaaagaaatggtggccctcatgggatattaggaccaagcttaattgtttgcaaacatgtattggcagtgcaaaactaacagaaagaattaggaaagctgtagaaatctatgatgaagatccacctgaaagtgtacagaagtatgttcttcatcagtgtaggaaatggaatttggtttgggtgggaagaaataaggttgctccattagagcctgatgaagtagaaacgctgttgggcttcccaaggaaccacaccagaggaggtgggataagtaggactgacagatacaagtcacttggtaattcattccaggttgacactgtggcataccacttgtcagttctgaaggagatgtatcctaatggtatcaatcttctttctctcttttctggaattggtggggcggaggtagctcttcatcggcttggcatccctctcaagaatgttgtgtctgttgaaaaatcggaagttaataggaatattgttagaagttggtgggagcaaacaaaccagaaaggtaatctatatgatatggatgatgtaagggagctagacggtgatcgcttggaacagctgatgagcacatttggtggttttgatctaattgttggtggcagtccatgtaataacctggctggtagcaacagggtcagccgggatggactggagggaaaagaatcttctctcttctttgattattttaggattctagacttggtaaaaaatatgtcggccaaatatcgatgatttttgtcccaagaagcctctttctccggttttgtatttaatccaaacaattaggatcttcgtatataaacctgaaacattagagacagatacttctcattccatttttgttgccaaagaaaggcaacgttttcaaataaaaaaattatcttaaaatttctgattccaggttactattttattaatacgt

SEQ ID NO: 145 - DNA, 2491 bp, Glycine max
tttctttccatttcttttccttactcctcccgaaaacaaaaccagctctagagctggtgttgcaatcaaacggttcagatcaaaacacgtggactgatttgtgagaaactttgtccctgattaacgtgtccccagcgggagtggaacacagaaattttcacagaaaaaactgcgcgagtatggaaagtttttccatgcttgtgttgttgcattgtccctgaatttgtacttgattctgggacgtcactcagtctgagtctgtttctgcaaatttcaaaaccctctctctcgttactcgccatcactagcgagtgctccttcttcctcttcgcgaaattcgtatgcgaagaagggttgtgttctctctctttgccgtttttgtttgtttaattttgtgtagttttacgaggttgaatttgagctgacgtgcattttttttgagttttgtgcagaggtagggattcgcgctcctgctttctcagactgcctaattatcttttattctgcgaagtaactgagagattgaagatgggaggagatgattctggtttggagagtgacaattttgattggaacactgaagatgagcttgaaattcagaactataactcgtcgtcttcatgtttaacccttcctaatggagatgctgttactggctctggagaggcaagctcgtctgcagttttggctaattccaaggtgcttgatcacttcgtcagcatgggattttctagagaaatggtttctaaagtaattcaggaatatggtgaggaaaatgaagataaactacttgaagaacttctcacatacaaggctctagaaagttcttcccgtccacagcagcgaattgagccagatccttgttcttcagagaatgcagggagttcttgggatgatttctcagatactgatattttttctgatgatgaagaaattgcaaaaactatgtctgagaatgatgataccttacggtctttggtgaaaatggggtacaagcaggtggaggctttaattgccatagaaagattaggcccaaacgcctcacttgaagaattggtagattttataggtgttgctcaaatggcaaaggctgaagatgctcttctgcctcctcaagaaaagttacaatacaatgactatgctaagtccaataaacgaagattatatgattatgaagtgctgggaaggaaaaagcctaggggatgtgagaagaaaatcctcaatgaagatgacgaggatgctgaagctcttcatcttccaaatccgatgattgggtttggtgtacctacagagtcaagcttcataacacacagaaggcttccagaagatgccattgggcctccttacttctattacgagaatgtagccttagcaccaaaaggtgtttggcaaacaatttcaagattcttgtatgatgttgaacctgagtttgtagattcgaagtttttctgtgctgcagccaggaaaaggggatatattcacaatctccccatccaaaataggttcccacttctaccacttccaccgcgcacaatacatgaggcttttcccctaacaaagaaatggtggccctcatgggatattaggaccaagcttaattgtttgcaaacatgtattggcagtgcaaaactaacagaaagaattaggaaagctgtagaaatctatgatgaagatccacctgaaagtgtacagaagtatgttcttcatcagtgtaggaaatggaatttggtttgggtgggaagaaataaggttgctccattagagcctgatgaagtagaaacgctgttgggcttcccaaggaaccacaccagaggaggtgggataagtaggactgacagatacaagtcacttggtaattcattccaggttgacactgtggcataccacttgtcagttctgaaggagatgtatcctaatggtatcaatcttctttctctcttttctggaattggtggggcggaggtagctcttcatcggcttggcatccctctcaagaatgttgtgtctgttgaaaaatcggaagttaataggaatattgttagaagttggtgggagcaaacaaaccagaaaggtaatctatatgatatggatgatgtaagggagctagacggtgatcgcttggaacagctgatgagcacatttggtggttttgatctaattgttggtggcagtccatgtaataacctggctggtagcaacagggtcagccgggatggactggagggaaaagaatcttctctcttctttgattattttaggattctagacttggtaaaaaatatgtcggccaaatatcgatgatttttgtcccaagaagcctctttctccggttttgtatttaatccaaacaattaggatcttcgtatataaacctgaaacattagagacagatacttctcattccatttttgttgccaaagaaaggcaacgttttcaaataaaaaaattatcttaaaatttctgattccaggttactattttattaatacgt

SEQ ID NO: 146 - DNA, 2349 bp, Glycine max
ctttggtgttgcaatcaaacggttcagatcaaaacacgtgctgattggtgagaaactctgtgtcccccaaccgtcggatttccctgattaacgtgtccccagcgagagtggaacagagaaattcccacggaaaaaagtgcgcgagtatggaaagttttttccatgctgcattgtacctgattcagggacttgattctgtctgagtctgtttctacaaatttcaaaaccctctctctctcgtgagttactcgcaccactagcgagttcttcttcttcttcttcttcgcgaaattcgtatgcgaagaaggaggtaggaattcacgctcctgcattctcagaccgttaggattccaattgtgcctaaatatatcttgtattctgcgaagaagaagctgagagaggttgaagatgggaggagatgattttgattggaatactgatgatgagcttgaaattgagaactataactcttcatcttcgtgtttaacccttcctaatggggatgctggagaggcaagctcgtctgcagttttggctaattccaaggtacttgaccacttcgtcaacatgggattttctagagaaatggtttctaaagtaattcaggaatatggtgaagaaaatgaagataaactacttgaagaacttctctcatacaaggctctggaaagttctccccaaccacagcagcgaattgagccagatccttgttcttcagagaatgcagggagctcttgggatgatttctctgatactgatattttttctgatgatgaagaaattgcaaaaactatgtctgagaatgatgataccttacggtctttggtgaaaatgggctacaaacaagaggaagctttagttgccatagaaagattaggcccaaatgcctcacttgaagaattggtagattttataggtgttgctcaaatggcaaaggctgaggatgctcttctgcctcctgaagaaaagttacaatacaatgactatgctaagtccaataaacgaagattttatgattatgaagtgctgggaaggaaaaagcctaggggatgtgagaagaaaatcctcaatgaagatgatgatgaggaagatgaagctcttcatcttccaaacccaatgattgggtttggtgtacctacagagtcgagcttcataacacacagaaggattccagaagatgccattgggcctccttacttctattatgagaatgtagccttagcaccgaaaggtgtttggcaaacaatttcaagattcttgtatgatgttcaacccgagtttgtagattcaaagtttttctgtgctgcagccaggaaaaggggatatattcacaatctccccatccaaaataggttcccacttctaccacttccaccgcgcacaatacacgaggcttttcccctaacaaagaagtggtggccttcatgggatactaggaccaagcttaattgtttgcaaacatgtattggcagtgcaaaactaacagaaagaattaggaaagctgtagaaatctatgatgaagatccacctgaaagtgtacagaagtttgttcttcatcagtgtaggaaatggaatttggtttgggtgggaaggaataaggttgctccattagagcctgatgaagtagaaacgctgctgggcttcccaaggaaccacaccagaggaggtggaataagtaggactgacagatacaagtcacttggtaattcattccaggttgacactgtggcataccacttgtcagttctgaaggagatgtatcctaatggtatcaatcttctttctctcttttctggaattggtggggcagaggtagctcttcatcggctcggcatccctctcaagaatgttgtgtctgttgaaaaatcagaagtgaataggaatattgttagaagttggtgggagcaaacaaatcagaaaggtaatctatatgacattgacgatgtaagggagctagacggtgatcgcttggagcagctgatgagcacatttggtggttttgatctaattgttggtggcagtccatgtaataatctggctggtagcaacagggtcagccgggatggactggagggaaaagaatcttctctcttctttgattactttaggattctagacttagtaaaaaatatgtcagctaaatatcgataaatttttgtccaaagaaacccctttctgcggttttgtctttcgtccaaataattaggatcttcgtatataaacctgaaacattagagacagatacttctcattccatttttattgccaaagaagggcaacgttttcaaataaaaaaattatcttaaaatttctgatttcaggttactattttattaatacctatgcggg

SEQ ID NO: 147 - DNA, 1512 bp, Glycine max
atgaaatttctgactgattttcaagttgaggaatactatggagctaaaggagttgatacatggagtttgaagatgtgggagaaagtgattagtaacaatgatactattgctgactgtgttgaagctctgataggagcatactatgtagatggtggactctttgcttcacttaatgtgatgaaatggcttgggattggtgttgaacttgaactatcatcacttgatgaagcaatcactgctgcatctctgagtacatgtgtgccaatagaaagtgatattgcaagccttgaaaagaaaattgagtatgaattttcagtcaagggactcttactggaggcaatcacacatttgtctgagaaagaacttgggattggctgctgttatgagaggcttaaatttcttggtgactcggtattggacctgcttatcacatggcatctttatcagagtcacacagatattgatccaggggtgttggctgacttacgttctgcttctgtcaataatgacaattttgctcaagttgctgttagacataaccttcaccagcaccttctacatagctcaggattattagtgagccagatattagaatatgtgaaggtcatttctgaatcagatcccagatcacttccaagtattagagctcccaaggcacttggagatgtagtggaaagtattgtcgggcctatactaattggtaccaagctaagtcttgaccaagtgtggaacgttttctatcctctattatctcccattgttactcctgataaacttgaattgcctccatttcgtgaattaaatgaattatgtgattcacttgggcattttgtaaaagtaaaagaaaattgtgaaaaaatgggatcagcaatgcatgttgaggttagtgtacagcttccaaatgccctattggttcgtgaaggaaaggggccaaataaaaaaactgcaaaaggagaagctgcttttcatttgttgaaggatcttgagaagcggggaattttacatggtagtctcatgtccaagggaaaaagagacaatcctgaccatatctatgattcatttcatctcaaaagggattctagtatttgttcttctctaattgaagaacattcctcagagccagcatcacataaaaggcacacattggatgaaactaacttaactgcatctattcagttctgtgagacatctgaattgatcactcctgctgtagcattcattaaccaaatcatagataatgctatgagtgttggaggaccacggaccacactatatgatgtatgtaagaaattacagtggccagtgcctgcatttgattcaagagaatataaagatagtttttattttgtcacagatctctatttgaatcctgtgaagggctgcaaggaagcaagggacaaaactgtttctttgtcgaaaattaccttgtgcatacccaattatggtaatatagaatgcaaaggagaagctagaagtgataagaagagctcctttgactctgctgcaatttaa

SEQ ID NO: 148 - DNA, 5984 bp, Glycine max
cgttggacacttaacctaaccttttcgttccaccgagtcacatgaagaaaaatatgacaaaccaatcttgtccaacacagctatttcatttttactctcgcaagatgcatagaagtttgctttggcactgtacacctcgtctactctagcaaacaaacaaacccgacgtatacttctgaaactcacttgactacttcacattcacactcactgttctgcgttgcgtcctacgtagtaaccaggaccatgaattccaacattgattcaacagaccatagccaggatcaaagcagaaaacgaaacctacccgatgctgatgattctccggcgccgaatttccacattgattcatcagaccataaccaggaccaaagtaaaaaacgaaagcaacccaatgatgaagattctccatcgcttgaatcgccttgttccaacatgaaccccagaaggtatcagatagaggtgtatgaagttgcaaggagaaggaacactatagctgtgttggatacagggtcaggtaagaccctgattgctgtaatgcttatgaaagaggttggtcaagccatcaagactagtggtgtaaagaagctgattattttcttggctcccacagttcatcttgtcaatcagcaattcaagaatataaaatttctgactgattttcaagttgaggaatactatggggctaaaggagttgatacatggactttgaagacgtgggagaaggagattagtaacaatgatgttctggttatgacaccccagattcttttggatgcgttaagaaaagcattcctgcgtatggaaatgatatgcttgattgttattgatgaatgtcatagaacaattggcaatcatccttatacaaaaataatgaaggaattttatcaccaagctaatgaaaagccaaagatttttgggatgacagcatcacctgttggtaaaaaaggtgtttcctctactatggattgtgaggatcagatatcagaacttgaaagcatcttggattctcagagatatactgttgaagatcggacagagatggataggtgtgtcccatctgctaaagagagttgtagatattatgaccaagcacgattttctgctttgagtttgaaaccaaagattgaagccttgtcgttcaagtttgatgcattgttatcagaaaatcaaagtaactataaggatgtggaaaataaatttaagacactttctcagcggatgtccaatgaacttgcaaaaattttacattgccttgaagatcttgggatcctatgtgcttatgaggctgttaaaatctgtcatgagaatttttccaaatctgaaggagagtgtgaaatttacagaaaaggttatcttcaatgtataacttttcttgaagaagtaatcaaattaatcgaagaatccctccatcttgctgataaaaagattttggaggttgattttaattattctcaggcagaagatttgggatacatatctcccaaattaattgaacttattaaactctttcagtcatttggagaatctagtcaggtgttgtgccttatttttgttgatagaatcattaccgcaaaggtgatccaaagattcgcaaagacagttcccaatatttctcatttcacagtttcctatttaactggtaacaatacatcggttgatgctctggctcctaagaggcagaaggagatattggattctttccgctctggaaaggtcaatctattatttactactgatgtacttgaggaaggaattcatgtgccaaactgctcatgtgtgatacgttttgacctcccaaagacagttcgtagttatgtccaatctcgtggaagatctaggcaggcaaactcccaatttgttgtgatgttggagaggggaaacttgaagcaaagagatcaactctttgatatcattaggagtgagcggtccatgactgatgcatctatttataaagaacatgaatctagtttaagggcatgtatggtggggaaaacaaatgcatactatgtggaatccactggagcatctttcactttagattctagtgttagtctcatccaccgatactgtggaacactccctcgagataagtactcctgtgtaaagcccaattttgagtttctgtctgtggaagggggttatcagtgtaaattaatattaccatctaattcagctttccaaacaataattggtccttctggaaaagatatgcgtttggcaaagcatcttgcatgtttcgaagcttgtaagaagctgcatcaaatgggtgccttaaatgaacatttggttccattaattgaagattcttcagaagatgaccatattgtgaaaaataaagaatcaagttctggtgcagggaccacaaaaagaaaggagttacatggaaaagctaacattcatgcattaagtggtgcatggggagacaaactcactagagtcaaatttaatgcgtataaatttgaattcacatgtaatattgtaagtgaaatatactctgggtttgctcttttgattgagtcagagcttgatgaggatgtgggaaatgtaaatttagatctttatttagtctcaaagattgtgaaagcttccgtctcttcatgtgggcaagttgatttggatgctgaacagatgatgagagcaaaatgcttccatgagctttttttcaatggtttgtttgggagactggtcttgaagtccaaatcagcaggagaaagggaatttttacttcagaaagacacaaactcattgtggagcccaaaacacttgtatttgcttctaccactagagaaattgaatgatatctgtgagggatctttgcaaattaattggtgtggaattaattcttgtgcttctgctatcaaatttttaaggaggaaattttctttggtcactggagattgtgatgataacggcacaatcacatcacctcatgataccagttcatcagagatggaatgtgtaggagcaaacaagattcactttgctaattgtgtggttgatgctgataatataaaagacagggtagttttggccattcacactgggaaaatatattgtattattgagatcgacagtaacctatctgctgaaagtcctttctatggaaacaatgaaaaatcaaaggaaagcattaccttctcggattatttcagcaaaagttatggaatttcactgagacatcctggacagcctatgttacggttgaagcaaagtcataatccacacaatcttcttttcaacttctatgaggaagatgcacgagacaagtcatcaaaaattggccctgcagcctcaaaattgccagtgcatgttcatattcctcccgagcttctatacattcttgatgttaaaagagatgtgttgaaatcactgtacttgctgccatctctgatgtaccgcattgaatctttgatgttatctagtcagcttagagaagagatagatggtcaaactagcaagttcaacatacgtagctcactgattctagaatcacttacaactttgagatgtagtgaaagtttttcaatggaacgtcttgagttgctaggagattctgttttgaagtatgtggtgagttgtcacctctttcttaaatatcctaaaaaacacgaaggacaattatctgccagacgatcatcggctgtttgtaactcaaccctacataaactggggacagatcgcaaattacagggatatattcgagactctgcttttgaaccacgccgttgggttgctccaggacagcgttctatacaccttgtttgttgtgattgtgggttggaaacccttgaagtgcctttagatgcaaaattccatactgaagatccaaaagttgtggttgggaagttttgcgacagaggtcactgctggatgtgttctaagactattgctgactgtgttgaagctctgataggagcatactatgtagatggtggactttttgcttcacttaatgtgatgaaatggcttgggattggtgctgaacttgaactatcattggttgatgaagcaatcactgctgcatctctgcgtacatgtttgccaaaagaaagtgagattgcaagccttgaaaagaaaattgggtatgaattttcggtcaagggactcttactggaggcaatcacacatttgtctgagaaagaacttgggattggctgctgttatgagaggcttgaatttctaggtgactcggtattggacctgcttatcacatggcatctttatcagagtcacacagatattgatccaggggtgttgactgacttacgttctgcttctgtcaataatgacaattttgctcaagttgctgttagacataaccttcaccagcaccttctacatagctcaggattattactgagccagatatcagaatatgtgaaggtcatttctgaatcagatcccagatcacttccaagtattagtgctcccaaggcacttggagatgtagtggaaagtatagttggggctatactaattgataccaagctcagtcttgaccaagtgtggaacgttttctattctctattatctcccattgttactcctgataaacttgaattgcctccatttcgtgaattaaatgaattatgtgattcgctcggttattttgtaaaagtaaaagaaaattgtgaaaaagtgggatcagcaatgcatgttgaggttagtgtacaacttccaaatgccctattggttcgtgaaggaaagggggcaaataaaaaaactgcaaaaggagaagctgctttttatttgttgaaggatcttgagaagcagggaatttcacatggtagtttcatgtccaagggaaaaagagataatcctgaccatgtctatggttcatctcatctcaaaatggattctagtattctaattgaagaacattcctcagagccagcatcacataaaaggcacatattggatgaaactaacttaactgcaattaatttatcaattaatatgaagaagggaggaccgcggaccacattatatgaagtatgtaagaaattacagtggccagtgcctacatttgattcaacagaatataaagatagatctctatttgaatcctgtgaggggctgcaaggaagcaagggacagaactgctttgtgtcgaaaattaccttgtgcatacccaattatggtaatatagaaagcaaaggagaagctagaagtgataagaagacctcctttgactctgctgcagttcaaatgcttcttgagctgcaaagactgggaaaagttgaaattgatcctctcccttctagttaggggaagagaaaggaaagaaaagggaagggaaggaaaagaaaagggagagaatataagagaagggatagtaccccaattttgtgcccccaaaaaacatgaactgttgttttgtgccattgatctggtaaattctctcagattaatggcagaggaccattagtttacagtatttttggggttgcaaatttgtggtactagtattgtgaccaagaagagaaaatgattggaaaaaaaaaggattgaaaaaaatgaggtggtgtttgagaagattcaagtgagaataaacagaagtccttttcctttcctttcctttcctttccccagggaaggaaaagaaaactcaaacagcaaaggttgatcaattttattcataaaacataaaattgcagaacatgactttgacgcaataatattgcatgtacatgaatgtagtagctgttcttagggcacttgtgcatgtatgtagtatcttgttcaatttttttccgtacataatttaagttgatttcatcttcatatacacgaagacacttttatcctgacttgtcaatcctcatctcactctggcacgcggtgatgtgcaagtgcaagcataaagttgcaccaaagtatctaagtctttcaataaagaatgttgggcgtgggccgggtgggtctttgaagtatgaatatggtaatttcatttattattgttatctattgtgttatttctt

SEQ ID NO: 149 - DNA, 2858 bp, Glycine max
gtcacaactgttactaaaaaagttgacccttccctctcactggaaactaatgttcccgcgcgtgtggccattttgaaaaaaatctgcttttcattcgctcagacacttttttgtccccatctcttttcattcgctcagcgatacgctaccatggctaaacgcaaaacatccgacgcctccgatgcacaagacgacactgtatcgctgcttccttcccaacgcaataaggccaagcatcctaactctaactccaacgcctgcttcgccggaaagcccattccgcccgccgaggccctcgccaaatggccccaccgatatccctccgaggggaaaaagaagggttcagctagaacctcaaaagaggctacgagtgaaaacagtgaagttatgccggcacggtgtcattatcgtcaagctaaagtggatggggttgtttataacctctatgacgatgcttatgtcaaggccgaagatggaaaaccagattatattgcacgaatcgttgagatgtttgaaactgttgataaggaacaatgttttacggctcagtggttctacagggctgaggacactgtgataaaaaatcacggtgaccttgttgacaagaagcgaatttttatatctgatgtgaaagatgtaaatccccttgactgtattgtttccaaagtcaaaatttacaaaaaaagtccaagtgtagatttgacttcaaagaagggaaaactcccttcttgtgattactattatgacatgaagtacactgtgccgtatctaaccttttccaacatcgtcaacgaaacagttaaaacagagagtgatgcatcttccacaatttctagtgaatctggatccaatggttgcgttagtaatgctaatctagctaatggaaagactactcaaaataatagttctggttcctcggagtggactttgctagacttgtattctggttgtggagccatgtccacagggctttgttttggtgcatccttggctggaataaaacttgtcactaggtgggctgtggacattaatgcacatgcatgcgaaagtttgaagctgaaccaccctgagactcaagttagaaatgaaccagctgaagacttcttaaacctaataaaatcctgggccaagctttgtgaagagtttgcattattaggatcagaacggttagattctgatccagacatggatgaagatgagaatgaagctgtgagaaaagaagagtcaggaaatcaatctgattcagaggaatttgaagtagaaaagttacttgctgtgtgctatggtgatccaaacgacgtcaaaaaaccaggactatattttaaagttcgttggctgggttatgcttccagctatgacacgtgggagccaatagaaggattgagtgattgcaaggaagctatgaaagattttgtgacaaaaggctacaagaaaagattattgcctcttcctggtgatgctaactttatttgcggtggacccccatgccaaggagtaagcggtttcaaccgcttcaggaatgcagcagctccattagaggacacaaagaataagcagttgcttgtttacatggatattattgattttttgaagccaaaatatgtcctcatggagaatgttgttgatattttgaggttttccggtggttatctggggcgttatgccatatgccgtcttgtagctatgaattatcaagcaagaatgggcatgatggcagcagggtcttatggccttccacaatttcgtatgcgtgttttcctttggggagctcgtcctactgagaaattgcctccatatccgttaccaacacatgaggtggtgtcaagaggttccgttcccactgaatttgaagaaattacagtagcttatgataaaaaggatacctgtcatctggctggcgctcttttacttgaggatgcaatatcagatctaccacatgttacaaatgatgagaaccaagatgaaaggaactatgaagctccttctgaaactgaatttcaaaaatatattagattgaagaaaaacgagatggtgggtagtatggctagtgctcaaagcgcaccagatagaatactatatgatcatcgtcctctgcagttgaacaaagatgattatgaaagagtttgccagattccccagaagaagggtgcaaacttcagagatctacctggtgtacttgtgaatggcaacaaagttcaatgggatccatcggttcaaagagtgatgctagactctgggaagcctttggttcctgattatgctatgacatttgtccgtgggacatctagcaagccatttggtcgtttgtggtgggatgaaattgtgtcaacagtggtgacaagggccgagcctcacaaccaggccattctccaccctacacaaaaccgagtacttaccattagagagaatgcgagactacaagggtttcctgattgctataaactttgtgggcctgtcaaagagaggtacatacaagttggaaatgctgttgctgttcctgttgctctagcattgggatacacatttggtttggcctgccagggattattgtcggatgataatcccttgacaaccctccccttcaagtatccaagttgtcttgccctttcatctcttgcagaaactgagaatgataacgaatcaagttgagattgttcccacacaatcccgttctctgtcattgccatgttaaacttgtccatatttccaactttccattttaatgcaagagtgagtgtacactaaaaggccgaaattttgtatcaataatgattgtatgtacactaatgacattgttcataatgatataagattcactttggtaatggttttgtgaaatttaagttgtagttaagaat

SEQ ID NO: 150 - DNA, 2893 bp, Glycine max
atttgaccttccccgtcactggaattcatgttcccgcgcgtgcggccattttaaaaacccccccttctcttttcctcactcactttttgtctgcatctcttctccgcttgtccctctatccatcactggaagcagcgatacgctgccatggctaaaaaacgcagcgcatcagacgccaccgatgatgcacaaaacgacaccgtatcgctgcttccctcccaacgcaagaagcccaagcactctgctcctaaccccgacgcctgcttcgtcggaaagcccattccttctgccgaggcccgcgccaaatggccccaccgatacccctccgaggtgaaaaagaaagctccagctagaagctcagaagaggttacgagtgaaaacagtgaggttatgctggctaggtgtcattatcgtcaagctaaagtagatggagttgtttataacctctatgatgatgcttatgttaaggccgaagacggtaaaccagattatattgcacgaatcgttgagatgtttgagactgttgataaggaacaatgttttatggctcagtggttctacagggccgaagacactgtgataaaaaatcacggtgatcttgttgacaagaagcgggtttttatatctgatgtgaaggatgtaaatccccttgactgtattgtttcaaaagtcaaaattttcaaaaaaaacccaagtgtagatttggcttcaaagaaggcaaaattgcctttttgtgattactattatgacatgaagtacactgtgccatatctaacattttccaacctagtcaatgaaacagttaaaaccgagagtgatgcatcttccacaatttctagtgaatctggatccattggttgcgttaataatgctaatctggcaaagagaaagactactcaaaataatagttctggttcctcgcagtggactttgctagacttgtattctggttgtggagccatgtccacagggctttgtttgggtgcatccttggctggaataaaacttgtcacaatgtgggctgtggacattaatgcacatgcatgcaaaagtttgaagctgaaccaccctgaaactcatgttagaaatgaaccagctgaagacttcttaaacctaataaaagcttgggccaagctttgtgaagagtttgcattattaggatcagaacggtcagattccgatccagacatggatgaagatgagaatgaagctgtgcaaaaagaagagtcaggaaatcaatctgacttggaggaatttgaagtagaaaaattacttgctgtgtgctatggtgatccaaacggcgtcaaaaaaccaggactatattttaaagtgcgttggctgggttatgattccagttatgacacatgggagccaatagatggattgagtgattgcaaggaagttatgaaagattttgtgacaaaaggctacaagaaaagattattgcctcttcctggtgatgctaactttatttgtggtggacccccgtgtcaaggagtaagtggtttcaaccgcttcaggaacgcagaagctccattagaggatacaaagaataagcagttgcttgtttacatggatattattgattttttgaagccaaaatatgtcctcatggagaatgtcgttgatattttgaagttttctggtggttatctggggcgttatgccataggccgtcttgtagctatgaattatcaagcaagaatgggcatgatggcagcagggtcttatggccttccacaatttcgtatgcgtgttttcctttggggagctcgtcctactgagcaattgcctccatatccgttaccaacgcatgaggtggtgtcaagaggttttgttcccactgagtttgaagaaattacagtagcttatgataaaaaggatacctgtcagctggctggtgctcttttacttgatgatgcaatatcagatctcccacctgttacaaatgatgagaaccaggatgaaaggaactatggagctcctgctcgaactgagtttcaaagatatattagattgaagaaaaacgagatggtgggtagcatggctactgctcaaagcacaccacgtagaatactgtatgatcatcgtcctcttcaattgaacaaagatgattatgacagagtttgccagattccccagaagaagggtgcaaacttcagagatctacctggagtacttgtgaatggcaacaaagttgaatgggatccatcggttgaaagagtgatgctagactctggaaagcctttggttcctgattatgcaatgacatttgtccgtgggacctctactaagccatttggtcggttgtggtgggatgaaattgtgccaacagtggtgacaagggccgagcctcacaaccaggccattctccaccctagacaaaaccgagtacttaccattagagagaatgcgagactacaaggatttcctgattgctataaactttgtgggcctgtcaaagagaggtacatacaagttggaaatgctgttgctgttcctgttgctctagcattgggatacacgtttggtttggcctgccagggactgtctgacgataagcctttgacaaccctccccttcaagtatccaagttgtcttgccctttcatctcttgcaggaactgagaatgataacgaatcaagttgagattgttcccacacaatcccttctctctgccattgccatgttgaacttttccatatttattcaaattttccattttaatgtaagagcgagtgtacactagaaggccgaaaagttgtatcaatgatgattgtatgtacactaatgacattgtttataatgatataagattcactttgttaatggttttgcaaaatttaagttgtattaaaaacaaaatgtatttaagaattaattaaacttgaga

SEQ ID NO: 151 - DNA, 2971 bp, Glycine max
cccgcccactccctccctcttcaaaaaatttcagcgcctactataaatactctcgcgcttccccattttcaaaacactcactctttctttctctctctaatttattttcgcactcgccgcaccactctcctcctccgcctccgccatgcctagcaagcgcaagaccagatcctccgcctctcccgctgccgcgccgccgagcaagcgcgcctccagatcctccgcctctcgcgtcgccgattccgcaccggtcaaatctgaagccgaggaagttgtggcagcttcctctgtcgtcaaagaagaggcgcaagcaagcttcacggacgttactgacggcaacgttagcgatggcgaggggactaacgccagattcgtcggagagcctgttcccgacgaggaagcccggcgccgctggccgaaacggtaccaggaaaaggaaaagaagcaatccgctgggccaaaatcaaacagaaacgatgaagacgaggagattcaacaagctcgacgtcactacactcaggcagaagtagatgggtgcatgctttacaaactttacgatgatgcccatgttaaagcagaagaaggagaagacaattacatttgtaaaattgttgagatatttgaggccattgatggggcactgtattttacggcacaatggtattatagggctaaagacactgtcattaaaaaacttgcatatctcattgaaccaaagcgagttttcttttctgaagtccaggatgacaaccctttggattgtctagttgaaaagctgaacatcgccagaataacattaaatgtagatttagaagcaaagaaggaaaccattccaccttgtgattattactgtgatacacaatatcttttgccatactccacatttgttaacttaccatcagaaaatggggaatctggtagtgaaacttcttctacaatatcttctgaaactaatggaatcggaaaatatgaggtgaactctcaacctaaggaagcttttcttcccgaagaaagtaaagatccggagatgaagttactagatttatattgtggttgtggtgcaatgtcaactggtttgtgccttggtggaaatttatctggtgtgaaccttgttactagatgggcagtggacttgaatcaacatgcttgtgaatgtcttaaattaaaccatcctgaaactgaggttagaaatgaatcggcagaaaattttctttcattattgaaggagtggcaggaattatgtagttacttctctctagttgaaaaaaaggtgtcacatgagaaatatgtgaatctttttagtgaagatgacgatgacactagcagtaatgaagaggttaatagtgaagatgacaatgaactgaatgaagatgatgaaatatttgaagtttctgaaatccttgctgtctgctacggtgacccaaataagaaaaaagaacaagggttatacttcaaggttcattggaagggttatgaatctgccctggattcttgggaaccaattgaaggtctaagtaattgcaaggaaaagattaaagaatttgtcagtcgaggcttcaagtcacagatattgcctttgcctggagatgttgatgtaatttgtggtggacctccttgccaaggtattagtggtttcaaccggtttcggaacaaagagagtcctttggatgatgagaagaacaaacaactagttgtttttatggatattgttcaataccttaagcccaaatttacattgatggaaaatgtggttgatcttgtaaaatttgcggaaggctttcttgggagatatgccttgggtcgccttcttcaaatgaattatcaagcgcgtttaggaattatggctgcaggtgcttatgggcttcctcagtttcgtttgcgcgtctttttatggggggctgcaccttctcagaagttgccacaatttccgcttccaactcatgatgttattgtaaggggtgttattcccttggagtttgagataaacactgtagcatacaatgaaggacaaaaggttcaactgcagaagaagcttttattggaggatgctatttctgaccttcctcgggttcagaacaatgagcgtcgtgatgagataaaatatgacaaagctgctcaaacggagttccaacgattcattagattaagcaaacatgaaatgttggagcttcaatctagaacaaaatcgtcgaagtctttgctatatgatcatcgtccactagaattgaatgcggatgattaccaacgtgtgtgtcggatccctaaaaagaagggtggatgcttcagagatttaccaggtgttcgtgtgggagctgataacaaggttgaatgggatcctgatgtcgaacgtgtatatttggattcaggaaaaccattggttccagattatgccatgacttttgtgaatggaacttcatcaaaaccttttgctcggttatggtgggatgaaactgttccaactgttgtgacaagagcagaacctcacaaccaggcaattttacaccctgaacaagacagagtgttgacgattcgtgaaaatgcaagactccaaggttttccagatttctacaagttgtgtgggccggtcaaagaaaggtacattcaagttgggaatgcagtggcagttccagtagctagagctttaggatacacactaggccttgcatttgaagggtctacttctacaagtgatgatccattgtataaattacctgataaatttcccatgattagggatcgggtttcttctgtatcttccgaagatgatgtgtaattcaacaacttttaataagttgcgattttgcatctgtgcaactataatttatgtatgatcggaaacattgttgtattatccagtctattgtttgagaaattgttcaatttatatattgaagcagcatttttagaaggcgcttaatttactgatgatatatataattgtagctagagttttactggtcttaatgatggt

SEQ ID NO: 152 - DNA, 3010 bp, Glycine max
atggaggtctcaaaacgtgtgcctatggcgaggaaagaggttgggtccaagggagagcccagacaactattagccaaccattttggagtttgcctagtcaagcccaaggatgatattgatggctacttctaccattatgatgttgccatgagttatgaagatgggaaccctgttgaggccaagggtgtagggagaaaggtcttaaatcaagtttgtgaaacatatgttgaactgagaaacatgagttttgcatatgatggtgaaaaaagtctattcactcttggtcctctagcaagtcagaggcttcaatatcctgttgtgttggaggatgtttcatcaaggagggttggaaagaatggaaaccctgctgagagtcctaagggaggatatacaaaaagaatgagaattaggcatcagtttcggccaaaaactatcaacgtggatatcaaatatgcagccaaaattccattgcaagcaattgaagatgcattgcgtggtcgggattctgagaaatctcaggaagcagtgagggttctagacatcatactgagacagcattctgcaaaccagggatacctccttgttcgccaatccttctttcatgacaatcgaagaacctgtactgatataggaggtggtgtgcaagggtgccgcggttttcattcaagctttcgagtcacacaaggaggtttatctctcaacatggatgtgacaaccacaatgattgtaaagcctggccctgtggtggacttccttctccagaatcagagtgttcagaacccaaactacattgattggaccaaggcaaagagaatgctgaagaacctaagaatcagggctaatggtgttgagttcaaaatctctggattgagtgataacacttgcaggaatcagaaatttcttttaaggcaaaagggtacgaatggtgaagtgcaggaaagggaaatcacagttcatgactactttacacgccaaaaactgattggcctgaactattctgctgacatgccatgcatcaatgttggcaaaccaaaacgcccgtcttattttccaatagagctatgtgaaatggtctcgttgcagcgttacaccaaggctctaacaaatttgcaaagggctcagctagtggagaagacaaggcaaaagccccaagttaggagacaagctttggaagatgccttaagaagcagcagatatgacgatgaacctatgcttcgctcttctgggattaccattgaacctaactttgttagactcgttggtcgtgtattggaacccccaaagcttatagttggaggagagaagagcatcattccccggaatgggcgctggaatttcaacaataagaaactatatgaacctttgatgattggtcgttgggccattgtaaacttctcaagtcggtgtgacacaagactcctgatagaactcattaggaggtgtgctgcagctaaagggatgaccatgagcaatagtctctttgataaagtaattgaagaggatggttgcttcatacgtgaaccaccaaatgtcagggtagagagaatgtatgcaaagctgaggaccactctgccgcacgagaaacctcactttctgttgtgtattcttccagagaaaaagaattctgacatttatggtccttggaagaagaaaagtcttgttgaagaagggattgtaacacaatgtattgcaccaacaaagattaatgatcaatacattactaatgtacttttgaaaattaatgcaaagtatggtgggatgaattcgtatctgtcagttgagctttgtaattccattccatttgtttcagctgtaccaaccttgattcttggtatggacgtttctcatggatctcctggtcgatcagatgtgccctctattgctgcggttgtgagctcaagatgttggcctcaaatttcacgttatagagcttcagttcgcacacaatcatcaaaagttgagatgattcaatctctattcaagcctgtggctaatactaataaggatgaaggtatcatcagggaggtgctgttggactttgaaattacttcattcaaaagaaagcctcaacaaattataattttcagggatggagtgagtgaatcacagttcaaccaggtgctcaatattgagttaagtcaaatcattgaggcatgcaaacaccttgatgaaaaatgggatccaaagttcactttgattattgcccagaagaatcatcatactaggttctttcaggccaatgctagagatcaaactaatgttccaccaggaaccgttattgacaacactgtctgtcatcccaaaaacaatgacttctacttgtgtgctcaagctgggatgattgggacaactcgacctactcactaccatgttttacacgatgaaatcggattctcagctgatgaagtgcaagaattagtgcattcattgtcttatacgtatcagaggagcacaactgctgtatcattagtcgctcccatttgctatgcccacttggcagcagcccagatggcacaatttatgaagtttgatgaacattctgagacttcttcaacccatggtggactcacatctgctagcgcacctttagtacctcaattaccacgtcttcacaaacaagtcatcaactccatgttcttttgttaatattttacatcatcttccttccacaaaaatttaattataaatttgacttttctgctgtccctcccttttgaagctgttctcgtactactcattcaaaaagatagcattttaagagttatgttatatttaattgtaaaaatattaacataactctcaaaaacgtcatgtcgaaggaacagcttggacagggaccagagagaagccaatttttcatatgaatgcctgtcattaggaactatctaggattgtttaaaatcgaatcaaatcgagtgtaaaactgaaaattgatccaagaaatcaatggtgattgatttggtttaattctctaattttccaaaccgcggttgggttcggttctcttaat

SEQ ID NO: 153 - DNA, 3216 bp, Glycine max
atggaggtctcaaaacgtgtgcctatggcgaggaaagaggttgggtccaagggagagcccagacaactattagccaaccattttggagtttgcctagtcaagcccaaggatgatattgatggctacttctaccattatgatgttgccatgagttatgaagatgggaaccctgttgaggccaagggtgtagggagaaaggtcttaaatcaagtttgtgaaacatatgttgaactgagaaacatgagttttgcatatgatggtgaaaaaagtctattcactcttggtcctctagcaagtcagaggcttcaatatcctgttgtgttggaggatgtttcatcaaggagggttggaaagaatggaaaccctgctgagagtcctaagggaggatatacaaaaagaatgagaattaggcatcagtttcggccaaaaactatcaacgtggatatcaaatatgcagccaaaattccattgcaagcaattgaagatgcattgcgtggtcgggattctgagaaatctcaggaagcagtgagggttctagacatcatactgagacagcattctgcaaaccagggatacctccttgttcgccaatccttctttcatgacaatcgaagaacctgtactgatataggaggtggtgtgcaagggtgccgcggttttcattcaagctttcgagtcacacaaggaggtttatctctcaacatggatgtgacaaccacaatgattgtaaagcctggccctgtggtggacttccttctccagaatcagagtgttcagaacccaaactacattgattggaccaaggcaaagagaatgctgaagaacctaagaatcagggctaatggtgttgagttcaaaatctctggattgagtgataacacttgcaggaatcagaaatttcttttaaggcaaaagggtacgaatggtgaagtgcaggaaagggaaatcacagttcatgactactttacacgccaaaaactgattggcctgaactattctgctgacatgccatgcatcaatgttggcaaaccaaaacgcccgtcttattttccaatagagctatgtgaaatggtctcgttgcagcgttacaccaaggctctaacaaatttgcaaagggctcagctagtggagaagacaaggcaaaagccccaagttaggagacaagctttggaagatgccttaagaagcagcagatatgacgatgaacctatgcttcgctcttctgggattaccattgaacctaactttgttagactcgttggtcgtgtattggaacccccaaagcttatagttggaggagagaagagcatcattccccggaatgggcgctggaatttcaacaataagaaactatatgaacctttgatgattggtcgttgggccattgtaaacttctcaagtcggtgtgacacaagactcctgatagaactcattaggaggtgtgctgcagctaaagggatgaccatgagcaatagtctctttgataaagtaattgaagaggatggttgcttcatacgtgaaccaccaaatgtcagggtagagagaatgtatgcaaagctgaggaccactctgccgcacgagaaacctcactttctgttgtgtattcttccagagaaaaagaattctgacatttatggtccttggaagaagaaaagtcttgttgaagaagggattgtaacacaatgtattgcaccaacaaagattaatgatcaatacattactaatgtacttttgaaaattaatgcaaagtatggtgggatgaattcgtatctgtcagttgagctttgtaattccattccatttgtttcagctgtaccaaccttgattcttggtatggacgtttctcatggatctcctggtcgatcagatgtgccctctattgctgcggttgtgagctcaagatgttggcctcaaatttcacgttatagagcttcagttcgcacacaatcatcaaaagttgagatgattcaatctctattcaagcctgtggctaatactaataaggatgaaggtatcatcagggaggtgctgttggactttgaaattacttcattcaaaagaaagcctcaacaaattataattttcagggatggagtgagtgaatcacagttcaaccaggtgctcaatattgagttaagtcaaatcattgaggcatgcaaacaccttgatgaaaaatgggatccaaagttcactttgattattgcccagaagaatcatcatactaggttctttcaggccaatgctagagatcaaactaatgttccaccaggaaccgttattgacaacactgtctgtcatcccaaaaacaatgacttctacttgtgtgctcaagctgggatgattctgtgccactttggacaacctctttccccctttggccatggcggaatccaccgtcgtgaccctcccggaactcctctccgtcaccgccgtgggcctggccccctccggcggcatcttggtgggcgtgaacctggagttccctggtttcccttgttgtcaccgctgacgtccaacatcgagatgtgcatctcgcacattggttggtggggacaactcgacctactcactaccatgttttacacgatgaaatcggattctcagctgatgaagtgcaagaattagtgcattcattgtcttatacgtatcagaggagcacaactgctgtatcattagtcgctcccatttgctatgcccacttggcagcagcccagatggcacaatttatgaagtttgatgaacattctgagacttcttcaacccatggtggactcacatctgctagcgcacctttagtacctcaattaccacgtcttcacaaacaagtcatcaactccatgttcttttgttaatattttacatcatcttccttccacaaaaatttaattataaatttgacttttctgctgtccctcccttttgaagctgttctcgtactactcattcaaaaagatagcattttaagagttatgttatatttaattgtaaaaatattaacataactctcaaaaacgtcatgtcgaaggaacagcttggacagggaccagagagaagccaatttttcatatgaatgcctgtcattaggaactatctaggattgtttaaaatcgaatcaaatcgagtgtaaaactgaaaattgatccaagaaatcaatggtgattgatttggtttaattctctaattttccaaaccgcggttgggttcggttctcttaat

SEQ ID NO: 154 - DNA, 1550 bp, Glycine max
gaccatgagcaatagtctctttgataaagtaattgaagaggatggttgcttcatacgtgaaccaccaaatgtcagggtagagagaatgtatgcaaagctgaggaccactctgccgcacgagaaacctcactttctgttgtgtattcttccagagaaaaagaattctgacatttatggtccttggaagaagaaaagtcttgttgaagaagggattgtaacacaatgtattgcaccaacaaagattaatgatcaatacattactaatgtacttttgaaaattaatgcaaagtatggtgggatgaattcgtatctgtcagttgagctttgtaattccattccatttgtttcagctgtaccaaccttgattcttggtatggacgtttctcatggatctcctggtcgatcagatgtgccctctattgctgcggttgtgagctcaagatgttggcctcaaatttcacgttatagagcttcagttcgcacacaatcatcaaaagttgagatgattcaatctctattcaagcctgtggctaatactaataaggatgaaggtatcatcagggaggtgctgttggactttgaaattacttcattcaaaagaaagcctcaacaaattataattttcagggatggagtgagtgaatcacagttcaaccaggtgctcaatattgagttaagtcaaatcattgaggcatgcaaacaccttgatgaaaaatgggatccaaagttcactttgattattgcccagaagaatcatcatactaggttctttcaggccaatgctagagatcaaactaatgttccaccaggaaccgttattgacaacactgtctgtcatcccaaaaacaatgacttctacttgtgtgctcaagctgggatgattgggacaactcgacctactcactaccatgttttacacgatgaaatcggattctcagctgatgaagtgcaagaattagtgcattcattgtcttatacgtatcagaggagcacaactgctgtatcattagtcgctcccatttgctatgcccacttggcagcagcccagatggcacaatttatgaagtttgatgaacattctgagacttcttcaacccatggtggactcacatctgctagcgcacctttagtacctcaattaccacgtcttcacaaacaagtcatcaactccatgttcttttgttaatattttacatcatcttccttccacaaaaatttaattataaatttgacttttctgctgtccctcccttttgaagctgttctcgtactactcattcaaaaagatagcattttaagagttatgttatatttaattgtaaaaatattaacataactctcaaaaacgtcatgtcgaaggaacagcttggacagggaccagagagaagccaatttttcatatgaatgcctgtcattaggaactatctaggattgtttaaaatcgaatcaaatcgagtgtaaaactgaaaattgatccaagaaatcaatggtgattgatttggtttaattctctaattttccaaaccgcggttgggttcggttctcttaat

SEQ ID NO: 155 - DNA, 3355 bp, Glycine max
gcagttgttatactttcttatatttatttgtcagtgaattagaagcaaaagtgactattttttttaataccttttctggttgtcatcctctttccactaaatcccaccaaaaacccttcaaaatcccaaaacccttccaaagataagttgcttgggttcttccttctaccgcccaccgtcccaggattgaactcaactcaggaaactcggactcgtggaatgaacgatggaggttgcgattacgagagctaagggaggaatgacggaggaagttcctgggattgtagaagctgctgaacctccaacatcatcacaatcacctgctgatgtgccacataatttggaaacagaacaaatgactcctacaaagtattctattatcagtaggaatggggttgggaccacaggaaaacacatacctttacttgtgaatctctttgaagttgctgttaatgttccagacacagtattttttcagtatagtgttgctattactttcgaagataaacaagctgttgaaagcaagggcattgggagaaaagtgattgataggctttaccaaacatactcttctgaacttggtggcaaaaggtttgtatatgatggagggaaaactttgtacacagtgggtcctctgccactaaataagtacgagttcaaagtgttgctggagaaatcatttacaaaacgtagtgccaagagtcctggtgctaatggaagccttcatgaggaaactaaaaggtcaaaacattcatttcagtcaaagacattcatggtggagataagttttgctaccaaaataccacttcagtccattgttatttccttgaaagaggttgagtcggataccaattctcaagatgctttgagagtgcttgatactatactgaggcagcgtgcagctaactgtgggtgtctcttggtaaggcaatctttttttcatgatgactcaagaaatttcaatgatgttggggctggtgtaacagcagtctcaggttttcattccagttttcgttccacacagcgaggattgtctctcaatattgacgtgtcaacaactattatcataaaacctggacctgtaattgattttctgttatcaaatcagcaagtgaaggaaccccgttatattgactgggaaaaggcgaaaaaaatgcttaaaaatttaagggtgcaagcaactcatcataaccaggaatttaaaatttctgggttgagtgagaaaccatgcattcagcaactttttagtatgaaggttaaaaatgatgacaacaatagcagagggcagacagtggatattactgtttatgaatattttgccaaacactgtggcatagagttgacctcatctgcttatcttccatgtcttgatgttgggaaaccaaaacgtcccgtctatcttcccttggagctatgttcacttgtttccctccaacggtatacaaaggttttatctctgatgcaaagagcatctttagttgaaaaatcacgccaaaagcctcaagatagaatcaaaattttaaaaagtgctgtaggaaaatgctatgatgatgatcctgttcttgctgcatgtggcatttctattgagaaacaactgaatctgattgaaggtcgtgttcttgaaacaccaaagttgaaggttggtaagaatgatgattgcatcccccataacggaaggtggaattttaataagaagacacttctacaagcatcacatattgattattgggctgttgtcaacttttctgcaagttgtgatactagttacatatcaagggagctgatcagatgtggaatgagcaagggcattaacattgaacggccatatactttgatagaggaggaaccacagttgagaaaatctcaccctgttgcaagggttgaaagaatgtttgacctgcttgcatcaaaactgaatagagagccaaagttgattctttgtgtcttgccagagaggaaaatttgtgatatatatgggccttggaaaaagaagtgtctgagtgaaattggtgttgtcacacagtgcattgcccctgtcaagatcactaatcaataccttactaatgttcttcttaaaatcaattctaagcttggaggaataaattctctgttggcaatagagcattctgggcatcttcccctgattaaagataccccaacgatgattttggggatggatgtctctcacaattcacttggtcgattagatagtccatcaatagcagctgttgttggatctcgacattggccactgatttcaaggtatagagcgtctgtgagaatgcaggcatccaaggtggagatgattgatgctctatacaagccattggaaaatgggagtgatgatggtattatcagagaattgcttttagatttctatgattctagtaatggacgcaagccaactcaatttattgtattcagggatggagttagtgaatcacaattcgaacaagttttaactatcgagcttaaccagataatcaaggcctatcaacatcttggtgaggttaatgttccccagttcactgtgattgtggcacaaaaaaagcatcatattaagctgtttctgcctaatggcccagaaaatgttcctcctgggacggttgtggatacaacaattacgcatccaagaaattatgatttttacatgtgtgctcatgcagggatgcttggaacatccaggcctgtacattatcatgtgctacttgatgagattggtttctcggcagatggcttgcaaaatttgatccattcgttgtcctatgtgaaccaaaggagcacaattgcaacctcagttgtggcacccatatgctatgctcaccatgctgcagctcagatgggacaacttttgaattttgatgattcatcagaaacaggttcaagtcctgcttcagagggaggcatccccatcccagagcttccaaggttgcacaggaatgtcaggagttccatgttcttctgttgaggtgtgtagatgacaggtgctagtaaatacatttagattgatcaaaagtgtaaatgtacatttggtataacctgcaaacatatgaagcccaaattttgtttgatggggagatggattcgtgggctagggtacagtctacatattagtgatatgaattgtcattttgagacatcaatcacggtaattgagtcgcatgggcttactagcttttttgcatatattgcagctatgaaatatttctacccttccttttttttagagaaatgtgattttatgtcaaatgctctgatttagtgtgtttggttggatatttggggagcttttaagtcatttgattagctattaattttgacaattttgtttggcacactaaggttttagaggagc

SEQ ID NO: 156 - DNA, 3133 bp, Glycine max
aaaaaaagtccattctgtgtcttgttacgtccaaaacgccgtttccttgtgtcagtgacaaacgatttttggccactccgcgatgtcgctgggtaacgctaagggaggaatgacggaggaagttcctgggattgtagaagctgctgaacctccaacatcatcacaatcacctgctgatgtgccacataatttggaaacagaacaaatgactcctacaaagtattctattatcagtaggaatggggttgggaccacaggaaaacacatacctttacttgtgaatctctttgaagttgctgttaatgttccagacacagtattttttcagtatagtgttgctattactttcgaagataaacaagctgttgaaagcaagggcattgggagaaaagtgattgataggctttaccaaacatactcttctgaacttggtggcaaaaggtttgtatatgatggagggaaaactttgtacacagtgggtcctctgccactaaataagtacgagttcaaagtgttgctggagaaatcatttacaaaacgtagtgccaagagtcctggtgctaatggaagccttcatgaggaaactaaaaggtcaaaacattcatttcagtcaaagacattcatggtggagataagttttgctaccaaaataccacttcagtccattgttatttccttgaaagaggttgagtcggataccaattctcaagatgctttgagagtgcttgatactatactgaggcagcgtgcagctaactgtgggtgtctcttggtaaggcaatctttttttcatgatgactcaagaaatttcaatgatgttggggctggtgtaacagcagtctcaggttttcattccagttttcgttccacacagcgaggattgtctctcaatattgacgtgtcaacaactattatcataaaacctggacctgtaattgattttctgttatcaaatcagcaagtgaaggaaccccgttatattgactgggaaaaggcgaaaaaaatgcttaaaaatttaagggtgcaagcaactcatcataaccaggaatttaaaatttctgggttgagtgagaaaccatgcattcagcaactttttagtatgaaggttaaaaatgatgacaacaatagcagagggcagacagtggatattactgtttatgaatattttgccaaacactgtggcatagagttgacctcatctgcttatcttccatgtcttgatgttgggaaaccaaaacgtcccgtctatcttcccttggagctatgttcacttgtttccctccaacggtatacaaaggttttatctctgatgcaaagagcatctttagttgaaaaatcacgccaaaagcctcaagatagaatcaaaattttaaaaagtgctgtaggaaaatgctatgatgatgatcctgttcttgctgcatgtggcatttctattgagaaacaactgaatctgattgaaggtcgtgttcttgaaacaccaaagttgaaggttggtaagaatgatgattgcatcccccataacggaaggtggaattttaataagaagacacttctacaagcatcacatattgattattgggctgttgtcaacttttctgcaagttgtgatactagttacatatcaagggagctgatcagatgtggaatgagcaagggcattaacattgaacggccatatactttgatagaggaggaaccacagttgagaaaatctcaccctgttgcaagggttgaaagaatgtttgacctgcttgcatcaaaactgaatagagagccaaagttgattctttgtgtcttgccagagaggaaaatttgtgatatatatgggccttggaaaaagaagtgtctgagtgaaattggtgttgtcacacagtgcattgcccctgtcaagatcactaatcaataccttactaatgttcttcttaaaatcaattctaagcttggaggaataaattctctgttggcaatagagcattctgggcatcttcccctgattaaagataccccaacgatgattttggggatggatgtctctcacaattcacttggtcgattagatagtccatcaatagcagctgttgttggatctcgacattggccactgatttcaaggtatagagcgtctgtgagaatgcaggcatccaaggtggagatgattgatgctctatacaagccattggaaaatgggagtgatgatggtattatcagagaattgcttttagatttctatgattctagtaatggacgcaagccaactcaatttattgtattcagggatggagttagtgaatcacaattcgaacaagttttaactatcgagcttaaccagataatcaaggcctatcaacatcttggtgaggttaatgttccccagttcactgtgattgtggcacaaaaaaagcatcatattaagctgtttctgcctaatggcccagaaaatgttcctcctgggacggttgtggatacaacaattacgcatccaagaaattatgatttttacatgtgtgctcatgcagggatgcttggaacatccaggcctgtacattatcatgtgctacttgatgagattggtttctcggcagatggcttgcaaaatttgatccattcgttgtcctatgtgaaccaaaggagcacaattgcaacctcagttgtggcacccatatgctatgctcaccatgctgcagctcagatgggacaacttttgaattttgatgattcatcagaaacaggttcaagtcctgcttcagagggaggcatccccatcccagagcttccaaggttgcacaggaatgtcaggagttccatgttcttctgttgaggtgtgtagatgacaggtgctagtaaatacatttagattgatcaaaagtgtaaatgtacatttggtataacctgcaaacatatgaagcccaaattttgtttgatggggagatggattcgtgggctagggtacagtctacatattagtgatatgaattgtcattttgagacatcaatcacggtaattgagtcgcatgggcttactagcttttttgcatatattgcagctatgaaatatttctacccttccttttttttagagaaatgtgattttatgtcaaatgctctgatttagtgtgtttggttggatatttgg

SEQ ID NO: 157 - DNA, 3280 bp, Glycine max
gctaatcatataggagtggccaaaacaaatttgagcaatcttttttgtttcttttctttaattacagacccatggtgcttcgtggaaacattcttcttttctaccccagcttgatgtgataatggatatatgacactatcctttagagaaaaactgcatctaactaagctactattcacaggacagataatggtgtgaatttggattgattttcaccatgggttgctttacataactttcatgcgctaagggaggaatgacggaggaagttcctgggattgtagaagctgctgaacctccaacatcatcacaatcacctgctgatgtgccacataatttggaaacagaacaaatgactcctacaaagtattctattatcagtaggaatggggttgggaccacaggaaaacacatacctttacttgtgaatctctttgaagttgctgttaatgttccagacacagtattttttcagtatagtgttgctattactttcgaagataaacaagctgttgaaagcaagggcattgggagaaaagtgattgataggctttaccaaacatactcttctgaacttggtggcaaaaggtttgtatatgatggagggaaaactttgtacacagtgggtcctctgccactaaataagtacgagttcaaagtgttgctggagaaatcatttacaaaacgtagtgccaagagtcctggtgctaatggaagccttcatgaggaaactaaaaggtcaaaacattcatttcagtcaaagacattcatggtggagataagttttgctaccaaaataccacttcagtccattgttatttccttgaaagaggttgagtcggataccaattctcaagatgctttgagagtgcttgatactatactgaggcagcgtgcagctaactgtgggtgtctcttggtaaggcaatctttttttcatgatgactcaagaaatttcaatgatgttggggctggtgtaacagcagtctcaggttttcattccagttttcgttccacacagcgaggattgtctctcaatattgacgtgtcaacaactattatcataaaacctggacctgtaattgattttctgttatcaaatcagcaagtgaaggaaccccgttatattgactgggaaaaggcgaaaaaaatgcttaaaaatttaagggtgcaagcaactcatcataaccaggaatttaaaatttctgggttgagtgagaaaccatgcattcagcaactttttagtatgaaggttaaaaatgatgacaacaatagcagagggcagacagtggatattactgtttatgaatattttgccaaacactgtggcatagagttgacctcatctgcttatcttccatgtcttgatgttgggaaaccaaaacgtcccgtctatcttcccttggagctatgttcacttgtttccctccaacggtatacaaaggttttatctctgatgcaaagagcatctttagttgaaaaatcacgccaaaagcctcaagatagaatcaaaattttaaaaagtgctgtaggaaaatgctatgatgatgatcctgttcttgctgcatgtggcatttctattgagaaacaactgaatctgattgaaggtcgtgttcttgaaacaccaaagttgaaggttggtaagaatgatgattgcatcccccataacggaaggtggaattttaataagaagacacttctacaagcatcacatattgattattgggctgttgtcaacttttctgcaagttgtgatactagttacatatcaagggagctgatcagatgtggaatgagcaagggcattaacattgaacggccatatactttgatagaggaggaaccacagttgagaaaatctcaccctgttgcaagggttgaaagaatgtttgacctgcttgcatcaaaactgaatagagagccaaagttgattctttgtgtcttgccagagaggaaaatttgtgatatatatgggccttggaaaaagaagtgtctgagtgaaattggtgttgtcacacagtgcattgcccctgtcaagatcactaatcaataccttactaatgttcttcttaaaatcaattctaagcttggaggaataaattctctgttggcaatagagcattctgggcatcttcccctgattaaagataccccaacgatgattttggggatggatgtctctcacaattcacttggtcgattagatagtccatcaatagcagctgttgttggatctcgacattggccactgatttcaaggtatagagcgtctgtgagaatgcaggcatccaaggtggagatgattgatgctctatacaagccattggaaaatgggagtgatgatggtattatcagagaattgcttttagatttctatgattctagtaatggacgcaagccaactcaatttattgtattcagggatggagttagtgaatcacaattcgaacaagttttaactatcgagcttaaccagataatcaaggcctatcaacatcttggtgaggttaatgttccccagttcactgtgattgtggcacaaaaaaagcatcatattaagctgtttctgcctaatggcccagaaaatgttcctcctgggacggttgtggatacaacaattacgcatccaagaaattatgatttttacatgtgtgctcatgcagggatgcttggaacatccaggcctgtacattatcatgtgctacttgatgagattggtttctcggcagatggcttgcaaaatttgatccattcgttgtcctatgtgaaccaaaggagcacaattgcaacctcagttgtggcacccatatgctatgctcaccatgctgcagctcagatgggacaacttttgaattttgatgattcatcagaaacaggttcaagtcctgcttcagagggaggcatccccatcccagagcttccaaggttgcacaggaatgtcaggagttccatgttcttctgttgaggtgtgtagatgacaggtgctagtaaatacatttagattgatcaaaagtgtaaatgtacatttggtataacctgcaaacatatgaagcccaaattttgtttgatggggagatggattcgtgggctagggtacagtctacatattagtgatatgaattgtcattttgagacatcaatcacggtaattgagtcgcatgggcttactagcttttttgcatatattgcagctatgaaatatttctacccttccttttttttagagaaatgtgattttatgtcaaatgctctgatttagtgtgtttggttggatatttgg

SEQ ID NO: 158 - DNA, 3227 bp, Glycine max
gctaatcatataggagtggccaaaacaaatttgagcaatcttttttgtttcttttctttaattacagacccatggtgcttcgtggaaacattcttcttttctaccccagcttgatgtgataatggatatatgacactatcctttagagaaaaactgcatctaactaagctactattcacaggacagataatgctaagggaggaatgacggaggaagttcctgggattgtagaagctgctgaacctccaacatcatcacaatcacctgctgatgtgccacataatttggaaacagaacaaatgactcctacaaagtattctattatcagtaggaatggggttgggaccacaggaaaacacatacctttacttgtgaatctctttgaagttgctgttaatgttccagacacagtattttttcagtatagtgttgctattactttcgaagataaacaagctgttgaaagcaagggcattgggagaaaagtgattgataggctttaccaaacatactcttctgaacttggtggcaaaaggtttgtatatgatggagggaaaactttgtacacagtgggtcctctgccactaaataagtacgagttcaaagtgttgctggagaaatcatttacaaaacgtagtgccaagagtcctggtgctaatggaagccttcatgaggaaactaaaaggtcaaaacattcatttcagtcaaagacattcatggtggagataagttttgctaccaaaataccacttcagtccattgttatttccttgaaagaggttgagtcggataccaattctcaagatgctttgagagtgcttgatactatactgaggcagcgtgcagctaactgtgggtgtctcttggtaaggcaatctttttttcatgatgactcaagaaatttcaatgatgttggggctggtgtaacagcagtctcaggttttcattccagttttcgttccacacagcgaggattgtctctcaatattgacgtgtcaacaactattatcataaaacctggacctgtaattgattttctgttatcaaatcagcaagtgaaggaaccccgttatattgactgggaaaaggcgaaaaaaatgcttaaaaatttaagggtgcaagcaactcatcataaccaggaatttaaaatttctgggttgagtgagaaaccatgcattcagcaactttttagtatgaaggttaaaaatgatgacaacaatagcagagggcagacagtggatattactgtttatgaatattttgccaaacactgtggcatagagttgacctcatctgcttatcttccatgtcttgatgttgggaaaccaaaacgtcccgtctatcttcccttggagctatgttcacttgtttccctccaacggtatacaaaggttttatctctgatgcaaagagcatctttagttgaaaaatcacgccaaaagcctcaagatagaatcaaaattttaaaaagtgctgtaggaaaatgctatgatgatgatcctgttcttgctgcatgtggcatttctattgagaaacaactgaatctgattgaaggtcgtgttcttgaaacaccaaagttgaaggttggtaagaatgatgattgcatcccccataacggaaggtggaattttaataagaagacacttctacaagcatcacatattgattattgggctgttgtcaacttttctgcaagttgtgatactagttacatatcaagggagctgatcagatgtggaatgagcaagggcattaacattgaacggccatatactttgatagaggaggaaccacagttgagaaaatctcaccctgttgcaagggttgaaagaatgtttgacctgcttgcatcaaaactgaatagagagccaaagttgattctttgtgtcttgccagagaggaaaatttgtgatatatatgggccttggaaaaagaagtgtctgagtgaaattggtgttgtcacacagtgcattgcccctgtcaagatcactaatcaataccttactaatgttcttcttaaaatcaattctaagcttggaggaataaattctctgttggcaatagagcattctgggcatcttcccctgattaaagataccccaacgatgattttggggatggatgtctctcacaattcacttggtcgattagatagtccatcaatagcagctgttgttggatctcgacattggccactgatttcaaggtatagagcgtctgtgagaatgcaggcatccaaggtggagatgattgatgctctatacaagccattggaaaatgggagtgatgatggtattatcagagaattgcttttagatttctatgattctagtaatggacgcaagccaactcaatttattgtattcagggatggagttagtgaatcacaattcgaacaagttttaactatcgagcttaaccagataatcaaggcctatcaacatcttggtgaggttaatgttccccagttcactgtgattgtggcacaaaaaaagcatcatattaagctgtttctgcctaatggcccagaaaatgttcctcctgggacggttgtggatacaacaattacgcatccaagaaattatgatttttacatgtgtgctcatgcagggatgcttggaacatccaggcctgtacattatcatgtgctacttgatgagattggtttctcggcagatggcttgcaaaatttgatccattcgttgtcctatgtgaaccaaaggagcacaattgcaacctcagttgtggcacccatatgctatgctcaccatgctgcagctcagatgggacaacttttgaattttgatgattcatcagaaacaggttcaagtcctgcttcagagggaggcatccccatcccagagcttccaaggttgcacaggaatgtcaggagttccatgttcttctgttgaggtgtgtagatgacaggtgctagtaaatacatttagattgatcaaaagtgtaaatgtacatttggtataacctgcaaacatatgaagcccaaattttgtttgatggggagatggattcgtgggctagggtacagtctacatattagtgatatgaattgtcattttgagacatcaatcacggtaattgagtcgcatgggcttactagcttttttgcatatattgcagctatgaaatatttctacccttccttttttttagagaaatgtgattttatgtcaaatgctctgatttagtgtgtttggttggatatttgg

SEQ ID NO: 159 - DNA, 3793 bp, Glycine max
aaaaactagtaatattgtactgtaccactcttaaatagagatacgcaccttattattgttaattcaattgaagttactgacacaagtaatcattgatgttacgttcgaactcgaaaatttcgctgtaaattttcttacaagtatttatcttaagcctttaatgcgctcacctcaattcatttctacaaacggcgtatttatccataaaaacaaaataggagcaagaaaaaaattagattctaattttaaaattaatttttttaaaaaagataattattttctcttgatattttccttattttttcaccacactctacccagaaagggagtgcacgatattcagtaatcacccactctcactcattcgtaaagttttttctggattctactcatttgtatttgtatagtttactaccaactgcaaataaaaaaaagaaaaagatgacgacctttcttccattcgaaactgttaccttcgctgcaataccagcaatagtacgttgcctctccccgctcacgccaacaacacttcgtaataccaaacaaacattcccttcaatttctctttctctctcaaaaaatgtctcctcgcggtggctccaagcagcaaccagattcacgccgtcaagcgccaccgtccgcggcggcggcggtgccttctcctcccggaagaggacgcggccgtggacgcggagaatcctccgttcccgcgccttctctggtgaatgcaccatctgctcctcctccggcttccaccatcggcgttccgtccggcgccgcgccttttcgtgctgcgttgccacctccggcggtggaatctctcacttccgcggtcgaaaagcaacttacaatgcaaccttcggcgccgtcgtcgtcgaaggcggtgaggttcaaggaacggccagggttcggtcttgctggggagaaaatcaaagttcgagcgaatcattttcaagtccaagtcgccgaacaagatctatttcattatgacgtctctatcaatcctgagattacttcgaagaaggtttctagagatgttatgactttgcttgtgcaagcgcatcgtgaaaagattctcggaaatcgcataccagcctacgatgggggaaagagtcttttcaccgctggatccttgcccttcgaatctaaggattttgtgatcgtgctaaaagacgacgatgaaccaggctcgtcgtcttcttcctctcctactaggaaaaaacgtgaacgcgagtatagagtcaccatcaggcttgcttccagaactgacattcaccacctcagtcagtttctcaggcgccgtcagttggattgtccttatgagactatccaggctcttgatgttgttctgcgtgctacaccgtctgaaaggttcgttgttgtgggaagatcgttcttctcaccttctttggggaaacctggatcgcttggtagcggaacggagtactggaggggctattaccagagccttcgcccaactcagatgggcctgtctcttaacattaatgtgtcggcgagggctttttatgagcctattcctgtgattgatttcattgaaagtcattttagggccaatccttccaggcctttgcctgatcaggatcgaatcaagcttaagagagtactgagaggagtgaaggtagaagtgactcatggaaagaatcttagacgttacaagatcactggagtcacaaaagaacaactcagaaagttaatgtttactcttgatgacaatagaacaaaaagctcagttgttcaatattttcatgagaaatacaatattgtgttgaagcatacgcttcttcctgctcttcaagctggtagtgacattaaaccaatttttctgcctatggagctttgtcaaattgtggctggacaaagatatacaaagagattgaatgaggagcaagtaactaatcttttaagggcatcttgtcagcgtcctcgtgatagagaaaactctatcagacaggtggtgaggcaaagtaatttcagcacagacaaatttgtgagtcactttggaattcaagtgagggaggatccagcattgcttgatgctcgagttcttcctgcaccaatgctaaaatatcatgacacaggtagagaatcaagtgttgaacccaaaatgggccaatggaatatgattgataagaaaatgtttaatgctggtgttgtggaacattggacttgcctcaacttttctggaaaaataaacagagagtttccaagtgcattttgtcataagttggccagaatgtgtagtaacaagggcatgcgttttaattcaaagcctttactgcccataacatctgctcaaagtagtcaaatagagagtgctcttgtaaatttgcataagcagtctattacaagactagcaaaccaaggaagactccaattgttgatcataattttgccagatttcgaggggtcctatgaaaaaataaagcgtatttgtgaaactgagctaggaatagtgtctcagtgttgtcagccgaggcatgtttgccagatgaagccacaatatcttgaaaatgtggccctcaagataaatgtgaaggttggtggcagtaacacagtattgaatgatgcaattgctagaataattcctcgtgtgtctgacagacctacattaatcttgggtgcggatgtaacacatccacagccaggggaagattctagtccttctattgctgcagtagttgcatctatggattggccttatgtaacaaggtacagaggagttgtttctgctcagactcaccgtgaagaaatcatccaagatctttataatacatgtgaagatcctgtgaaggggaaggtgcattcgggaattatcagggagttacttcgcgctttccgtttgtctactaatcagaagccagagaggattatattctacagggatggagtaagtgagggccaattcagccaggttttgctgtacgagatggatgcaatacggcgggcttgtgcttcactacaagaaggctatttaccccgtgttacttttgtggtggtccaaaaacgacaccacacaaggttatttcctgtagatcatggaagtcatgatcagacaaataaaagtggaaatataatgccagggactgtcgtagacacacacatatgccaccctcgggagtttgatttttacctcaacagtcatgctggaatgcaaggaactagtcgaccaacacattatcatgtgctgttcgatgaaaacaacttcactgctgacgggttgcaaatgtttactaataatttgtgttatacgtatgcaaggtgtactcgatcagtctcaatagttccacctgtgtattatgcacatttggctgccttcagggctcgctgttacattgaagttgcaacatcagattctggttctgcaagtggaggccgggctgctaactgtgaggttagattgccttcggttaaggaaaatgtgaaagatgtgatgtttttctgttaagcctgtgagatgcttttgtgaagatggggggatattgatatgaggttatgtatgattttgggctttatagagctactttataaacattttgctatcttttttttttttttttaatttgttgctgctacattcaaagttcagttaatatacaaagttcagttagctttcggttcgaatatatcttggcctcattcctagcatcagtagagttgtagctctcacctgaatacttgaatggttttgttgagacacaattggagcaatttttgcagcctggattatggatgtggatttagtcttaatatagtgatgcatttgaagtttcag

SEQ ID NO: 160 - DNA, 3684 bp, Glycine max
tggctgttggtcttctttttctacttataaggtcactactctctccccactcacgcataccacacttccttccctcctagtcaaaccaacaaatattctttctctcaaatcctctttcttactctaaaatgtctcgtcgcggtggctctaaacaacaaccagattcacgccatccagcaccaccgtctgcggcgccttctcccgccggaagaggacgcggccgtggccgcggagaattctcctcagttcccgctccttctccggtgaatgcaccatccgctcctcctccggcttccaccatcggcgttccttccggcgccgcacctgttcgtgccgcgtctccgtctccggcggcagaatctctcacttccgctgtcgaaaagcaacttacattgcaaccgtcggcgccttcgtcgacgaaggcggtgaggttcagtgaacggccagggttcggtcttgtagggaagaaaatcaaagttcgagcgaatcatttccaagtcaaagtcgctgaacaagatctatttcattatgacgtctctatcaatccggagattaattcgaagaaggtttgcagagatgttatgactctgcttgttcaagcgcaccgtgaaaagtttcttggaaatcgcataccggcctacgatgggcgaaagagtcttttcaccgccggacccttgcccttcgaatcgaaggattttgtgatcgtgctgaaggatgaagatgaaccaggctcgtcttcttccgcgcctgctagaaaaaaacgtgaacgcgagtttagggtcaccatcaggtttgcttccaggactgaccttcaccatctcgggcagtttctcaggcgtcgtcagttggattgtccttatgaaactattcaggctcttgatgttgttctgcgtgctactccatctgaaaggttcgatgtggtgggaagatcgtttttctcgccttttttggggaaacctggaacgcttggtagcggaacggagtattggaggggctattaccagagccttcgtccaactcagatgggcctgtctctaaatattgatgtgtcagcaagggcgttttatgaagctattcctgtgattgatttcattcaaatccattttaggctcaatccttccaagcctctgcctgatcaggatcgaatcaagcttaagagagcattgagaggaatcaaggtagaagttaatcacggaaagaatcttagacgttacaagatcactggagtcacaaaagaaccactcagagagttaatgtttactcttgatgacaaaagaacaaaaagctcagttgttcaatattttcatgagaaatacaatattgtgttgaagcatacacatcttcctgctcttcaagctggcagtgacagtaaaccaatttttttgcctgttgagctttgtcaaattgttgctggacagagatatacaaagagattgaatgaggagcaagtaactaatcttttaagggcaacttgtcagcgtcctcatgatagagaaaactctatcaaacaggttgtgaagcaaagtaatttcagcacagacaaatttgtgtgtcactttggaattcaagtgaaggaggaaccagcattgcttgatgctcgggttttgcctcccccaatgctaaaatatcatggcacaggtagagaatcatgtgttcaacccagaacaggtcaatggaatatgattgataagaaaatggttaatggtggcgctgtgcagcattggacttgcctcaacttttctggaaaaacaaaccgaggtttggcagcttcattttgtcaagagttggccaaaatgtgtaataacaagggcatgcgttttaacttggatcctttgctgcccataacatctgttcatagtagtcaagtagagagtgctcttgggaatgtgcataagcaggctattgcaaaactagcaaacgaaggaagactcgaattattgatcataattttgcctgatttgaagggatcctatgggaaaataaagcgtatttgtgaaactgagttagggatagtatctcagtgttgtcttccgaggcatgtttaccagatgaagccacaatatcttgaaaatgtggccctcaagataaatgtgaaggttggtggcagtaacacagtattgaatgatgcatttactagaagaattcctcacgtgtctgacttaccaacaataatcttgggtgcagatgtaacacatccacagccaggggaagattatagtccttctattgctgcagtagttgcatcaatggattggccttatgtaacaaagtacagaggagttgtttctgctcaaactcaccgtgaagaaatcatccaagatctttataatacacatgaagatcctgtgaggggaaagacacattcgggaattatcagggaattacttcgtgctttccgtttatcaactaagactaagccagagaggattatattctacagagatggagtaagtgagggccaattcagccaggttttgctgtacgagatggatgcaatacgacgcgcttgtgcctcactacaagaagactatatgccccgtgttacttttgtggtggtccagaaaagacaccacacaaggttatttcctgcagaacacggaagtcgtgatcagacagataaaagtggaaatatattgccagggactgtcgtggacactcaaatatgccaccctcgggagtttgatttttacctcaacagtcatgctggaatacaaggaactagtcgaccaacacattatcatgtgctgttcgatgaaataacttcactgctgacgagttgcaaatgcttacaaataacttgacttatacgtatgcaaggtgtactcgatcagtctcaatagttccgcctgcatattatgcacatttggctgccttcagggctcgctattacatggaaggtgaaacatcagattctggttctgcaagtggaggccggactgctaactttgaggttaaattgccttcggttaaggaaaatgtgaaagatgtgatgttcttctgttgaaggctgtggtatgcttttgtgaagatgggtttgcttttatgagatgctttttgtgaagattggggtggtgggggtattgatatgagattaagtttgtttttgggctttatagttttttataaacattttgctatctttttcttaattttagttgctgctacatgcaaagttcagttatatacaaagttcagttagcttttcggtccaaatatcttggcgtcgttcctagtatcattagagttgcaattttttgcaggctggatgacggatgggaatttaatctttactataatcatgcatttgaagtttcagatagtttacaacttaaacaacattttagcgaagaattgtaaggaataagcggtaaacagagcgttgtgggtagaaaagttgagcaataggaaattatggtcaacttgtaggaaaggcaatgttccgtcagcttgttatattaatttatttaaatagtaattattagttatgttataattataaaatgaagtttaaagttgtagttctaataaaaaaataatatatgatgtagacgatgaaggacaaggtgacaaaaatgcaaacgcgttcaacttttaagactacatttaatcttctttaaatagaagatgatattgatttgtacttttgttatgatcgtcatttggctatttaattggtacacttgt

SEQ ID NO: 161 - DNA, 5567 bp, Glycine max
ttcgaaaacgtgcgtggaaagaaaacaaagaacaaagacctttatgcgagaaaaaaaagataatcaatgttgggtcacacacaatcattctactggtcagtcttagtgagcgagcgtgttcactaaggtaactctttatcactcttttcttcgctgactccattatcaacgttttgaacaaaactctctctcttgttattattattcttctttttctcttttcactctcctttgtttgtcctttgaacccacccgtgaaccctccttcaaccgtcatcgttttgatcacatacacccactcttaaaccttcaaactctcttcgccttgggtaatgccggacggagaatcctccgtcgtcgtcgccggcggccaagcttccatggaaccctccttaagcgtctccaatcaactgcagtccctgagtctttcccaagacaaaaaccatgatgactcagtcaagaaagatccccggaaaattgcaagaaagtatcagttggagttatgcaaaaaagctatggaggaaaatataattgtgtatttagggacagggtgtgggaagacccacattgctgtgcttcttatgtatgggatgggtcatttgattcggaaaccgcagaagaacatatgtgtctttcttgcccctactgtggctttagtccatcagcaagcaaaggttatagcagactctactaattttaaggttgggacatactgtggaagttccaagcgcttgaaacgtcatcaagactgggagcaggagattggacaatatgaggttcttgttatgaccccacaaatattacttcataacttatctcattgcttcatcacaatggagatgattgcacttttgatatttgatgaatgccatcatgctcaagtcaaaagcaaccatgcttatgcagttatcatgaaagtcttctacaaaagtaattcctcaaaggttccccgtatatttggcatgactgcttcccctgttgtaggaaaaggtgcttctagtgaagcaaatctagcaaaaagcatcaatagtcttgaacatatacttgatgctaaggtatactctgttgaagacaaggaattgcaatcttttgtgaccactcctgtgattaatatatatcattatgtttcaactgcaagtggggaaactagcttgtacctgaaaattgaggagattaaacgccagtgcatagcaaaccttggtaggagtatagaagatcaccagaaaaggatgaatgcaaagaaacttctgaaccggatgcatgataatgtgattttcggtctgcagaatcttggcatttggggagcattgcaagctagtcatattcttctgagtggtgatcgttctgagaggcatgagttagtggaggctgaaggaaattcaagtgatgactctctgtgtgataaatatcttgctcaggctgctgaactgtttacttcacaatgcatgataggcgacagggtaactgatttatcttctgtggaaatattaaaagagccatttttctcagcaaagcttttacgactcattgggatattatccaactttaggttgcaaaagaacatgaaatgtataatttttgtgaatagaattgtgacagcaagatccctgtcatacattctacagaagctcaagcttctaagacaatggaggagtgatttcctagtaggagtccatgctggactgaagagtatgtcacgaaagaccatgaacatcattgttgataagtttcgctctggagagttgaatctactggttgcaaccaaagtgggtgaagaaggacttgacattcagacgtgttgcctcgtcatacgatttgatcttccagaaactgttgccagctttatacagtcaagaggtcgtgcacgtatgcctcagtcagaatatgcatttttggtggacagtggcaataagaaggaacttgacataattgatggctttgagaaagatgaataccgaatgaatatggaaattacttttcgaacatccaaggagacatacataatccctgaggaaagaatattcagagttgattcgtctggtgcttctgttagttctggatatagtatctcattgcttcaccagtattgttcaaagcttccacatgatgagtactttgaccccaagccatgtttttattacttagatgattcaggggggatttcctgccatataacattgccttccaatgcaccaataaaccaaattttaggtacaccacagttgtctatggaggcttccaaaagagatgcttgcctgaaagcaatagaagaactgtataatttaggcactttaagtgattgtctcttgccaaaacaagatgatgcagagccagaggcgcaggtttcaggctcttctgatgaagatgaatgtgaagatgccatatcaagaggagaattacatgagatgctagttccttctgcctttggacagtcatggataaatgaggataacatcgtccgtctcaactcttactacataaaattttgtccctatccagaggatagggtctacaaagagtttggtcttttcatcatggttcggcttccaatggaggctgagaaattggaacttgatctccatcttgctcatggtcgatctgtgatgacaaaatttgtcccatttggagttgtagaatttgacaaagatgagattaagatggcagagaattttcaagaaatgttcctcaaaattattcttgatagattagaattcgtttctgagtttgtagacttgggtatgggtgctgaatctcacacaggcacatcaaccttctaccttttgcttccagttgtattgcaagaatatggaaatgccatgaaagtagactggaagactgtgaagagatgcctttgttcaccaattttcaggcatccagctgatactatggataaaaaagttttccctttagatattcacctgcaacttgccaatggttacagaagtgtaagagatgtcgagaatagtttagtgtatgccccacataagaagaacttttattttgtcacgaatgttaactaccaaaagaatggatatagtcctcataatgattcaggcacttcaagctatgtggattacttcattgaaaagttttccattcacctcaaatgtccagaacaaccacttctacatgttaaaccagtctccaatttgcacaacctgctacacaaccgaaagcatgaggatgcagaaccacaggagctggacgaatacttaatttatttgcctcctgagctttgtgaactaaaaataataggtttttcgaaggatattggcagttccatatctttgctaccttcaattatgcaccgtcttggaaacttgctggtggctattgaactaaagcacaggctatcttcttcctttccagaggcagctgaaattagtgcccttagagttttagaagctctcactactgagaagtgtcaggagcgcttttcccttgaaagacttgaagtgcttggtgatgcttttcttaaatttgctgttgcacgtcatttttttctcatgcatgacagccttcatgaaggagaccttacaaaaaggcgctccaacgctgtgaataattccaatctgtttaagttggctatcaagcgcaatttgcaggtctatatatgcgatcagacatttgatcccactcagttttatgcattaggccgtccttgcccaagactttgtagcaatgaaaccaaagaaagcatacacttctgtttaaattctgttaaggaacaaggaaaagtaactgaaacccaatgtaacaaaaatcatcattggttacataggaaaacaattgctgatgtggttgaagctctggttggagcatttctagttgacagtggctttaaagctgcaattgcttttctttcatggattggcattcaagttgattttgaagcttcacaagtggttgatatttgcatagcaagtgctagttatttacctctttcttctgaagtagacattccttctcttgaaggtaagctaggacatcacttttttcataagggcctgcttctccaggcatttgtacatccttcttacaataagcttggaggaggctgttatcagcgattggagtttcttggagatgctgtcttggattatttgattacttcatatgtattctcagcttatcccaaactaaagcctggtcaattgacagatttgagatcattgtctgttaacaacaaggcatttgcttgtctagcggtagatcgcagttttgataaatttcttttatgtgattcaagtggcctgtctgaggcaataaaaaagtatgttgactacattagaagacctgtatcagataacagcattaaagaagggccaaaatgtcccaaggcactgggtgacttagtggaatcttgtgttggtgccatccttcttgattcagggttcaatttgaacaaagtttggaagattatgacttcgttcttggactcaatcatgaaattctcatcaagcttgcagctcagtcctgttagggatttgcgagaactttgccaatctcataatatggagttggagtttctgccagtgccctcaaaattgactaaaaggttttcagttgaagctaaagtgagtgggaatggtgtatgtgaaacagcttcagcaactggtcaaaataaaaaagaggcttgcagaattgcttcactgctacttttttcaaagttcaaggctcaaggctggaaagcaaagtcaaaaactttggaagaagttctggaatcaacttctaaaatggaaccaaaacttattggctatgatgagactcccattgatgtaacagataccaataaacacatagtggttaatgcagacccatacaacaagtctaacccagaaattcgccctatgcaagagacagatgaaatatgctctccatgtgtgaaacctttcggccaacggcttcaatcttctgctaagggaaagcttagtcaaatatttgaaaatcgtgattgcagcagtgacttgtcagggacaggaacggcaagatcacgattgtatgaattatgtgcttcttattgttggaaacctccttcatttgaatgctgcaaggcagagggacctgaccacctgaaacaattcacttgcaaggtgaccttagagatagaagaggcccagaatttgattttagagtttgttggggaacctctttcaaagaagaaagatgcagcagagagtgcggcagagggtgcattttggtatctacaacatgaaggttacttgcctagtagtggtaattgacatattgtagaacaattatcatgtcacataaatcccaaggcaattggtgtaggcaatgtcttgattattgagggtgtcgaatgtgttgttataggtaatcatataatctagaaggcaataatagtacaggtttagtaactcagggccagggagggttccctaatggtaaatctattgtaaaggtattattcatgtatgtattattgtagtgtcaaagttacatctaacattgtatgtaaaccatccctcgattataacagtgaattttctatttactacgtttgaaatgtaaatataagctcgcgagacatttgaccattatta

SEQ ID NO: 162 - DNA, 5599 bp, Glycine max
tctaaaaagccattttgtttggaaaatactagtaacaaaaaacgacatgggggagtgttgggaatgaagtgatgcgaaaacgtgcgtggaaacaaaacaaagaacaaagactttcagtcattcagtctttagtgagcgtgttcactaaggtaactcttcactctcttctccgttgactccataatcaacgttttggttgggaacagaagtgaatgaagtgactacaaacaaagctctctctctgttattattattattattcattttctcttttcacactcctttgtcctttgaacccacccgtgaactctccaaccgtcgtcgttttgatttcacccactctcatacctccaaactctcttttcctcggctaatgccggacggagaatcctctgccgtcgccggcggccaagtttccatggaaccctctttaagcctctccgatcaactacagtccctgagtctttcccaagtaaaaaatcatgatgactcggtcaagaaagatccccggaagattgcaagaaggtatcagttggagttgtgcaaaaaagctatggaggaaaatataattgtgtatttagggacagggtgtgggaagacccacattgctgtgcttcttatgcatgagatgggtgatttgattcggaaaccacagaagaacatatgtgtctttcttgctcccactgtggctttagtccatcagcaagcaaaggttatagcagactctactgattttaaggttgggacatactgtggaagttccaagcgcttgaaacatcatcaagactgggagcaggagatgggacaatatgaggttcttgttatgaccccacaaatattacatcataacttatcccattgcttcatcacaatggagatgattgcacttttgatatttgacgaatgtcatcatgctcaagtcaaaagcaaccatgcttatgcagtaatcatgaaagtcttctacaaaagtaattccacaaaggttccccgtatatttggcatgactgcttcccctgttgtaggaaaaggtgcttctagtgaagcaaatttagcaaaaagcatcaacagtcttgaacatatacttgatgccaaggtatactctgttgaagacaaggaattgcaatcttttgtgaccactcctgtgattaatatatatcattatgtttcaactgcaagtggggaaactagcttgcacttgaaaattgaggagattaaacgccagtgcatagcaacccttggtaggagtatagaagatcaccagaaacggatgaatacaaagaaacttctgaaccggatgcatgataatgtgattttcggtctgcagaatcttggcatttggggagcattgcaagctagtcatattcttctgagtggtgatcattctgagaggcatgaattagtggaggcagatggaaattcaagtgatgactctctgtgtgataaatatcttgctcaggctgctgaactatttacttcacaatgcatgataggcgacagggtaactgatttatcttctgtggaaatattaaaagagccatttttctcagcaaagcttttacgactcattgggatactatccaactttaggttgcaaaagaacatgaaatgtataatttttgtgaatagaattgtgacagcaagatccctgtcatacatactacagaagctcaagcttctaagacaatggaggagtgattttctagtaggagtccatgctggactgaagagtatgtcacgaaagaccatgaacatcattgttgataaatttcgttctggagagttgaatctactggttgcaaccaaagtgggtgaagaaggacttgacattcagacatgttgtctcgtcatacgatttgatcttccagaaactgttgccagcttcatacagtcaagaggtcgtgcacgtatgcctcagtcagaatatgcatttttggtggacagtggcaataagaaggaaattgacgtaattgatggtttcaaggaagatgaataccgaatgaatatggaagttacttttcgaacatccaaggagacatacatcatccctgaggaaagaatattcagaattgattcgtctggtgcttctgttagttctggatatagtatctcattgcttcaccaatattgttcaaagcttccacacgatgagtactttgaccccaagccaagttttcattacttagatgattcagggggaatttcctgccacataacattgccttccaatgcaccaataaaccaaattttgggtacaccacagttatctatggaggcttccaaaagagaagcttgcctgaaagcaatagaagaactgtataatttgggcgctttaagtgattgtctcttgccaaaacaagatgatgcagagcctgaggtgcaggtttcaggctcttctgatgaagatgaatgtgaagatgccatatcaagaggaaaattacatgagatgctagttccttctgcctttggacagtcatggataaatgaggataacattgtccgtctcaactcttactacataaaattttgtccctatccagaggacagggtctacaaagagtttggtctattcatgatgacctgtcttccgatggaggctgagaaattggaacttgatctccatcttgctcatggtcgatctgtgatgacaatgtttgtcccatttggagttgtagaatttaacaaagatgagattaagatggcagagaattttcaagaaatgttcctcaaaattattcttgatagattagaattcatttccgagtttgtagacttgggtatgagtgctgaatctcactcaggcacatcaaccttctaccttttgcttccagttgtattgcaagaatatggaaatgccatggaagtagattggaagatagtgaagagatgcctttgttcaccaattttcaggcatccagctgatactatggataaaaaagttttccctttagatattcacctgcaacttgccaatggttacagaagtgtaagaaatgtcgagaatagtttagtgtatgccccacataagaagaacttttattttgtcacgaatgttaactatgaaaagaatggatatagtcctcataatgattcaggcacttcaagctatgtggattacttcattgaaaagttttccattcacctcaaatgtccgaagcaaccacttctgcatgtgaaaccggtctccaatttgcacaacctgttacacaacagaaagcgtgaggatgcagaaccacaggagctggacgaatacttaatttatttgcctcctgagctttgtgaactaaaagtaataggtttttcgaaggatattggcagttccatatctttgctgccctcaattatgcatcgtcttggaaacttgctggtggctattgaactaaagcacatgctatcttcttcctttccagaagcagctgaaattagtgccattagagttttagaggctctcaccactgagaagtgtcaggagcgcttttcccttgaaagacttgaagtgcttggtgatgctttccttaaatttgctgttgcacgtcatttttttctcatgcatgacagccttcatgaaggagaccttacaaaaaggcgttccaatgctgtaaataattccaatttgtttaagttggctattaagcgcaatttgcaggtctatatatgcgatcagacatttgatcccactcagttttatgcattgggccgtccttgcccaagagtttgtagcaatgaaaccgaagaaagcatacacttttgtttaaattctgttatgcaacaaggaaaagcaactgaaacccgatgtagcaaaaatcatcattggttacataggaaaacaattgctgatgtggttgaagctctggttggagcattcctagttgacagtggctttaaagctgcaattgcctttctttcatggattggcatacaagttgattttgaagcttcacaagtggttgatatctgcatagcaagtgctagctattcccctctttcttctgaagtagacattccttctcttgaaggtaagctaggacatcacttttttcataaaggcctgcttctccaggcatttgtacatccttcttacaataagcttggaggaggctgttatcagcgattggagtttcttggagatgctgtcttggattatttgattacttcatatctattctcagcttatcccaaactaaagcctggtcaattgacagatttgagatcattgtctgttaacaacaaggcatttgcttgtctagcggtagatcgcagttttgataattttcttttatgtgattcaagtggcctgtctgaggcaataaaaaagtatgtggactatgttagaagacctgtgtcagataatggcattaaagaagggccaaaatgtcccaaggcactgggtgacttagtggaatcttgtgttggtgccatccttcttgattcagggttcaatttgaacaaagtttggaagattatgacttcattcttggacccaatcatgaaattctcatcaagcttgcagctcagtcctgttagggatttgcgagaactttgccaatctcataatttggagttggagtttctgccagtgccctcaaaattgactaaaaggttttcagttgaagctaaagtgagtgggaatggtgtatgtgaaacagcttcagcaactggccaaaataaaaaagaggcttgcagaattgcttcacagctactttttttaaagttcaaggctcaaggttggaaagctaagtcaaaaaccctggaagaagttctggaatcaacttctaaaatggaaccaaaacttattggctatgatgaaactcccattgatgtaacagataccaatactgccaagcacatagtggttaatgctgacccgtacaacaactctaacccagaaatttgccctatgcaactgacagatgaaatatgctctccatgtgtgaaacctttcggccaacggcttcaatcttctgctaagggaaagcttagtcaaatatttgaaaatcgtgattgtggcagtgactcgtctgggacaggaacagcaagatcacgattgtatgaattatgtgctgcgtattgctggaaacctccttcatttgaatgctgcaagaaagagggaccagaccacctgaaacaatttacttgcaaggtgaccttagagatagaagaggcccagaatttgattttagagtttgttggggaacctctgtcaaagaagaaagatgcagcagagagtgcggcagagggtgcattatggtatctacaacatgaaggtttcttgcctagtattggtaattgacatattgcacaacaattatcatgtcacataaatctgaggcaatgtcttagggtgtcatttgaaatttctggatgcaccctcattgttattgataatcatataaatctagaagacaataatagataatacaggtttagtaacccagggccagagggttccctaatggtaatctattgtaaagcattatttatgtatgtattattgtagtgtcaaagttacatttatttgtaatgaccctcgattgtaacagtgaattttctatttactacgtttgaaatataaatataagctcccgaaacatttgaatggtaa

SEQ ID NO: 163 - DNA, 5593 bp, Glycine max
tctaaaaagccattttgtttggaaaatactagtaacaaaaaacgacatgggggagtgttgggaatgaagtgatgcgaaaacgtgcgtggaaacaaaacaaagaacaaagactttcagtcattcagtctttagtgagcgtgttcactaaggtaactcttcactctcttctccgttgactccataatcaacgttttggttgggaacagaagtgaatgaagtgactacaaacaaagctctctctctgttattattattattattcattttctcttttcacactcctttgtcctttgaacccacccgtgaactctccaaccgtcgtcgttttgatttcacccactctcatacctccaaactctcttttcctcggctaatgccggacggagaatcctctgccgtcgccggcggccaagtttccatggaaccctctttaagcctctccgatcaactacagtccctgagtctttcccaagtaaaaaatcatgatgactcggtcaagaaagatccccggaagattgcaagaaggtatcagttggagttgtgcaaaaaagctatggaggaaaatataattgtgtatttagggacagggtgtgggaagacccacattgctgtgcttcttatgcatgagatgggtgatttgattcggaaaccacagaagaacatatgtgtctttcttgctcccactgtggctttagtccatcagcaagcaaaggttatagcagactctactgattttaaggttgggacatactgtggaagttccaagcgcttgaaacatcatcaagactgggagcaggagatgggacaatatgaggttcttgttatgaccccacaaatattacatcataacttatcccattgcttcatcacaatggagatgattgcacttttgatatttgacgaatgtcatcatgctcaagtcaaaagcaaccatgcttatgcagtaatcatgaaagtcttctacaaaagtaattccacaaaggttccccgtatatttggcatgactgcttcccctgttgtaggaaaaggtgcttctagtgaagcaaatttagcaaaaagcatcaacagtcttgaacatatacttgatgccaaggtatactctgttgaagacaaggaattgcaatcttttgtgaccactcctgtgattaatatatatcattatgtttcaactgcaagtggggaaactagcttgcacttgaaaattgaggagattaaacgccagtgcatagcaacccttggtaggagtatagaagatcaccagaaacggatgaatacaaagaaacttctgaaccggatgcatgataatgtgattttcggtctgcagaatcttggcatttggggagcattgcaagctagtcatattcttctgagtggtgatcattctgagaggcatgaattagtggaggcagatggaaattcaagtgatgactctctgtgtgataaatatcttgctcaggctgctgaactatttacttcacaatgcatgataggcgacagggtaactgatttatcttctgtggaaatattaaaagagccatttttctcagcaaagcttttacgactcattgggatactatccaactttaggttgcaaaagaacatgaaatgtataatttttgtgaatagaattgtgacagcaagatccctgtcatacatactacagaagctcaagcttctaagacaatggaggagtgattttctagtaggagtccatgctggactgaagagtatgtcacgaaagaccatgaacatcattgttgataaatttcgttctggagagttgaatctactggttgcaaccaaagtgggtgaagaaggacttgacattcagacatgttgtctcgtcatacgatttgatcttccagaaactgttgccagcttcatacagtcaagaggtcgtgcacgtatgcctcagtcagaatatgcatttttggtggacagtggcaataagaaggaaattgacgtaattgatggtttcaaggaagatgaataccgaatgaatatggaagttacttttcgaacatccaaggagacatacatcatccctgaggaaagaatattcagaattgattcgtctggtgcttctgttagttctggatatagtatctcattgcttcaccaatattgttcaaagcttccacacgatgagtactttgaccccaagccaagttttcattacttagatgattcagggggaatttcctgccacataacattgccttccaatgcaccaataaaccaaattttgggtacaccacagttatctatggaggcttccaaaagagaagcttgcctgaaagcaatagaagaactgtataatttgggcgctttaagtgattgtctcttgccaaaacaagatgatgcagagcctgaggtgcaggtttcaggctcttctgatgaagatgaatgtgaagatgccatatcaagaggaaaattacatgagatgctagttccttctgcctttggacagtcatggataaatgaggataacattgtccgtctcaactcttactacataaaattttgtccctatccagaggacagggtctacaaagagtttggtctattcatgatgacctgtcttccgatggaggctgagaaattggaacttgatctccatcttgctcatggtcgatctgtgatgacaatgtttgtcccatttggagttgtagaatttaacaaagatgagattaagatggcagagaattttcaagaaatgttcctcaaaattattcttgatagattagaattcatttccgagtttgtagacttgggtatgagtgctgaatctcactcaggcacatcaaccttctaccttttgcttccagttgtattgcaagaatatggaaatgccatggaagtagattggaagatagtgaagagatgcctttgttcaccaattttcaggcatccagctgatactatggataaaaaagttttccctttagatattcacctgcaacttgccaatggttacagaagtgtaagaaatgtcgagaatagtttagtgtatgccccacataagaagaacttttattttgtcacgaatgttaactatgaaaagaatggatatagtcctcataatgattcaggcacttcaagctatgtggattacttcattgaaaagttttccattcacctcaaatgtccgaagcaaccacttctgcatgtgaaaccggtctccaatttgcacaacctgttacacaacagaaagcgtgaggatgcagaaccacaggagctggacgaatacttaatttatttgcctcctgagctttgtgaactaaaagtaataggtttttcgaaggatattggcagttccatatctttgctgccctcaattatgcatcgtcttggaaacttgctggtggctattgaactaaagcacatgctatcttcttcctttccagaagcagctgaaattagtgccattagagttttagaggctctcaccactgagaagtgtcaggagcgcttttcccttgaaagacttgaagtgcttggtgatgctttccttaaatttgctgttgcacgtcatttttttctcatgcatgacagccttcatgaaggagaccttacaaaaaggcgttccaatgctgtaaataattccaatttgtttaagttggctattaagcgcaatttgcaggtctatatatgcgatcagacatttgatcccactcagttttatgcattgggccgtccttgcccaagagtttgtagcaatgaaaccgaagaaagcatacacttttgtttaaattctgttatgcaacaaggaaaagcaactgaaacccgatgtagcaaaaatcatcattggttacataggaaaacaattgctgatgtggttgaagctctggttggagcattcctagttgacagtggctttaaagctgcaattgcctttctttcatggattggcatacaagttgattttgaagcttcacaagtggttgatatctgcatagcaagtgctagctattcccctctttcttctgaagtagacattccttctcttgaaggtaagctaggacatcacttttttcataaaggcctgcttctccaggcatttgtacatccttcttacaataagcttggaggaggctgttatcagcgattggagtttcttggagatgctgtcttggattatttgattacttcatatctattctcagcttatcccaaactaaagcctggtcaattgacagatttgagatcattgtctgttaacaacaaggcatttgcttgtctagcggtagatcgcagttttgataattttcttttatgtgattcaagtggcctgtctgaggcaataaaaaagtatgtggactatgttagaagacctgtgtcagataatggcattaaagaagggccaaaatgtcccaaggcactgggtgacttagtggaatcttgtgttggtgccatccttcttgattcagggttcaatttgaacaaagtttggaagattatgacttcattcttggacccaatcatgaaattctcatcaagcttgcagctcagtcctgttagggatttgcgagaactttgccaatctcataatttggagttggagtttctgccagtgccctcaaaattgactaaaaggttttcagttgaagctaaagtgagtgggaatggtgtatgtgaaacagcttcagcaactggccaaaataaaaaagaggcttgcagaattgcttcacagctactttttttaaagttcaaggctcaaggttggaaagctaagtcaaaaaccctggaagaagttctggaatcaacttctaaaatggaaccaaaacttattggctatgatgaaactcccattgatgtaacagataccaatactgccaagcacatagtggttaatgctgacccgtacaacaactctaacccagaaatttgccctatgcaactgacagatgaaatatgctctccatgtgtgaaacctttcggccaacggcttcaatcttctgctaagggaaagcttagtcaaatatttgaaaatcgtgattgtggcagtgactcgtctgggacagcaagatcacgattgtatgaattatgtgctgcgtattgctggaaacctccttcatttgaatgctgcaagaaagagggaccagaccacctgaaacaatttacttgcaaggtgaccttagagatagaagaggcccagaatttgattttagagtttgttggggaacctctgtcaaagaagaaagatgcagcagagagtgcggcagagggtgcattatggtatctacaacatgaaggtttcttgcctagtattggtaattgacatattgcacaacaattatcatgtcacataaatctgaggcaatgtcttagggtgtcatttgaaatttctggatgcaccctcattgttattgataatcatataaatctagaagacaataatagataatacaggtttagtaacccagggccagagggttccctaatggtaatctattgtaaagcattatttatgtatgtattattgtagtgtcaaagttacatttatttgtaatgaccctcgattgtaacagtgaattttctatttactacgtttgaaatataaatataagctcccgaaacatttgaatggtaa

SEQ ID NO: 164 - DNA, 5560 bp, Glycine max
gtggaaacaaaacaaagaacaaagactttcagtcattcagtctttagtgagcgtgttcactaaggtaactcttcactctcttctccgttgactccataatcaacgttttggttgggaacagaagtgaatgaagtgactacaaacaaagctctctctctgttattattattattattcattttctcttttcacactcctttgtcctttgaacccacccgtgaactctccaaccgtcgtcgttttgatttcacccactctcatacctccaaactctcttttcctcggctaatgccggacggagaatcctctgccgtcgccggcggccaagtttccatggaaccctctttaagcctctccgatcaactacagtccctgagtctttcccaagtaaaaaatcatgatgactcggtcaagaaagatccccggaagattgcaagaaggtatcagttggagttgtgcaaaaaagctatggaggaaaatataattgtgtatttagggacagggtgtgggaagacccacattgctgtgcttcttatgcatgagatgggtgatttgattcggaaaccacagaagaacatatgtgtctttcttgctcccactgtggctttagtccatcagcaagcaaaggttatagcagactctactgattttaaggttgggacatactgtggaagttccaagcgcttgaaacatcatcaagactgggagcaggagatgggacaatatgaggttcttgttatgaccccacaaatattacatcataacttatcccattgcttcatcacaatggagatgattgcacttttgatatttgacgaatgtcatcatgctcaagtcaaaagcaaccatgcttatgcagtaatcatgaaagtcttctacaaaagtaattccacaaaggttccccgtatatttggcatgactgcttcccctgttgtaggaaaaggtgcttctagtgaagcaaatttagcaaaaagcatcaacagtcttgaacatatacttgatgccaaggtatactctgttgaagacaaggaattgcaatcttttgtgaccactcctgtgattaatatatatcattatgtttcaactgcaagtggggaaactagcttgcacttgaaaattgaggagattaaacgccagtgcatagcaacccttggtaggagtatagaagatcaccagaaacggatgaatacaaagaaacttctgaaccggatgcatgataatgtgattttcggtctgcagaatcttggcatttggggagcattgcaagctagtcatattcttctgagtggtgatcattctgagaggcatgaattagtggaggcagatggaaattcaagtgatgactctctgtgtgataaatatcttgctcaggctgctgaactatttacttcacaatgcatgataggcgacagggtaactgatttatcttctgtggaaatattaaaagagccatttttctcagcaaagcttttacgactcattgggatactatccaactttaggttgcaaaagaacatgaaatgtataatttttgtgaatagaattgtgacagcaagatccctgtcatacatactacagaagctcaagcttctaagacaatggaggagtgattttctagtaggagtccatgctggactgaagagtatgtcacgaaagaccatgaacatcattgttgataaatttcgttctggagagttgaatctactggttgcaaccaaagtgggtgaagaaggacttgacattcagacatgttgtctcgtcatacgatttgatcttccagaaactgttgccagcttcatacagtcaagaggtcgtgcacgtatgcctcagtcagaatatgcatttttggtggacagtggcaataagaaggaaattgacgtaattgatggtttcaaggaagatgaataccgaatgaatatggaagttacttttcgaacatccaaggagacatacatcatccctgaggaaagaatattcagaattgattcgtctggtgcttctgttagttctggatatagtatctcattgcttcaccaatattgttcaaagcttccacacgatgagtactttgaccccaagccaagttttcattacttagatgattcagggggaatttcctgccacataacattgccttccaatgcaccaataaaccaaattttgggtacaccacagttatctatggaggcttccaaaagagaagcttgcctgaaagcaatagaagaactgtataatttgggcgctttaagtgattgtctcttgccaaaacaagatgatgcagagcctgaggtgcaggtttcaggctcttctgatgaagatgaatgtgaagatgccatatcaagaggaaaattacatgagatgctagttccttctgcctttggacagtcatggataaatgaggataacattgtccgtctcaactcttactacataaaattttgtccctatccagaggacagggtctacaaagagtttggtctattcatgatgacctgtcttccgatggaggctgagaaattggaacttgatctccatcttgctcatggtcgatctgtgatgacaatgtttgtcccatttggagttgtagaatttaacaaagatgagattaagatggcagagaattttcaagaaatgttcctcaaaattattcttgatagattagaattcatttccgagtttgtagacttgggtatgagtgctgaatctcactcaggcacatcaaccttctaccttttgcttccagttgtattgcaagaatatggaaatgccatggaagtagattggaagatagtgaagagatgcctttgttcaccaattttcaggcatccagctgatactatggataaaaaagttttccctttagatattcacctgcaacttgccaatggttacagaagtgtaagaaatgtcgagaatagtttagtgtatgccccacataagaagaacttttattttgtcacgaatgttaactatgaaaagaatggatatagtcctcataatgattcaggcacttcaagctatgtggattacttcattgaaaagttttccattcacctcaaatgtccgaagcaaccacttctgcatgtgaaaccggtctccaatttgcacaacctgttacacaacagaaagcgtgaggatgcagaaccacaggagctggacgaatacttaatttatttgcctcctgagctttgtgaactaaaagtaataggtttttcgaaggatattggcagttccatatctttgctgccctcaattatgcatcgtcttggaaacttgctggtggctattgaactaaagcacatgctatcttcttcctttccagaagcagctgaaattagtgccattagagttttagaggctctcaccactgagaagtgtcaggagcgcttttcccttgaaagacttgaagtgcttggtgatgctttccttaaatttgctgttgcacgtcatttttttctcatgcatgacagccttcatgaaggagaccttacaaaaaggcgttccaatgctgtaaataattccaatttgtttaagttggctattaagcgcaatttgcaggtctatatatgcgatcagacatttgatcccactcagttttatgcattgggccgtccttgcccaagagtttgtagcaatgaaaccgaagaaagcatacacttttgtttaaattctgttatgcaacaaggaaaagcaactgaaacccgatgtagcaaaaatcatcattggttacataggaaaacaattgctgatgtggttgaagctctggttggagcattcctagttgacagtggctttaaagctgcaattgcctttctttcatggattggcatacaagttgattttgaagcttcacaagtggttgatatctgcatagcaagtgctagctattcccctctttcttctgaagtagacattccttctcttgaaggtaagctaggacatcacttttttcataaaggcctgcttctccaggcatttgtacatccttcttacaataagcttggaggaggctgttatcagcgattggagtttcttggagatgctgtcttggattatttgattacttcatatctattctcagcttatcccaaactaaagcctggtcaattgacagatttgagatcattgtctgttaacaacaaggcatttgcttgtctagcggtagatcgcagttttgataattttcttttatgtgattcaagtggcctgtctgaggcaataaaaaagtatgtggactatgttagaagacctgtgtcagataatggcattaaagaagggccaaaatgtcccaaggcactgggtgacttagtggaatcttgtgttggtgccatccttcttgattcagggttcaatttgaacaaagtttggaagattatgacttcattcttggacccaatcatgaaattctcatcaagcttgcagctcagtcctgttagggatttgcgagaactttgccaatctcataatttggagttggagtttctgccagtgccctcaaaattgactaaaaggttttcagttgaagctaaagtgagtgggaatggtgtatgtgaaacagcttcagcaactggccaaaataaaaaagaggcttgcagaattgcttcacagctactttttttaaagttcaaggctcaaggttggaaagctaagtcaaaaaccctggaagaagttctggaatcaacttctaaaatggaaccaaaacttattggctatgatgaaactcccattgatgtaacagataccaatactgccaagcacatagtggttaatgctgacccgtacaacaactctaacccagaaatttgccctatgcaactgacagatgaaatatgctctccatgtgtgaaacctttcggccaacggcttcaatcttctgctaagggaaagcttagtcaaatatttgaaaatcgtgattgtggcagtgactcgtctgggacaggaacagcaagatcacgattgtatgaattatgtgctgcgtattgctggaaacctccttcatttgaatgctgcaagaaagagggaccagaccacctgaaacaggtacatagaactttcacttgcatttgtttattgttccatttttagatttacttgcaaggtgaccttagagatagaagaggcccagaatttgattttagagtttgttggggaacctctgtcaaagaagaaagatgcagcagagagtgcggcagagggtgcattatggtatctacaacatgaaggtttcttgcctagtattggtaattgacatattgcacaacaattatcatgtcacataaatctgaggcaatgtcttagggtgtcatttgaaatttctggatgcaccctcattgttattgataatcatataaatctagaagacaataatagataatacaggtttagtaacccagggccagagggttccctaatggtaatctattgtaaagcattatttatgtatgtattattgtagtgtcaaagttacatttatttgtaatgaccctcgattgtaacagtgaattttctatttactacgtttgaaatataaatataagctcccgaaacatttgaatggtaa

SEQ ID NO: 165 - DNA, 5375 bp, Glycine max
gtggaaacaaaacaaagaacaaagactttcagtcattcagtctttagtgagcgtgttcactaaggtaactcttcactctcttctccgttgactccataatcaacgttttggttgggaacagaagtgaatgaagtgactacaaacaaagctctctctctgttattattattattattcattttctcttttcacactcctttgtcctttgaacccacccgtgaactctccaaccgtcgtcgttttgatttcacccactctcatacctccaaactctcttttcctcggctaatgccggacggagaatcctctgccgtcgccggcggccaagtttccatggaaccctctttaagcctctccgatcaactacagtccctgagtctttcccaagtaaaaaatcatgatgactcggtcaagaaagatccccggaagattgcaagaaggtatcagttggagttgtgcaaaaaagctatggaggaaaatataattgtgtatttagggacagggtgtgggaagacccacattgctgtgcttcttatgcatgagatgggtgatttgattcggaaaccacagaagaacatatgtgtctttcttgctcccactgtggctttagtccatcagcaagcaaaggttatagcagactctactgattttaaggttgggacatactgtggaagttccaagcgcttgaaacatcatcaagactgggagcaggagatgggacaatatgaggttcttgttatgaccccacaaatattacatcataacttatcccattgcttcatcacaatggagatgattgcacttttgatatttgacgaatgtcatcatgctcaagtcaaaagcaaccatgcttatgcagtaatcatgaaagtcttctacaaaagtaattccacaaaggttccccgtatatttggcatgactgcttcccctgttgtaggaaaaggtgcttctagtgaagcaaatttagcaaaaagcatcaacagtcttgaacatatacttgatgccaaggtatactctgttgaagacaaggaattgcaatcttttgtgaccactcctgtgattaatatatatcattatgtttcaactgcaagtggggaaactagcttgcacttgaaaattgaggagattaaacgccagtgcatagcaacccttggtaggagtatagaagatcaccagaaacggatgaatacaaagaaacttctgaaccggatgcatgataatgtgattttcggtctgcagaatcttggcatttggggagcattgcaagctagtcatattcttctgagtggtgatcattctgagaggcatgaattagtggaggcagatggaaattcaagtgatgactctctgtgtgataaatatcttgctcaggctgctgaactatttacttcacaatgcatgataggcgacagggtaactgatttatcttctgtggaaatattaaaagagccatttttctcagcaaagcttttacgactcattgggatactatccaactttaggttgcaaaagaacatgaaatgtataatttttgtgaatagaattgtgacagcaagatccctgtcatacatactacagaagctcaagcttctaagacaatggaggagtgattttctagtaggagtccatgctggactgaagagtatgtcacgaaagaccatgaacatcattgttgataaatttcgttctggagagttgaatctactggttgcaaccaaagtgggtgaagaaggacttgacattcagacatgttgtctcgtcatacgatttgatcttccagaaactgttgccagcttcatacagtcaagaggtcgtgcacgtatgcctcagtcagaatatgcatttttggtggacagtggcaataagaaggaaattgacgtaattgatggtttcaaggaagatgaataccgaatgaatatggaagttacttttcgaacatccaaggagacatacatcatccctgaggaaagaatattcagaattgattcgtctggtgcttctgttagttctggatatagtatctcattgcttcaccaatattgttcaaagcttccacacgatgagtactttgaccccaagccaagttttcattacttagatgattcagggggaatttcctgccacataacattgccttccaatgcaccaataaaccaaattttgggtacaccacagttatctatggaggcttccaaaagagaagcttgcctgaaagcaatagaagaactgtataatttgggcgctttaagtgattgtctcttgccaaaacaagatgatgcagagcctgaggtgcaggtttcaggctcttctgatgaagatgaatgtgaagatgccatatcaagaggaaaattacatgagatgctagttccttctgcctttggacagtcatggataaatgaggataacattgtccgtctcaactcttactacataaaattttgtccctatccagaggacagggtctacaaagagtttggtctattcatgatgacctgtcttccgatggaggctgagaaattggaacttgatctccatcttgctcatggtcgatctgtgatgacaatgtttgtcccatttggagttgtagaatttaacaaagatgagattaagatggcagagaattttcaagaaatgttcctcaaaattattcttgatagattagaattcatttccgagtttgtagacttgggtatgagtgctgaatctcactcaggcacatcaaccttctaccttttgcttccagttgtattgcaagaatatggaaatgccatggaagtagattggaagatagtgaagagatgcctttgttcaccaattttcaggcatccagctgatactatggataaaaaagttttccctttagatattcacctgcaacttgccaatggttacagaagtgtaagaaatgtcgagaatagtttagtgtatgccccacataagaagaacttttattttgtcacgaatgttaactatgaaaagaatggatatagtcctcataatgattcaggcacttcaagctatgtggattacttcattgaaaagttttccattcacctcaaatgtccgaagcaaccacttctgcatgtgaaaccggtctccaatttgcacaacctgttacacaacagaaagcgtgaggatgcagaaccacaggagctggacgaatacttaatttatttgcctcctgagctttgtgaactaaaagtaataggtttttcgaaggatattggcagttccatatctttgctgccctcaattatgcatcgtcttggaaacttgctggtggctattgaactaaagcacatgctatcttcttcctttccagaagcagctgaaattagtgccattagagttttagaggctctcaccactgagaagtgtcaggagcgcttttcccttgaaagacttgaagtgcttggtgatgctttccttaaatttgctgttgcacgtcatttttttctcatgcatgacagccttcatgaaggagaccttacaaaaaggcgttccaatgctgtaaataattccaatttgtttaagttggctattaagcgcaatttgcaggtctatatatgcgatcagacatttgatcccactcagttttatgcattgggccgtccttgcccaagagtttgtagcaatgaaaccgaagaaagcatacacttttgtttaaattctgttatgcaacaaggaaaagcaactgaaacccgatgtagcaaaaatcatcattggttacataggaaaacaattgctgatgtggttgaagctctggttggagcattcctagttgacagtggctttaaagctgcaattgcctttctttcatggattggcatacaagttgattttgaagcttcacaagtggttgatatctgcatagcaagtgctagctattcccctctttcttctgaagtagacattccttctcttgaaggtaagctaggacatcacttttttcataaaggcctgcttctccaggcatttgtacatccttcttacaataagcttggaggaggctgttatcagcgattggagtttcttggagatgctgtcttggattatttgattacttcatatctattctcagcttatcccaaactaaagcctggtcaattgacagatttgagatcattgtctgttaacaacaaggcatttgcttgtctagcggtagatcgcagttttgataattttcttttatgtgattcaagtggcctgtctgaggcaataaaaaagtatgtggactatgttagaagacctgtgtcagataatggcattaaagaagggccaaaatgtcccaaggcactgggtgacttagtggaatcttgtgttggtgccatccttcttgattcagggttcaatttgaacaaagtttggaagattatgacttcattcttggacccaatcatgaaattctcatcaagcttgcagctcagtcctgttagggatttgcgagaactttgccaatctcataatttggagttggagtttctgccagtgccctcaaaattgactaaaaggttttcagttgaagctaaagtgagtgggaatggtgtatgtgaaacagcttcagcaactggccaaaataaaaaagaggcttgcagaattgcttcacagctactttttttaaagttcaaggctcaaggttggaaagctaagtcaaaaaccctggaagaagttctggaatcaacttctaaaatggaaccaaaacttattggctatgatgaaactcccattgatgtaacagataccaatactgccaagcacatagtggttaatgctgacccgtacaacaactctaacccagaaatttgccctatgcaactgacagatgaaatatgctctccatgtgtgaaacctttcggccaacggcttcaatcttctgctaagggaaagcttagtcaaatatttgaaaatcgtgattgtggcagtgactcgtctgggacaggaacagcaagatcacgattgtatgaattatgtgctgcgtattgctggaaacctccttcatttgaatgctgcaagaaagagggaccagaccacctgaaacagtgagttactttaaaaataaaatgaagttttaaacatccgtactatcaggtttcagctttggaatttcactcaggatcttcatttcatcctctgaaaatccaaagttaacaatagaagttcaaaactagctatcaatgataatgagaatcacagccaaaagaaaagaaaaatatccctaaaaacttgtttatattaacatggactaaagtataaacaacaaacattcaaattttgtagactggagtggtgtccttaaagggctgtgtaatttaagcatctccatgaaaaaacgggtggattttctcattcaaatcaattacatttctgaatttttg

SEQ ID NO: 166 - DNA, 3956 bp, Glycine max
tatgatatcaattaataaaatttatatgatatcaatttgattaattaaaattatatatataaaagaatttggaactccttcactcagggtcactgcatatccaatggagggttagtgagtgttgttgacttcacattgacgatcctttttttttcctgtctgtttgcttccaatttctcataccttcaatcttcaatcttggaagattggagaacagcattgattgagttttaccacacgatcgtagagcttctgatatttttcgaagaggaaaggcaaaagagttagcatttaggatgggaaaaacaattgagttgtatggattccctacatctgtgaatgtgtctgatgtaaagacatttgtagagcagtatactggtgaaggaactgtgttcgccattaaattaagacatggaaaaggtcgggttccaagagcatttgcaattattcaattcaccaccgcaaattctgctacatctatgatgtccagagctaacaacattttgagaacattgcggtatgggacctcctatttaaaagctcgggaaatggaaagagatattgtgccaaggccaagggtgtttttgcatagtttggatgatgtgaaactgtcttttggctgtcagatctcaaagggaagattctctgttttatggaaaaagcaggatgttattgtaaattttgggagtggaatgagaaagatgcatttcttattttcccacaacaatgtgcaatacaaacttgagctttcatatgagaacatttggaagattgagctgcatcggccacggaatgagactacacgttatctgttgattcagttacttggtgctccccgggtttttgagaacgatgtacctacatcaacaaatatctttgatgatcctttgttcaacttcttcaaagatgcccctgatgagcaatggatccgagcaattgatttcactccagaaagtcgtattgggcagtcctccgccatatgtctggagcttcctaatggccgacaacttccaaatttcagggaaaactttgcttattatgaggaaagtgagaggcaatacactttacagacaggagttcccttttctcaaaattggggtcttgtccccattgttgctcctcctctaggtgttaaaatatcatatgacatcttgtttaaagtcaattcattggttcaacatgcatgtcttgcaggacctgcacttgatggtgacttctatcgcttggttgatccacgtagaatgccccgtgaatttattgaatatgctttagaaaagatttactattcaaaggaattttgttatgaacccacaaagtggctgactgatcagtacaaaacataccttgagtcaaaaaatcatcctcggtcacctgcaatatccttggatacagggttggtatacgttcgcagggttcagatcacgccttgcaaagtatacttttgtggtccagagatgaatgtctcaaatcgtgttctccgtcatttccgtgaacatattgataactttctacgtgtttcatttgttgatgaagaattggataaactgttttcaactgatttatcatcacgttcacagaacaagaaaactgagatatacaccagaattctttccatccttaagaatggcatagttgttggtgataagaagtttgaatttctagcattctcatcaagtcagttgcgggaaaactctctctggatgtttgctcctacagaaactggatgtactgctgcttacataaggaaatggatgggaaattttagccagattaggaatgttgctaaatatgctgctaggctggggcaatcttttggttcatctactgaaactctaagtgtccatagggatgaagttgaaattattcctgatgtgaagaagcttacatatgatggaaacgaatatgtcttctctgatggaattgggaaaatatctcttgaatttgcccagaaagtggctaaaaaatgtggttatgattgcactccatctgcctttcagattcgatatggtgggtacaaaggagttgtggctgttgaccctaaatcatgctacaagttatcactgaggaagagcatgcggaagtatgattcagataacacaaagttagatgttttggcccgtagtaagtttcagccatgttatctgaatcggcagttaatttctctcttatccactcttggtatcaaggatgatgtttttgagaaaaaacaaagagaaactgttaatcaactgaacactatactaacagattcattaaaggctcaggaagttctggacttaatgtctgctggagagatcactaatgttctgaaggagatgctcatttgtggatacaagcctaatgaagaaccattcctttcaatgatgcttcaaacatttagggcatcaaaacttttggaattgcgacttaaatctaggatctttattccaaaaggaagagcaatgatgggatgtctagatgaaactagaaccctagaatatggtcaagtatttgttcagttctctaacaataggctgcagaatctatctgatgattttttttcatatgatttgccaaagaattatatggttaaaggtaaggtagttgtagcaaaaaacccctgcttgcacccaggtgatgtgcgtgttttacaagctgtggatgtgccagatttgtaccacatggtggactgtgttgttttccctcaaaaaggaccaagacctcatccaaatgagtgttcgggaagtgatctggatggagatatctactttgtttgttgggaccatgaattgattccttctcgcccaattgatccaatggactatactgctcctgcaactgtggaattggatcatgatgtgatgatcgaggaggttgaggagtattttgccaattacatagtcaatgacagtctgggaataattgccaatgcacacactgtctttgcagataaagaacatttgaaagcaatgtctgatcaatgtgttaagcttgcaaggttgttttcaacagcagttgactttcctaaaactggtgttccagctgttatacctcctgaacttcatgtcaaagaatatcctgacttcatggagaagcctgacaaacccacatacaaatcgcataacgtgataggaaagctctttagggaagtgaaagaaatatcaacaagtgccggctcaattacatccttcacaaagttggttgcgagagactcttacgaccatgaaatggaagttgatggcttcatggattatgttgatgatgctttctatcacaaaaccaattatgactacaagttgggaaatctgatggactactatgggatcaaaactgaagctgaaatcctcggtgggaatattatgaaaatgtcaaaatctttcaacaaaaggagggatgcagaagcaatcaatatggctgtgaggtccctaaggaaagaggccagggcctggttcaatgaaaacagcagtggtgatgtagattcagggagtagtgatgtgtatgcaaaagcttctgcttggtaccatgttacttatcatccaagttactggggttgctataatgaaggcatgaatagggatcattatctaagtttctcatggtgtgtttaccctcttcttgtccaaatcaagaaagagaaactcagcattagaaggtcctctttggaatacagtttcagtgggttgcgtttgagttgacaactttggactttgcactccctattttccagttggatttctgagccaggcagcttgtttatatttttatagtaactatgcatgtatgttctatggtaatgtcgctatataacatgtatgagtgaatatatacatattctatcaaggaatgagggtgtgcacttccattcccttgctttttttaaaattatatataaatattttgaatgtgtagattttgtctttctctaattttttatatttgaacatcttattcttaattttttatttccttcataataa

SEQ ID NO: 167 - DNA, 3888 bp, Glycine max
tatgatatcaattaataaaatttatatgatatcaatttgattaattaaaattatatatataaaagaatttggaactccttcactcagggtcactgcatatccaatggagggttagtgagtgttgttgacttcacattgacgatcctttttttttcctgtctgtttgcttccaatttctcataccttcaatcttcaatcttgggaaaggcaaaagagttagcatttaggatgggaaaaacaattgagttgtatggattccctacatctgtgaatgtgtctgatgtaaagacatttgtagagcagtatactggtgaaggaactgtgttcgccattaaattaagacatggaaaaggtcgggttccaagagcatttgcaattattcaattcaccaccgcaaattctgctacatctatgatgtccagagctaacaacattttgagaacattgcggtatgggacctcctatttaaaagctcgggaaatggaaagagatattgtgccaaggccaagggtgtttttgcatagtttggatgatgtgaaactgtcttttggctgtcagatctcaaagggaagattctctgttttatggaaaaagcaggatgttattgtaaattttgggagtggaatgagaaagatgcatttcttattttcccacaacaatgtgcaatacaaacttgagctttcatatgagaacatttggaagattgagctgcatcggccacggaatgagactacacgttatctgttgattcagttacttggtgctccccgggtttttgagaacgatgtacctacatcaacaaatatctttgatgatcctttgttcaacttcttcaaagatgcccctgatgagcaatggatccgagcaattgatttcactccagaaagtcgtattgggcagtcctccgccatatgtctggagcttcctaatggccgacaacttccaaatttcagggaaaactttgcttattatgaggaaagtgagaggcaatacactttacagacaggagttcccttttctcaaaattggggtcttgtccccattgttgctcctcctctaggtgttaaaatatcatatgacatcttgtttaaagtcaattcattggttcaacatgcatgtcttgcaggacctgcacttgatggtgacttctatcgcttggttgatccacgtagaatgccccgtgaatttattgaatatgctttagaaaagatttactattcaaaggaattttgttatgaacccacaaagtggctgactgatcagtacaaaacataccttgagtcaaaaaatcatcctcggtcacctgcaatatccttggatacagggttggtatacgttcgcagggttcagatcacgccttgcaaagtatacttttgtggtccagagatgaatgtctcaaatcgtgttctccgtcatttccgtgaacatattgataactttctacgtgtttcatttgttgatgaagaattggataaactgttttcaactgatttatcatcacgttcacagaacaagaaaactgagatatacaccagaattctttccatccttaagaatggcatagttgttggtgataagaagtttgaatttctagcattctcatcaagtcagttgcgggaaaactctctctggatgtttgctcctacagaaactggatgtactgctgcttacataaggaaatggatgggaaattttagccagattaggaatgttgctaaatatgctgctaggctggggcaatcttttggttcatctactgaaactctaagtgtccatagggatgaagttgaaattattcctgatgtgaagaagcttacatatgatggaaacgaatatgtcttctctgatggaattgggaaaatatctcttgaatttgcccagaaagtggctaaaaaatgtggttatgattgcactccatctgcctttcagattcgatatggtgggtacaaaggagttgtggctgttgaccctaaatcatgctacaagttatcactgaggaagagcatgcggaagtatgattcagataacacaaagttagatgttttggcccgtagtaagtttcagccatgttatctgaatcggcagttaatttctctcttatccactcttggtatcaaggatgatgtttttgagaaaaaacaaagagaaactgttaatcaactgaacactatactaacagattcattaaaggctcaggaagttctggacttaatgtctgctggagagatcactaatgttctgaaggagatgctcatttgtggatacaagcctaatgaagaaccattcctttcaatgatgcttcaaacatttagggcatcaaaacttttggaattgcgacttaaatctaggatctttattccaaaaggaagagcaatgatgggatgtctagatgaaactagaaccctagaatatggtcaagtatttgttcagttctctaacaataggctgcagaatctatctgatgattttttttcatatgatttgccaaagaattatatggttaaaggtaaggtagttgtagcaaaaaacccctgcttgcacccaggtgatgtgcgtgttttacaagctgtggatgtgccagatttgtaccacatggtggactgtgttgttttccctcaaaaaggaccaagacctcatccaaatgagtgttcgggaagtgatctggatggagatatctactttgtttgttgggaccatgaattgattccttctcgcccaattgatccaatggactatactgctcctgcaactgtggaattggatcatgatgtgatgatcgaggaggttgaggagtattttgccaattacatagtcaatgacagtctgggaataattgccaatgcacacactgtctttgcagataaagaacatttgaaagcaatgtctgatcaatgtgttaagcttgcaaggttgttttcaacagcagttgactttcctaaaactggtgttccagctgttatacctcctgaacttcatgtcaaagaatatcctgacttcatggagaagcctgacaaacccacatacaaatcgcataacgtgataggaaagctctttagggaagtgaaagaaatatcaacaagtgccggctcaattacatccttcacaaagttggttgcgagagactcttacgaccatgaaatggaagttgatggcttcatggattatgttgatgatgctttctatcacaaaaccaattatgactacaagttgggaaatctgatggactactatgggatcaaaactgaagctgaaatcctcggtgggaatattatgaaaatgtcaaaatctttcaacaaaaggagggatgcagaagcaatcaatatggctgtgaggtccctaaggaaagaggccagggcctggttcaatgaaaacagcagtggtgatgtagattcagggagtagtgatgtgtatgcaaaagcttctgcttggtaccatgttacttatcatccaagttactggggttgctataatgaaggcatgaatagggatcattatctaagtttctcatggtgtgtttaccctcttcttgtccaaatcaagaaagagaaactcagcattagaaggtcctctttggaatacagtttcagtgggttgcgtttgagttgacaactttggactttgcactccctattttccagttggatttctgagccaggcagcttgtttatatttttatagtaactatgcatgtatgttctatggtaatgtcgctatataacatgtatgagtgaatatatacatattctatcaaggaatgagggtgtgcacttccattcccttgctttttttaaaattatatataaatattttgaatgtgtagattttgtctttctctaattttttatatttgaacatcttattcttaattttttatttccttcataataa

SEQ ID NO: 168 - DNA, 3953 bp, Glycine max
tatgatatcaattaataaaatttatatgatatcaatttgattaattaaaattatatatataaaagaatttggaactccttcactcagggtcactgcatatccaatggagggttagtgagtgttgttgacttcacattgacgatcctttttttttcctgtctgtttgcttccaatttctcataccttcaatcttcaatcttggattggagaacagcattgattgagttttaccacacgatcgtagagcttctgatatttttcgaagaggaaaggcaaaagagttagcatttaggatgggaaaaacaattgagttgtatggattccctacatctgtgaatgtgtctgatgtaaagacatttgtagagcagtatactggtgaaggaactgtgttcgccattaaattaagacatggaaaaggtcgggttccaagagcatttgcaattattcaattcaccaccgcaaattctgctacatctatgatgtccagagctaacaacattttgagaacattgcggtatgggacctcctatttaaaagctcgggaaatggaaagagatattgtgccaaggccaagggtgtttttgcatagtttggatgatgtgaaactgtcttttggctgtcagatctcaaagggaagattctctgttttatggaaaaagcaggatgttattgtaaattttgggagtggaatgagaaagatgcatttcttattttcccacaacaatgtgcaatacaaacttgagctttcatatgagaacatttggaagattgagctgcatcggccacggaatgagactacacgttatctgttgattcagttacttggtgctccccgggtttttgagaacgatgtacctacatcaacaaatatctttgatgatcctttgttcaacttcttcaaagatgcccctgatgagcaatggatccgagcaattgatttcactccagaaagtcgtattgggcagtcctccgccatatgtctggagcttcctaatggccgacaacttccaaatttcagggaaaactttgcttattatgaggaaagtgagaggcaatacactttacagacaggagttcccttttctcaaaattggggtcttgtccccattgttgctcctcctctaggtgttaaaatatcatatgacatcttgtttaaagtcaattcattggttcaacatgcatgtcttgcaggacctgcacttgatggtgacttctatcgcttggttgatccacgtagaatgccccgtgaatttattgaatatgctttagaaaagatttactattcaaaggaattttgttatgaacccacaaagtggctgactgatcagtacaaaacataccttgagtcaaaaaatcatcctcggtcacctgcaatatccttggatacagggttggtatacgttcgcagggttcagatcacgccttgcaaagtatacttttgtggtccagagatgaatgtctcaaatcgtgttctccgtcatttccgtgaacatattgataactttctacgtgtttcatttgttgatgaagaattggataaactgttttcaactgatttatcatcacgttcacagaacaagaaaactgagatatacaccagaattctttccatccttaagaatggcatagttgttggtgataagaagtttgaatttctagcattctcatcaagtcagttgcgggaaaactctctctggatgtttgctcctacagaaactggatgtactgctgcttacataaggaaatggatgggaaattttagccagattaggaatgttgctaaatatgctgctaggctggggcaatcttttggttcatctactgaaactctaagtgtccatagggatgaagttgaaattattcctgatgtgaagaagcttacatatgatggaaacgaatatgtcttctctgatggaattgggaaaatatctcttgaatttgcccagaaagtggctaaaaaatgtggttatgattgcactccatctgcctttcagattcgatatggtgggtacaaaggagttgtggctgttgaccctaaatcatgctacaagttatcactgaggaagagcatgcggaagtatgattcagataacacaaagttagatgttttggcccgtagtaagtttcagccatgttatctgaatcggcagttaatttctctcttatccactcttggtatcaaggatgatgtttttgagaaaaaacaaagagaaactgttaatcaactgaacactatactaacagattcattaaaggctcaggaagttctggacttaatgtctgctggagagatcactaatgttctgaaggagatgctcatttgtggatacaagcctaatgaagaaccattcctttcaatgatgcttcaaacatttagggcatcaaaacttttggaattgcgacttaaatctaggatctttattccaaaaggaagagcaatgatgggatgtctagatgaaactagaaccctagaatatggtcaagtatttgttcagttctctaacaataggctgcagaatctatctgatgattttttttcatatgatttgccaaagaattatatggttaaaggtaaggtagttgtagcaaaaaacccctgcttgcacccaggtgatgtgcgtgttttacaagctgtggatgtgccagatttgtaccacatggtggactgtgttgttttccctcaaaaaggaccaagacctcatccaaatgagtgttcgggaagtgatctggatggagatatctactttgtttgttgggaccatgaattgattccttctcgcccaattgatccaatggactatactgctcctgcaactgtggaattggatcatgatgtgatgatcgaggaggttgaggagtattttgccaattacatagtcaatgacagtctgggaataattgccaatgcacacactgtctttgcagataaagaacatttgaaagcaatgtctgatcaatgtgttaagcttgcaaggttgttttcaacagcagttgactttcctaaaactggtgttccagctgttatacctcctgaacttcatgtcaaagaatatcctgacttcatggagaagcctgacaaacccacatacaaatcgcataacgtgataggaaagctctttagggaagtgaaagaaatatcaacaagtgccggctcaattacatccttcacaaagttggttgcgagagactcttacgaccatgaaatggaagttgatggcttcatggattatgttgatgatgctttctatcacaaaaccaattatgactacaagttgggaaatctgatggactactatgggatcaaaactgaagctgaaatcctcggtgggaatattatgaaaatgtcaaaatctttcaacaaaaggagggatgcagaagcaatcaatatggctgtgaggtccctaaggaaagaggccagggcctggttcaatgaaaacagcagtggtgatgtagattcagggagtagtgatgtgtatgcaaaagcttctgcttggtaccatgttacttatcatccaagttactggggttgctataatgaaggcatgaatagggatcattatctaagtttctcatggtgtgtttaccctcttcttgtccaaatcaagaaagagaaactcagcattagaaggtcctctttggaatacagtttcagtgggttgcgtttgagttgacaactttggactttgcactccctattttccagttggatttctgagccaggcagcttgtttatatttttatagtaactatgcatgtatgttctatggtaatgtcgctatataacatgtatgagtgaatatatacatattctatcaaggaatgagggtgtgcacttccattcccttgctttttttaaaattatatataaatattttgaatgtgtagattttgtctttctctaattttttatatttgaacatcttattcttaattttttatttccttcataataa

SEQ ID NO: 169 - DNA, 9440 bp, Glycine max
ggatttgttaagattgtatacgatattatcaaaatcagttttaattaagattaaaaaacaaatgtatctgcaatttaatatagtacattgggattaaatatcttaactttaaatttaattcaaattagaattcaaattcaaaatgaattaaatggttaacatataaaatgtcaactgacttaataatataataacttccaaaaaataaatactttaatatcaaagcaagattgaaatttatactataagagtgactcaaatctataataattccatatcaaattaatactattttccttaattagttacatatttgaaatatttttttaaaatttcctaaaatatttgatcaatattcaattttttttaccaatattcattataatatggtattgtttatttttttatgatgtataatatggtgttgcttgaccaagatttttcatcaatattgcatatttttttaaaattatactttcaaatgttttatatgtttcattttttttggtaaaacaattatttctcaaatatagttttgaatttataattttatgtttattttttttaatatctgcacaaaactaacgagcatgaatatcaactgataggggaattttggcaattgagttattttttaaatgttaaaaatgtagaattttcgaatgatgtattttatatttgtctttgctttaattattagcaaaatagtatagttttaactaaattaacattctattatttttctaactttgttataattcttaaaataatcattattaagacacattttataagaaaaaatattttatataagagggtaatataattaaatctgtaacttataattatatattaaggatttaaaatttaatgttaaaaaaaattatataatttttttaaaattcacataactttttcgatcacattacatcaaaatgccactttcatataagatataatttttctcattcttattattattattttagttaatgtatgaatttaactttttctaaaaaaatgacatatctgatttaaatttatttatttaattttaaaatcaaataactataaacaaagtatttacttttaattatagctgaattaatcacgtatacatattttgtttagaattttaaacatattcatgtattgttaattttttttttttaaaataacgtcgtagtaaaaaattgtacctacttctagttaaatgaacatgatttctaggatgaataaccaattattagtatttttgcacattgatgtctccccaaaattcatttatttgcacgcaccccatcattatccagacccaatgccacgaacatgaatacaaaaacgcattttatcgaaagaatcgatgtttctctttattaaaaaaataaaaaagttgtaacaaatgctgagggaaatggggccccactagtgcaaacgtaatcaccatgctccacctttacgaaccgaatcccgaaccattttgcctatcggatctcagccctccacgtcaccacaccacaccacatcatcaaacgtccgagagcggctaacagcacaaactgcatagagcgtcaccgcagagtgcgtcattattattattttctcttcgtactcccccagaggaatgagaggatgtgaacaggtgctcgctgatgccactattaaaagagtgaagggagcgagtaacagaatcacgcttcaaatcatctgcattcatttttcttctctctacttcttctgcgtcatcttagggttttggtttgtgctcctctcactgattttctggtcaggaatacgctaactcttcttcttacctcatgaattttgcttcgttttttctttctttctctcttctgcttgctttcgttgctacctgtcatgatcacatgctgcatttgccatttcctgcgtttttcttccgcttaattcgtcctcagtgtttgtttcaccgtttaatcgtgtcttattgatagtatggggttttctgcttttgaaatgcttcgctgttgtttatgttctttcgttttcctgcgttttttttgtgatgttttgttttgctgcatgtctttcggctttgatcgtctttttttgcgtgtttattttgaagaggaaacgctttcgctgtgcttcgttgacttaagctcgattttgcttccgaggcgacgcgtatttgttagaattttcagtgtttttttgagtttaattcttgcggtttcactggttgtgatttccctgtatctttgtttttttttttttttgaaagcgcaaactctgtctgctctgatgatggtccgaatcggtgactacacctttgggcatttgtgttccgaagccagatatttgcttcagggtgcctgattttgccgcccgagtatcttttttgtgtttagttgtatttattttttaatttcgtttttatttgtatctttttttatataaattttacttgttttagctttttacgtcctccgtgcttatgtcgtttactgcacttttgtgtattttattttgcttgcagtgcatgtaattatttctatgttggtttatttgtataaaatgcgttttgctggttacttgtttgtttcatcaatttgagtgagaaatgttgttctagattctatattcatgatagttgttccctttttgttttgttgtgcgaaaatgttttactatattgtttttcgcataatttcgcatgattagagtttttatgtagataatttgagcattttgttgtttttaaaattcttttctcagtaggtttatttgtatagacgtattttgttgtttgtttgccttttacgcttcctgtttgaataataaaatattactctagatttttgtttgcatgatagcggtttgtctctttttttttttgtatgaaaatttgttgtaccctagtgtttggcgtctgcttagatatgcatgtagacaatctcagaatatttagttatttttcaaattttttgtttgaaggattatgtgaactaactacttatgctgacacaatttatttaatgcatgatctatgcaggagatggcttctttcgggccaaatggaactgaaaatgaggattcgttgcctcccccacctcccgttgtaccatcagatgttgtacctgttaaagctgagccggagaagaaaaaggcttcaaggtttccaatagccaggcgtggccttgcttcaaaagggacgaagctgcaacttctcaccaatcactacagagtgaacgttgcaaacactgatgggcatttttatcagtatagtgtatgtgctttcattttcaccagcattatttatttcaggtctctgtttaacttggaatcatttattcaatgtttatgtttaagcaggttgctcttttttatgatgatggacgacctgtggagggtaagggtgtagggaggaagcttctggacagggtgcatgaaacgtatgattctgaattgaatgggaaagattttgcatatgatggtgagaagactctgtttactctcgggtctcttgctcgcaacaagcttgagtttacggttgttctggaggatgttattgctaccaggttcaaattctgtggatgctaattcttcaatttgacttaactttttactgtttaagctttgtaacttattttttctgtaccaatgtatgttatagaaacaatggaaactgcagcccagagggcaatggagaactgaatgagagtgacaaaaagaggatgaggcgccctaatagatccaaggcatttaaagtggaacttagctatgcttcaaagattccattgcaggccattgccaatgctctacgtggacaggaatctgagaattatcaagaagcaataagagtgcttgatatcattttgaggcaacatgctgctaagcagtgcgtggattatgatcatttcttttttcttctattattattattattgataacattattgcatcagcttgcctttgtgtgtctcttatgttgtaatttaaaataataaaataatgtcaatttacagagggtgtttgcttgtgcggcaatcgttctttcacaacaatcccaagaattttgctgatgtaggaggaggtgtacttggttgcaggggcttccactctagttttagaactactcaaagtggactgtctttgaacataggtttgatctgttgtttgccttggacactacattcgtttcctcataatatttattaattctttcttggaatttgtttagatgtctcaaccaccatgataattacccctgggcctgtggttgacttcctaatatccaatcaaaatgtgagagaccccttttcacttgattgggcaaaggtaagctaattcaatgaccatttgatcatagtacttgattgattgttaaataccataatctcatcttttatttattttcttgaacaggccaagaggacattaaaaaacctgaggattaaatcgagcccatctaatcaagaattcaaaatcactgggcttagtgaactcccttgcaaagatcaaatgtatgccattaattctgcttttgttcttgataattaattattattaattttagagatttttaactatcagggtgtgggtgttgtaggtttacattgaagaaaaaaggtggtgatgatgacactgaggaagaagtgacagtatatgattattttgttaatatccgcaagatagatcttcggtattctggggatctcccatgtatcaacgttgggaaaccaaaaaggccaacttacattcctcttgaggtagatttggtgctttatatttttgtttaggattttgaattagaaagctattgattcatctttgctggttaataactttttaactttttatgcttagctgtgttctttggtatcacttcaacgttatacaaaagcactatccacacttcaaaggtcttcattggtggagaagtccaggcagaagccacaagagaggatgagggtcttgtctgatgtatgtgtctttttgtcctgttttgaatatttgggttgtatatttttctggtttacctgatattactttaattgttacaggcacttaaaagtagcaattatggttctgaaccaatgctacgcaattgtggaatctctataagccccaactttactgaagttgagggtcgggttttacaagctccacgggtaaattttaagtcattataattgtgcatttgcttattaatttttatcatgcattgtcttctttatcttcttttaaataaactttgttaccttcatattgatgaatattgtggtaatgacttaattttgttaatattgtgctcagagcattaaatattgctttgcttaattgtctaagaatagttggtaatataatcttcatgttctaccataaccaattctaactggttttatatggaaatgttgtcaaattattgagatgtggttttatttgttgttgatggcatcttattctttaattatcaatgttgagttctgtaatatgggttttaaagctgattattaaatttacgtttgcagttgaaatttggtaatggggaggacttcaatcctagaaatgggaggtggaacttcaataacaaggtatgttattctactcttacattaatttcataaaaaaatgatttgaattttctaatcattgattttttttctccagaaaattgtcaagccaactaaaatagaaagatgggctgtggttaacttctctgcacgctgtgatatacgagggcttgtgagggatctcattaagtgtggtggaatgaaaggcattgtaagttttagaactgcagattgactctgaagcataatgaagttgctgactatatttttcttaactgcaattggtaggtgatagatcagccgtttgatgtgtttgaagaaaatggtcagtttaggcgtgcaccgccagtggttcgagttgagaagatgtttgagttggtccagtcaaaacttcctggggctcctcagtttcttctttgtctgcttcctgagaggaaaaattctgatctttatggtaaggttatttgataagttttgtcttttgtttactcctctcatgcaattgtttaagtccccttattgatgaaaattaactgaacttggtaaggtccatggaagaagaagaatcttgctgagtttggaattgtgactcagtgtatagctccgacaagggtcaatgaccaatatttgactaatgttctgttgaaaatcaatgctaaggtatgttgtttcttggtttaattttctatttttttttggaatatatattgtaattctttttgtgcagtttgtcaggattcattgttgtacctttcattgaattttttttattgttttgtagcttggtggtctgaactcaatgttaggcgttgagcattctccttctattcctattgtttctagagcgccaaccatcattattggcatggatgtgtctcatggttcgccagggcaaacagatattccttcaattgctgcggtattttattagtgcttgtgatttttatattgggcatctgtttcaaacctgtgattgtcttagtttgagcctacatcctggttattggaatgttttatgactatctgattgtgtgctaatgcttaaacatgcaggtggtcagctctagagaatggcctctaatatcaaagtatagggccagtgtccgtacgcagtctccaaagatggaaatgattgataatttgttcaagaaagtttccgacaaggaggatgaaggcataatgaggttaatttaattttgtaacaaatcattgaattaatcctcctagtatatttatgatatcatattgttctcaattttgtttacattaatctggaatttggttctgtgaaatgatcagaatttggtttctaaattttgtatcaaagcatttatttattcattatagtttgtgtaattgctctcgtgtgttgtgcattacctctttgctttaaagcatttcttgctacataatattaagtgaatgccagtttagtttcaattttataaattattaacggtattttgtggtaaccgtttattttctggtttatattttttggaattggacggtcattggtgtgttgtatatctgcagggagcttctacttgatttctatacaagttctggaaatagaaagcccgataatataatcatattcaggttactttttttctcattttattctgtgaaatatgtactttatatttttagttttcataaatgttgtttgagttgttaatatatattgtaatggatgttatccatttttgtttttatacaatgattaattaaatatattgttttaagtcaatgttatctagtattgtggttaatatgtatgactgttcgtgtaatatttgattagtttaaaaggcacttgattgatggtctttgttagtgttttgaatgataaagttgtatgatacgatccttatcatctgttctgcaaatctctttttatgtcaccaagacaaatgtcaaaggcttatagatttaacaaatgcctactatttggtttgcaattcctgacctaatttatgttagatgatcagttggtcggacctataatgtgtatgttgttatatgtgagtgtgtgtactgaattgtgtttttttttaaattttttttatttgtcttcagtcgtttttatgtctgttattttattagttcttacatattttttcataatgaatctttttaatatgtatttttgtttgttaagtgatatttttgtgtattttgaactgaccttttttgggctggatgtagggatggtgttagtgagtcccagttcaatcaagttttgaacattgaacttgatcaaattatcgaggtgcttatttattgagctgatgaatttaaatattaaatatttgaagtgtttttggggttaatattgtcttcttcaatattattaggcttgcaagtttttagatgaaaagtggaatcccaagtttttggtgattgttgctcaaaagaaccatcatactaaattctttcaacctggagctcctgacaatgttcctcctggtatgcgtcttgtttattttgaattttaacacgtttcaataatttctgttttgttatttcttaaccttttttattttttgcaggaacggtaattgataacaaaatttgtcatcctcggaattatgatttctacatgtgtgcacatgctggaatgattgtgagtatctgctattttttattttatttattttaatgtggttttggttttacaatttgtagatccattactgtggctcctatccattgttgatgtaaagtgtgcgaatgttctttaagacgcatgtacattcattttacttggtgaaattgtttacaaattgaagttgaatgattctggcttctttccttcttaatttaaatgtttatgtatgttcatttgcatgtctctaatttttaacatgtaattttttttctggtcatcctcgttatgcatttcactgaatgctgtttatttagagattaggaagctaccctctgtacgagttttccataaatgatatgtttgtgtcagtacttcaataacatgcttgtatttgtttaaaaaattactattcagggtactagcaggcctacacactaccatgttctcttagacgagattggcttttcacctgatgatctacaggagcttgtgcattcattatcatatgtgtaagtagtagttgtgatctatttgattgttttagaatattgtttattccaacccttgccatgtatggatattgtcttaaaattattttgctatttgacaataggtatcagaggagcacaactgccatttctgtcggtaagttcgtgcacaacatttttagcattgtgttttacacttatatgttcccaatttatagaaatatatagggtctcattggtgaaataactgaatgtatgcagttgctccaatatgctatgctcatctggctgcaactcagatgggtcaatttatgaaatttgaggacaaatctgagacatcttcaagtcatggtggttctggtatacctgctcctcccgtccctcagttgccaagattgcaggacaaagtttcgagctcaatgttcttttgttgaaggatctgtttctagggataggcgatgactgataacagtgctgtttataagaccttcataggatagtttttttgtggaaacagttgaactatgggcgccaatggtgtaggtaaggattattatacatgtaagcaggcattttgctcatgcctttacatgtgtttagtcttttactattttgaatattgttgcgaagtctttcgctattttgaagtttgttaaggtttatgtgattcctatggcgttcctattatgcactcttgatcattatctaatctagtggtttgcatgaatcaaaaaggtgaaatgggtattactgtttttgttaaagtttgttggtgatctgtct

SEQ ID NO: 170 - DNA, 9839 bp, Glycine max
ttaggattaaatatcttgacttttaatttaattcaaattcaaaatgaattaaaatgcttaatatataaaatgtcaattaattatttcgtaggaattaaatgcaatatcaaataatttataacacttaaataacttactcaaccaaccaattgaattagataaaatgtacactgacttaaccagaaatataataactttcaaaacagaaatattttaaattcaaaacaagattgactttaattctacaaagagtgaataaaacctataatattttcatatcaaatcaaattaatattattttccttaattaaatacatatttttttaatctgttataatatggctctgtttaaatatttgttattataatatggtattgtttgacctataataaatattttttattataaatatttttcattaatatcgtatattttttcaaattattcttccaaatgttgtatatgtttaagtttttttttggtaaaacaattacttctcaaatatagttttgaacttataattttaatgatatattcataatactatcgagcatgaatattaactgctaggatgattttccaacttaatcaagtgattttgaattcttaaaatacaattgcattaacattcaataaaaaagattttgttaaatttagtaatttctactaatatgattttaccagtcgtgagcacaataagtttttaccaattaagttgttttttaaatgttaaaatgtagaatttttaaattatgtattttatatttgtctttacttttaattattagcaaaacagtcttgttttaactaaattaacattcttttatttttcttcttctaattttgttatgattttcttatttttaaatattctcaaaataatcaacatagtcatcatactattattttcatagttaatttatgtattcaactttttcagaagaatgacatatctcatttaatttttttttatttaaattttaagagaaaattattacaacccaaactactccaaatttacttttaattatagctaaattaatcacgtataaatatgttttttttagaattttaaacatatttatgtattgttcatttatttttgtattttttcaaaattaaaatacacctcgtagtaaaaaattgtacctgctgctagttaaatgaacatggtgcctaggacgaataaccgaatattagtagtattgttttgcacattgatgtctgtcaccaaattcatttattcagcattatccaaacccaatgccacgaaggtgaatacaaaaaggctttttttttttttttatcgaaagaatcgatgtttctatttattaaaaaaataaaaaaggagtaacaaatgctgagggaagtggggtccacgagtgcaaacgtaatgaccgtgctccacctttacgaaccgaatcccaaaccgtctcaaacgtgatcggatctcagctctccacgtcactaaaccacatcatcatcaaacgtccgagagcgggtaacattacaaactgtatagagcagcaccgcagagtgcgtcatttttattttttattttttctcttcgcaattcactcattcactcactcactcactcactcactctctctcgctgctgccattattaaaagagtgaagagagagcgagttatagaaccatacttcaaatcattttcattccattttcttctctctgcgccttcttagggtttgggtttctgcttgtgcttctgtcactcattctggtgaggaaaacagcctactcttcttacctcacggatttcgcttcgttttttttctctcttgctttcattgctctttgtgatgatcacatgctgcatttgcttttttctgatttttttcttccttttatttcgttctcagtgtttgtttcaccgtttaatcgaggcttattgttggtttagggttttctgcttttggaaatgcttcgctgttgttcatgtcctttcgtcttgtgatgttttgttttactgcatgtgtttcagctttgatcgtcgttttttgtgtgtttattttgaagagaatatgttttcgttgacttcaaactcgttttgcttccgacgcgaagattgtttgctagaattttcagactgtttttttgagttaatccttgcgttttcactggttgttatttcgccgtgacgtttctttttgcttttttaaaagtgttaaatttttttgaagcgaaaactctgtttggtgtcatggtggctcgaatcggcggccacactgagtttaataaaattaattttcaccgtctttatgatttttccgtaccgatgttttatgtatttgcatttttaaattttgtttaatttttttttggaaagcggaaactctgtttgctctgatgatggtcagaatcggtgaccacacctacctatttttgggcatttgtgttccgaagtcagatatttgcttcagggtgcctgattttgctgccagaggagcttttttgtgtttagttgtatttgttttttaatttcgttattatttgtattttttttaatttgacttgttttaacattttacgtcttccgtgcgtagtattttgtttactgcacttttgtgtattttctttgcttgcattgcatgtgcttacttctgtgttggtttatttgtataaaatgcgttttgctagttacttgtttgtttcatcaatttgagtgagaaatgttattctagattctatattattgtattttattttgctgccatgatagttgttccttttttgttttgttgtatgaaaatgttttactatattatttttccctaatttcgcataattagagtttatgtagataatctaataatattttaaatttattttcttcgtaggtttataaacgctttttgttgtttgttttcatagtttcaccgcttcctattcgagtaataaatattactctagatttttgtttcccttctcttaaattgatgttcttttttcggttttatttgcaagatagctgttcgtcctttttttttatgaaaatttgttgtaccatagcgtttggcgcatgcttggagatacatgtagacaatctcagaatatttagttattttttgaaatttttgtttataatttttgttcaaaggattatgtgaacttactacttatgctgagacacaatttatttaacaacttttcctatatagctgacactgctttttataatttggatgtggtgatttaatacatgatctatgcaggagatggcttcttcggggccaaatggaactgacaacggggattcgttgcctcccccgcctcctgttgtcccatcagatgttgtacctgtcaaagctgagctggagaagaagaaggctttgcggcttccaatagccaggcgtggccttgcttcaaaagggacaaagctgcaacttctcaccaatcactacagggtgaacgttgcaaatactgacgggcatttttatcagtatagtgtatgtgcttttattttcacctgcattatttaattcaggtctctgttttacttggaatcatttattcaatgtttatgtttgtgcaggttgctcttttttatgatgatggacgacctgtggagggtaagggtgtagggaggaagcttctggacagggtgcatgagacgtatgattctgaattgaatgggaaggattttgcatatgatggtgagaagactctgtttactcttgggtctcttgctcgcaacaagcttgagtttacggtcgttttggaggatattattgcttccaggttcaaattctgtggttgttaattcttcaatttgacttgacttaactttttactgtttcagctttgtaactttttcttcttctttctgtaccaatgtatgtacagaaacaatggaaactgcagcccagatggcaatggagaactgaatgagagtgacaaaaagaggatgaggcgccctaatagttccaaggcatttaaagttgagcttagctatgcttcaaagattccattgcaggccattgccaatgctctacgtggacaggaatccgagaattatcaagaagctataagagtgcttgatatcattttgaggcaacatgctgctaagcagtgggtggattatgtttatttcttttttcttctatgattattaataataatattattgtatcagctttccttagtgtgcctgttatgttggaatataaaataatgtcattttacagaggctgtttgcttgtgaggcaatcgttcttccacaatgatcccaagaattttgctgatgtaggaggaggtgtacttggatgcaggggtttccattctagctttagaactacacaaagtggactgtctttgaacataggttcgatctgttgtttgccctggacactatattggttcctcataatatttcttaattctttcttacaatttgtttagatgtctcaaccacgatgataattacccctgggcctgtggtggacttcctaatatccaatcaaaatgtgagagaccccttttcacttgactgggccaaggtaaagctaattcaatgaccaattgatcatagtgcttgattaactgttatatacaataatctcattttttatttattttcttgaacaggccaagaggacattaaaaaatctgaggattaaagcgagcccatctaatcaagaattcaaaataactgggattagtgaattcccttgcaaagatcaaacgtatgtcattatcctgcttttgttcttgattattaattattatcatttttagagatttttaattaccagggtgggggtgttgtaggtttaccttgaagagaaaaggtggtgatgatgttgctgaggaagaagtgacagtatatgattattttgttaatatccgcaagatagatcttcgatattctggggatctcccatgtattaacgttggaaagccaaaaaggccaacttatatccctcttgaggtagatttggtgctttatattttgttttagtactttgaattagaaagctattgattcatctttgctgcttaattacttttaattttttatgcttagctttgctctttggtatccctgcaacgttatacaaaagcactatccactcttcaaagggcttcattggtggagaagtccaggcagaagccacaggagaggatgagggttttgactgatgtaagtgtctttttgtccagttttgaataattggattcttgtatatttttctgggtttacctgatattatttctattattgcaggcacttaaaagtagcaattatggttccgaaccaatgctacgtaattgtgggatctctataagccccaactttactgaagttgagggtcgggttttacaagctccgcgggtaaatttcaagtcattataattgtgcatgtgcttattcttttttattttgttaccttcatgttgatgttgatgaatatcgtagtggtgaattgattttgttaatattgtgcccagagaggtgggtttagatattgccttgcttttgcaccaattctaattgctttttgttggctgaattatcaatgttgtgttctgtaattgctttcgaaactgattattaaatttgtgcatgtagttaaaatttggtaatggggaagacttcaatcctagaaatgggaggtggaacttcaataacaaggtatgtcattctaatattcaattaatttcataaaaaaagatttgaattttctaataattgaattttttttctccagaaaattgtcaagccaactaaaatagaaagatgggctgtggttaacttctctgcacgctgtgatacacgagggcttgtgagggatctcattaagtgtggtggaatgaaaggaattgtaagttatataactgcagattgactcggaagcataataaatttgctgactatatttttcttaactgctattggtaggtgatagatcagccatttgatgtgtttgaagaaaatggtcagtttaggcgtgcaccgcctgtggttcgagtagagaagatgtttgaattggttcagtctaaacttcctggggctcctcagtttcttctttgtctgcttcctgagaggaaaaattctgatctttatggttagttatctgataatttttgtcttttgttcactcttgttttcatgtaattgtttgagtccccttattgattaaaattaactgaacttggtaaggtccatggaagaagaagaatcttgctgagtttggaatcgtgactcagtgtatagctccgaccagggtcaatgaccaatatttgactaatgttctgttgaaaatcaatgctaaggtatgttgtttcttgggttagttttctattttttggaatataaattacaaatcttttttgtgcagatttccaggattcattattgtgcctttcattgaaatttttaatcttttgtagcttggtggcctgaactcaatactaggtgttgagcattctccttctattcctattgtttctagagcaccaaccattattattggcatggatgtgtctcatggttcgccagggcaaacagatattccttcaattgccgcggtaatttattagtgcttgttgtgtttttatatgttgggcatgtgtttcaaactcatgattgtcttagtttgagtatacttcctggttattggaaggaatgttttatgactatctgatagtgtatgctaatacgtaaatatgcaggtggtcagctcccgagaatggccactaatatcaaagtatagggctagcgtccgtacccagtctccaaagatggaaatgattgataatttgttcaagaaggtttctgacaaggaggatgaaggcataatgaggttaatttaattttgtatcaaatcattgaattgatcctcctagtatatttacgatatcatattggtatcaattttgtcaacattaatttggaatttggttctgtgaaatgatcagaatttggtttctaaattgatgtcaaattatatattggattaaggtatagtgcgtccaacaatatgataaatctaccaagcatttattcgttctttaagtttgtatacatgctctcgtgtgttgtgcattaccactttcctttgaagtatttcttgctacataatattaagtgaattcaaatgaatgccagtttagttgcaatttataaattataaacagtattttatggtacttgtttattttgtggtctgcattttctggaattggacagtcattggtttgttgtatatctgcagggagcttctacttgatttctatacaagttctgggaatagaaagcccgataatataatcatattcaggttaactttttttctcaaattttattctgtgaactatgtactatattttctttgtttttataaatgttgtttagttgttaatatatagatattgtaatgtttgttgttcgtttttgtttttaacaatgtttgattaaatctattcttgcaacatgttatgtaatatcgtggtggttaatatgtaagactgtttgtgtaatatttgtttaggttaaaaagtgcttgcttgatgccttttttagtgttttcaatgataaatttgtaagatacgatcattatcatctgttttaggctcaaatactctagctgcattttcctaatttagtttgcctttttttaaccctttctcttttaattggatgtgcaatattcaatatttattaacaattttaaaaggattcatatgcatttaaggtaataggatttttgttgatttcatctgagaatgttataccatgcaaagctctttttatgtcactaagacaaatgtcaaaagcttatagatttaaccaatgcttctatttagtttatggttttattatcacttcagaatgtttgtctgaatttttcttcagaatgtttgtactgaattttatatatatttcttttttactgaattgtgtgtgtgtgtgtatttatttattatgtcttcagttgtttttatgtctgttattttgtttgttcttacatatttttttgtaacgaatctttttaatatgtaagtttatttttgtttgttattgtatttgttctttaatcattgtactgacctttttttggctggatgtagggacggtgttagtgagtcccagttcaatcaagttttgaacattgaacttgatcaaattatcgaggtgcttattgattgagctgatgaatttaaaacattaaatatttttagtgtttttggttggggttaatactgtcttctttaatgttaggcttgcaagtttttagatgaaaagtggaaccccaagtttttggtgattgttgctcaaaagaaccatcatactaaattctttcaacctggagctcctgacaatgttcctcctggtatttgtcttgttttatttagaatttaacatcttttgataatttctgttttgttatttcttaacccttttttatttatttttgcaggaactgtaattgataacaaaatttgccatcctcggaattatgatttctatatgtgtgcacatgctggaatgattgtgagtatctgctaaattttttttctgtattttaatgtggttttggtttttctatttgtagatccattattgaggctcctattccttgttgatgtaaagtgcacgaatgttctttaagacgcatgtacattcgttttacttggtgaaattgttttcaaattgaattcgaatgattttggtttctttccttcttaattaaatgtgtatgtatgttcgttcatttgcatgtctctattttttagtatgtaagttttatggtcatcctcgtcattcatttcatttggatgctgtgtattaagagattaggaagctacccttggtaagagtttccataaatgatgtgtctttgtcagaacttgcaataacagtcttgtattgttttgaaaaattactattcagggtactagcaggcccacacactaccatgttctgttagacgagattggcttttcacctgatgatctacaagagcttgtacattcattatcatatgtgtaagtagtagttgtgatctatttgattgttttagaatattgcttctgccaatccttggcatgtaacgatattgtcttaaaatcattttgctatttgacaataggtatcagaggagcaccactgccatttctgtcggtaagttcttacacagcttttttttttaactgtttatttagtggtttttgtattcatagaaatatatagggtctcattggtgaaaaaaactcatgtatgcagttgctccaatttgctatgctcatctggctgctactcagatgggtcagtttatgaaatttgaagacaaatctgagacatcttcgagtcatggtggttctggtatgcctgctcctcccgtccctcagttgccaagattgcaggaaaatgtttcgagctcaatgttcttttgttgaaggatctgttgcagttctagggatagtgataactgataacagtgctgtttataagacttcataggatagtttttttgtttgaaccgttgactatgggcgccattggtagtaggaaaggattattatacatgtaaaaaggcattttgcttatgcctttacatgtgtttagtctttaactattttgatactgttgcgagcgaagtctttcgctattttgaagattgttaaggtttatgtgattcctatggcgctcttgatcattttctattttagttgtggtttgcatgaatcaaaagattaaatgggtatattactgttcttatttacggataaaatccatattatagactcctgattgcaatgtgacccgagtaaataagaatgtctcaattgtgtttaaaatacgtgaat

SEQ ID NO: 171 - DNA, 10321 bp, Glycine max
tttggggcaaaactccccatccagcaacactcaggccatcaatcatagttgtgtgtgaatcagttcccgtcatttgtgttgaacacaactctaccaaggtattctaaattaacgtgcaaaattaaaatgacaatattcagaaaagaaatttgaatcacgggatgaatttttttcgctgcatgtaaaattaaaagtattctatatcagcaaaattagtattcaaattaaaagtattctatatcagcaaattgattttggtactgcatatcattaacgattcaaattgattttggtactgcatatcattaacgattcaaattgattttggtactgcatattatcaagaagaacaatataacgattgaaattgattttggtattgcatatcattattctatataagcaaaattagtattcaccataaaactaaatagagacaacatcttatcaagaagaagaatataacgatttagattgattttggtactgcatatcatttgctttaatgtctacattgactaaacaaataaaaacttcaaatttaggggtaaaaatgttgaatctcaagtacccgtgaatttgttttaatctattttctgcgcttgttctaagaaattgaaactttttggggtaaaaataacaaagaaaaacgataagctaacatgcatgtaagaaaggatgcatgataacagcaccgaaagagaagtcgaacctcgtccaatacaaaaaaacaaaaatctaacatgcatgtaagaaaccatacatgaaaacaacaccgaaaaagaaggcaaaccttgtttgtatctggaaaaatgaagaagagaaaaacatcaataataggaagtcaaaagttacacatttataaaagaaaatacaacagcaaagctacaattaaaaaacagaacaacaaaagtaccatgaacagagaaaaacgataagctaacatgcatgaaaacaacatcgaaagagaagccaaacctcgtccaacacgcatacatgaaaacaacaccgaaagagaagacaaaccttgtttgtatctggaaagatgaagaagaatagaaaagatggaagcgattaaccacgcaaagaagcaagaagcaaacaggagcaagtgcaaagtgtggtaaattagacacgtaaccacccaaagaagcaagaagcaaatgggagcaggtgcaaagtgtgataaattagacatgtaaccacccaaagaagcaagaagcaaataggagcaggtgcagagaaatcaaacacgtgtaagaaacatgggagtgggaaatgaaaagactaaaagataaaaaaattaaggaaatgaacatgtgtcccagccttaggtagggacattttagaattttccagagacttctcttttattagatagtatatagatatatcatattaaaaaaatatttattctatgggtgtatgttttcaataaaaatacattgttttcaaccagaactgtttcatattataattttttttttctcttcatttttttcctttaaaatcaaacatatgcaggcgtaggaaaagtcccgaaacccgaggcacgcacgcgtcagtgacatgcctgcacgcacttactcgccatgcgtgcgtttcatccttcgagctcgctcactgcatcaccgcacccaatcaatcccacccctccgtgcaatcaacaccaaacatgaatcaacggtccccaacgcatggaaccgaaccgcagagaataatcgctttgttgactcacaagagagagagagagacgatgacaaaagaggtgagtgaggatttcatttatagtttatagagagagagagcgttgacacctatccattttgaaaccttctaaactcactctctcactttctcactccctcactccctccgttgacgtttttgttttctttttctctgtgttctgaagaagttttagggtttcgttttgtttctctcttcggccacttcaggtcattttttccttttttgttttctgaatttttaaccgtttctttttgtttttttgtttgtgactctctctggtgttgtaatttgtagtgctgcattgctcttctggcttcggatttttttagccgtattatttttttcttttcaattttgctttgtgagaatggttgccttattttttatttttttctgaagttgaaatgtagtactgttttttttttcttagggttttggaagttgtttatgtgtttgcatgtgttggacatggatcttgcttttttgactgtttattttgaaggaaaagaggattttgccttggctacaaaccgtgtttcgtttcagaaatggagttttctgttgttgctggagttttgtatgtttttcttcactgttttgggtttgctcttttttcgttgttaaaagttgttatttatagcattttaggacttgtgttggttttcttttttataagttcttttagtaagtggaaaaccctaatttctgcaatgcatgtctttaacatttggttgggtttgctcttttttcgttgttaaagttgttatttatagcattttaggacttgtgttggttttcttttttataagttcttttagtaagtggaaaaccctaatttctgcaatgcatgtctttaacatttgggtgggtattttttgttgatgggttagatttatcttctggatgctgcttttactgaaggtggtttgaatgaatgcatgccttttcttttgttatctatgttagaggatggtacggcgttttagactgttatttgttacaaaggttagccatgttttaaaagtgttgtgtatatacatttaagtaacctttgctgcatttagtaatatttttgcaatttatttgttgaagcttagctcttgcttttattgttttttatttttatttttttggtatggaattagtaatatgtaatgatcgaacttaacattttgttgctgcctttttgttatgtattcatgttcaccaaaagtagtacattgatttttggaagacactcttcagtgacattatgattctcaagtgcttggttttgaattgtggttgtggtaaaacaatctttgattttgtggaaaatttagacaaatgctgcagatgtggctgcaagtgtggttgtttaggcttacaaaaccttgatatttctgtagcaattgcggatgtgggtcattaataccttgttcttagtattgaatgcttaccaaatttactttattatatttgagagttaaactggtttaattctctttgagaatgttatttatttatttttaaaaaaccaaacatggggaataagggattccaacttcagactcatgggagactaaaaagttttcttgtaccaaacgcctccttaaacttttgtcatcttcataattcttcgtttatggataatgtaatcccctgctttaccttatattcctaactttgtctatacaggctatggattcatttgagccagatggaaatgggaaggagtcactgccaccaccacctcctgttgttccctctgatattgtacctctcaaagcagaggaggtgctctgtacccctaccgagcataataagaaaaaggcttcccgacttccaatagccagatctggtctgggatcaaaaggaaataaaatacaattactaaccaatcacttcaaagttaatgttgctaaaaatgatgggcatttcttccattatagtgtatgtccttcgattagtttttggtttagtattaatatctgtgtttttgtttaagcttgtcacttaaagttgatgcttatgttatcacttcacttgatatgcaaacaggtggcttttacttatgaagatggacgccctgtagaaggtaagggtgtagggagaaagataatagatagggtgcaggagacatatcattctgacttaaatggtaaggactttgcatatgatggggagaaaagtctgtttactgttggctctcttcctcaaaacaagcttgagtttgaagttgttcttgaggatgtcacctctaacaggtagaagtaattagagagcatttagttgttgttttggctcttcaaattggttttcgtactattgtttcaatagcctttgatttattttttgttttctaggaataatggcaattgcagccctgatggtctaggggacaatgagagtgacagaaagaggatgcgacgtccttatcgttcgaagtcattcaaagtagagataagctttgctgcaaaaattccaatgcaggccattgccagtgccttacgcgggcaagagactgagaattttcaagaagccatcagagttcttgatatcattttgaggcagcatgctgctaagcagtaagtaaatagtgctttctttttcttagcgtgtggttaactgtttaatatttttttcttaacatgagtctatctgtacattgtttattgcagaggctgcttacttgtacgccaatcctttttccacaataatccaaataattttgctgatgtaggaggtggtgtcctaggctgtagaggattccactcaagctttagaactacacagagtggcctgtctcttaacataggttaaattcgttgcctgtgcaatcttctcaagtcaatatgttttgtctaattctagcaatctctaatttgtttagatgtgtcaactacaatgataatttctcctgggcctgtggtggatttcttaatttccaatcaaaatgtgagagatccttttcaacttgactgggctaaggtgaacaagttttctgaatactttttcatctcccatcattgatattgtaaggctcaaatttgattcccccctatccccttttaacattttaacaggccaaaaggaccctaaaaaatctgaggattaaaactagcccatccaatcaagaattcaaaatttctgggctcagtgaactcccatgcagagagcagacgtacttattttctttgttttcatattgttaatttcttacactgtatttgctgtattgtaatttttgagttgttctttaggtgatgtgttgaggtttttgatggtgtgtattctgcagttttactttgaaaggtaaaggtgggggggatggtgaagatggtaatgaggaaatcactgtatatgattattttgttaaggttcgtaagatagatctccgatactctgctgaccttccatgtatcaatgttggcaagcctaaacgaccaacatttttccccattgaggtaaattaagggttttttttgttctctaaactgcatttgtttgcatcaattcaggaggtacagattgatcttagcaacatattggttattaatgaattttctttcttttttcttggttcttttaggtttgtgaattggtatcattgcaacgatatacaaaagctctgtccacgcttcaaagggcttcattagtggagaagtcgaggcagaagccacaagagaggatgaaaattttgtctgatgtaaacgattttttgctacattttgagtagtataattttaattcatatgtctaggataagaaatcttactattaacttttactgaaggcactgagaacaagcaactatggtgctgaacctatgctccggaattgtggaatttctataagcactggcttcactgaagtggagggccgggtgttgcctgcaccaagggtatatatatatttatatatatatatagttatagttataccattatgtttatgaatcgttttattaattctattttgtatattaaaacaatgatcttttttgttgaggtttggaagtatcaatagtagttttcttttatggttagaaaatgattattgaatcttcttcaatagttgaagtttggcaatggtgaggatctcaatcctaggaatgggagatggaatgtcagcagagtggtatttaattcaattccctttcctgtgaagttttaatattttctccttaataacaatattggcttaggttctaactttttgcatgctgtgacgtacgaggactgttgctaactttcatgaatgcttcagaaatttgtggaaccatcaaagatagaaagatgggctgttgctaacttttctgcacgctgtgatgtacgaggacttgtacgggacctcattagaattggagatatgaaaggaattgtaagttctttaactgcatattttttggtgtgaaagagctattgactgacattatgttttctttgatttctgcagactatagaacaaccatttgacgtgtttgatgagaatccacagtttaggcgtgccccccctatggttagagtggagaaaatgttcgagcatatccaatctaaacttcctggggctcctcagttccttctctgtttgcttcctgatcggaaaaattgtgatatttatggttagtgttttttgtgtgattatatttttatgcccaagcaattttcaagagccctgaatagaaattgtctttttttcgttgaaggtccatggaaaaagaagaatcttgctgattttggaatcataaatcagtgtatgtgtcctttaagggtcaatgaccagtacctgactaatgttatgttgaagatcaatgccaaggttaatttaatattttggttatattgtacagtatctttgtacatgatcatataagcatttgcatgtaaaccatcttatcttaattttatagtaaaaatagatgaagttatggaaaccttcatgcccattcctcacttactaggataaggcgtggttgttatgattgatttttactgcatgtgcctgtaaaccatcttgtaaactgatgaaaaccttcatgcccttccctacttactattctaaggctttggttgttacaattaatttttattgcttagttgattcattatgaagggtgttttctttctgttgaattcttttattgttatgcagcttggtgggttgaattcattgttaggcgttgaacattctccttctcttcctgttgtttccaaagctcccaccctcattctgggaatggacgtgtcacatggctcacctgggcagactgacattccttcaattgctgcggtaaatgataatttgtcttgtgttttatatgaacagtgtttccaaatgcatatggaagcctaattttctggatgaaggtatattggtttttagttttggcctgcatgtctaatgtgtaaatatgcacatgcaggtggtcagctctagacactggcctctgatatcaaagtatagggcatgtgttcgtacgcaatctgcaaagatggaaatgattgataatttgttcaagctagtatctgaaaaggaagatgaaggcatcataaggttaaaatttgtcattttctggcagattcaagccactgtaaactaactccaaagaatcatttacaaaatatttacgagatcaaggacccacccaattgcatatttttttcagtttaaggacctaattaataattctagatagttcaggaatttgtttaatagtttagctgtttttgttttttccagttgcaataattgtatatgcattttctgttggtccatgtacaaggactgcctatactgatgggtttcatctattgcagggaacttttgcttgatttctatacaacttctgggaggagaaaaccggaaaatataatcatattcaggtatgtttttccttctttgagaatgcagcttctgtttatttttcttatttttgcattttgattgttacatctgtgtaaatgttcaacttttatgggtaaatcattatttcacctagtgagatgaggctttagttgttgtatataaaccatgtttgatgtttgatatatgttattattgtgaaattgttcaatgtgtcttgaagtatcttgctatttcaaataatatattatcttgtacattaaccttgtatttattttctatagattgacattcagatatatatttgatttaatgttaatgttattcatttgattcaactgaacattgttttttccgttttctatataatgtgtagggatggggttagtgagtcacaattcaatcaagttttgaatattgaactcgatcgaatcattgaggtactgatgctggtcaattgtgcttttttagtactaatcattagtcatagagaactaatctttaaaattttaggcttgcaaatttctcgatgaaaattgggagccaaaatttgtggtaattgttgctcagaagaaccaccacactagatttttccagcctggctctcccgacaatgtcccacctggcaagtgttctgggtctttacagtaagattttttaatttgaaagtatctgttcccttattatttttttttggcaggaactgttatcgacaataaaatttgtcatcccagaaattatgatttctacctatgtgcacatgctggaatgatagtgagtatcccagctatttaatatatatgtttctgtactgtttttctcgttttgaagttgcatgattgtggcttgtgtggctatctagttggcttttgtatcccttcttgacctttgtccgaagtatgcaagccttttcttatagaaatctatctttctttatctttttttaattccacttgtttgtaactgattttttattgctgatagtctgatagttaaagagaatatttactttgattctagttttttttttggtcagcatttactttgattctagtattccacttgtttgtaactgatttttttattgctgatagtctgatagataaagagaatctttactttgattctagttatttaaagaggtagtgtggaataaaggttggggattcttattttcattttattaaaatagagaaaactagttacagttgaagtatcttctatgaaatggtagttggttgcattactccattttttctgtaaactgaggaattcttccaacgtcaagtttcatttgcattgttattttgatctgagttgagtgcagtattatttctgctgcatcgggcttctaccatacatctttgtacatatttttagttgaactcaattttttttttgttgacgttgaataggatgtttgtaaacgttgttccccccgccccagaatgatctccctttgtacatttgattttgatataatcaactggtgtgtaaaggtccttttttgttttttctgccgtttcctctatgcattgcctggtcttgcaggcatttagggagttgtgaaaaaggtgccccttcacctgccctcaattactgtgttagtgttgtttataaagctgttgtacttgaactacttaatgccaattggttgttaagattacagacatggagggctatatttgattcctctttccacatgtatttataacctataaattaaattaaatgtaggtggacctagttgtgtgtggggaaaggtttttaaaattaaaaactttattaacatttgttttatattctccctctaattgtggtgcccagggaactagtaggcctacccattatcatgtgctgcttgatcaggttggtttctctccggatcagctgcaggagcttgtccattcattatcatatgtgtaagtggaaatttggacctatttgattgcattagactcattttacggtttcaggtaaagatcaatctaaacaatgtaaattgattgtgaatatgggcaggtatcagaggagcactactgccatttctgttggtaattaaattttgtacattatttattccaatagatggttattgttttgacctaattattattcatgattgaattttacctatatataatcttcctcgttgcagttgctccaatatgctatgcgcacttggctgctactcagttggggcagttcatgaaatttgaggacaaatctgaaacatcttcaagccatggtggattgagcggtgcaggtgctgttcccgtccctcagttgcctcccttgcaggagaatgtccgcaacacaatgttcttttgttgaggccttaatgctctgccctgtctcctcaagtggtgaaaatgctgtacataaaactatgtttctaatcttgcaagttatgcggacgaagtttatattgtggtagacttggtcttcttagccatatttagtctttctagcacaagccttttcaaatgttcggggaccttaccttactttttgtagcaagactctctttagcgcaacgtctttttgtagcaaggcttgatcttcagcacgtcttttgttaggcccccccttttttaaggtttaattgcactttttacctcgaatgctgtaatttatagtgaattttacttatctccaacaaattaccttggcgtattttattccaaatttttaagaaacttagattttattgtgttattttact

SEQ ID NO: 172 - DNA, 10133 bp, Glycine max
attaacgattcaaattgattttggtactgcatatcattaacgattcaaattgattttggtactgcatattatcaagaagaacaatataacgattgaaattgattttggtattgcatatcattattctatataagcaaaattagtattcaccataaaactaaatagagacaacatcttatcaagaagaagaatataacgatttagattgattttggtactgcatatcatttgctttaatgtctacattgactaaacaaataaaaacttcaaatttaggggtaaaaatgttgaatctcaagtacccgtgaatttgttttaatctattttctgcgcttgttctaagaaattgaaactttttggggtaaaaataacaaagaaaaacgataagctaacatgcatgtaagaaaggatgcatgataacagcaccgaaagagaagtcgaacctcgtccaatacaaaaaaacaaaaatctaacatgcatgtaagaaaccatacatgaaaacaacaccgaaaaagaaggcaaaccttgtttgtatctggaaaaatgaagaagagaaaaacatcaataataggaagtcaaaagttacacatttataaaagaaaatacaacagcaaagctacaattaaaaaacagaacaacaaaagtaccatgaacagagaaaaacgataagctaacatgcatgaaaacaacatcgaaagagaagccaaacctcgtccaacacgcatacatgaaaacaacaccgaaagagaagacaaaccttgtttgtatctggaaagatgaagaagaatagaaaagatggaagcgattaaccacgcaaagaagcaagaagcaaacaggagcaagtgcaaagtgtggtaaattagacacgtaaccacccaaagaagcaagaagcaaatgggagcaggtgcaaagtgtgataaattagacatgtaaccacccaaagaagcaagaagcaaataggagcaggtgcagagaaatcaaacacgtgtaagaaacatgggagtgggaaatgaaaagactaaaagataaaaaaattaaggaaatgaacatgtgtcccagccttaggtagggacattttagaattttccagagacttctcttttattagatagtatatagatatatcatattaaaaaaatatttattctatgggtgtatgttttcaataaaaatacattgttttcaaccagaactgtttcatattataattttttttttctcttcatttttttcctttaaaatcaaacatatgcaggcgtaggaaaagtcccgaaacccgaggcacgcacgcgtcagtgacatgcctgcacgcacttactcgccatgcgtgcgtttcatccttcgagctcgctcactgcatcaccgcacccaatcaatcccacccctccgtgcaatcaacaccaaacatgaatcaacggtccccaacgcatggaaccgaaccgcagagaataatcgctttgttgactcacaagagagagagagagacgatgacaaaagaggtgagtgaggatttcatttatagtttatagagagagagagcgttgacacctatccattttgaaaccttctaaactcactctctcactttctcactccctcactccctccgttgacgtttttgttttctttttctctgtgttctgaagaagttttagggtttcgttttgtttctctcttcggccacttcaggtcattttttccttttttgttttctgaatttttaaccgtttctttttgtttttttgtttgtgactctctctggtgttgtaatttgtagtgctgcattgctcttctggcttcggatttttttagccgtattatttttttcttttcaattttgctttgtgagaatggttgccttattttttatttttttctgaagttgaaatgtagtactgttttttttttcttagggttttggaagttgtttatgtgtttgcatgtgttggacatggatcttgcttttttgactgtttattttgaaggaaaagaggattttgccttggctacaaaccgtgtttcgtttcagaaatggagttttctgttgttgctggagttttgtatgtttttcttcactgttttgggtttgctcttttttcgttgttaaaagttgttatttatagcattttaggacttgtgttggttttcttttttataagttcttttagtaagtggaaaaccctaatttctgcaatgcatgtctttaacatttggttgggtttgctcttttttcgttgttaaagttgttatttatagcattttaggacttgtgttggttttcttttttataagttcttttagtaagtggaaaaccctaatttctgcaatgcatgtctttaacatttgggtgggtattttttgttgatgggttagatttatcttctggatgctgcttttactgaaggtggtttgaatgaatgcatgccttttcttttgttatctatgttagaggatggtacggcgttttagactgttatttgttacaaaggttagccatgttttaaaagtgttgtgtatatacatttaagtaacctttgctgcatttagtaatatttttgcaatttatttgttgaagcttagctcttgcttttattgttttttatttttatttttttggtatggaattagtaatatgtaatgatcgaacttaacattttgttgctgcctttttgttatgtattcatgttcaccaaaagtagtacattgatttttggaagacactcttcagtgacattatgattctcaagtgcttggttttgaattgtggttgtggtaaaacaatctttgattttgtggaaaatttagacaaatgctgcagatgtggctgcaagtgtggttgtttaggcttacaaaaccttgatatttctgtagcaattgcggatgtgggtcattaataccttgttcttagtattgaatgcttaccaaatttactttattatatttgagagttaaactggtttaattctctttgagaatgttatttatttatttttaaaaaaccaaacatggggaataagggattccaacttcagactcatgggagactaaaaagttttcttgtaccaaacgcctccttaaacttttgtcatcttcataattcttcgtttatggataatgtaatcccctgctttaccttatattcctaactttgtctatacaggctatggattcatttgagccagatggaaatgggaaggagtcactgccaccaccacctcctgttgttccctctgatattgtacctctcaaagcagaggaggtgctctgtacccctaccgagcataataagaaaaaggcttcccgacttccaatagccagatctggtctgggatcaaaaggaaataaaatacaattactaaccaatcacttcaaagttaatgttgctaaaaatgatgggcatttcttccattatagtgtatgtccttcgattagtttttggtttagtattaatatctgtgtttttgtttaagcttgtcacttaaagttgatgcttatgttatcacttcacttgatatgcaaacaggtggcttttacttatgaagatggacgccctgtagaaggtaagggtgtagggagaaagataatagatagggtgcaggagacatatcattctgacttaaatggtaaggactttgcatatgatggggagaaaagtctgtttactgttggctctcttcctcaaaacaagcttgagtttgaagttgttcttgaggatgtcacctctaacaggtagaagtaattagagagcatttagttgttgttttggctcttcaaattggttttcgtactattgtttcaatagcctttgatttattttttgttttctaggaataatggcaattgcagccctgatggtctaggggacaatgagagtgacagaaagaggatgcgacgtccttatcgttcgaagtcattcaaagtagagataagctttgctgcaaaaattccaatgcaggccattgccagtgccttacgcgggcaagagactgagaattttcaagaagccatcagagttcttgatatcattttgaggcagcatgctgctaagcagtaagtaaatagtgctttctttttcttagcgtgtggttaactgtttaatatttttttcttaacatgagtctatctgtacattgtttattgcagaggctgcttacttgtacgccaatcctttttccacaataatccaaataattttgctgatgtaggaggtggtgtcctaggctgtagaggattccactcaagctttagaactacacagagtggcctgtctcttaacataggttaaattcgttgcctgtgcaatcttctcaagtcaatatgttttgtctaattctagcaatctctaatttgtttagatgtgtcaactacaatgataatttctcctgggcctgtggtggatttcttaatttccaatcaaaatgtgagagatccttttcaacttgactgggctaaggtgaacaagttttctgaatactttttcatctcccatcattgatattgtaaggctcaaatttgattcccccctatccccttttaacattttaacaggccaaaaggaccctaaaaaatctgaggattaaaactagcccatccaatcaagaattcaaaatttctgggctcagtgaactcccatgcagagagcagacgtacttattttctttgttttcatattgttaatttcttacactgtatttgctgtattgtaatttttgagttgttctttaggtgatgtgttgaggtttttgatggtgtgtattctgcagttttactttgaaaggtaaaggtgggggggatggtgaagatggtaatgaggaaatcactgtatatgattattttgttaaggttcgtaagatagatctccgatactctgctgaccttccatgtatcaatgttggcaagcctaaacgaccaacatttttccccattgaggtaaattaagggttttttttgttctctaaactgcatttgtttgcatcaattcaggaggtacagattgatcttagcaacatattggttattaatgaattttctttcttttttcttggttcttttaggtttgtgaattggtatcattgcaacgatatacaaaagctctgtccacgcttcaaagggcttcattagtggagaagtcgaggcagaagccacaagagaggatgaaaattttgtctgatgtaaacgattttttgctacattttgagtagtataattttaattcatatgtctaggataagaaatcttactattaacttttactgaaggcactgagaacaagcaactatggtgctgaacctatgctccggaattgtggaatttctataagcactggcttcactgaagtggagggccgggtgttgcctgcaccaagggtatatatatatttatatatatatatagttatagttataccattatgtttatgaatcgttttattaattctattttgtatattaaaacaatgatcttttttgttgaggtttggaagtatcaatagtagttttcttttatggttagaaaatgattattgaatcttcttcaatagttgaagtttggcaatggtgaggatctcaatcctaggaatgggagatggaatgtcagcagagtggtatttaattcaattccctttcctgtgaagttttaatattttctccttaataacaatattggcttaggttctaactttttgcatgctgtgacgtacgaggactgttgctaactttcatgaatgcttcagaaatttgtggaaccatcaaagatagaaagatgggctgttgctaacttttctgcacgctgtgatgtacgaggacttgtacgggacctcattagaattggagatatgaaaggaattgtaagttctttaactgcatattttttggtgtgaaagagctattgactgacattatgttttctttgatttctgcagactatagaacaaccatttgacgtgtttgatgagaatccacagtttaggcgtgccccccctatggttagagtggagaaaatgttcgagcatatccaatctaaacttcctggggctcctcagttccttctctgtttgcttcctgatcggaaaaattgtgatatttatggttagtgttttttgtgtgattatatttttatgcccaagcaattttcaagagccctgaatagaaattgtctttttttcgttgaaggtccatggaaaaagaagaatcttgctgattttggaatcataaatcagtgtatgtgtcctttaagggtcaatgaccagtacctgactaatgttatgttgaagatcaatgccaaggttaatttaatattttggttatattgtacagtatctttgtacatgatcatataagcatttgcatgtaaaccatcttatcttaattttatagtaaaaatagatgaagttatggaaaccttcatgcccattcctcacttactaggataaggcgtggttgttatgattgatttttactgcatgtgcctgtaaaccatcttgtaaactgatgaaaaccttcatgcccttccctacttactattctaaggctttggttgttacaattaatttttattgcttagttgattcattatgaagggtgttttctttctgttgaattcttttattgttatgcagcttggtgggttgaattcattgttaggcgttgaacattctccttctcttcctgttgtttccaaagctcccaccctcattctgggaatggacgtgtcacatggctcacctgggcagactgacattccttcaattgctgcggtaaatgataatttgtcttgtgttttatatgaacagtgtttccaaatgcatatggaagcctaattttctggatgaaggtatattggtttttagttttggcctgcatgtctaatgtgtaaatatgcacatgcaggtggtcagctctagacactggcctctgatatcaaagtatagggcatgtgttcgtacgcaatctgcaaagatggaaatgattgataatttgttcaagctagtatctgaaaaggaagatgaaggcatcataaggttaaaatttgtcattttctggcagattcaagccactgtaaactaactccaaagaatcatttacaaaatatttacgagatcaaggacccacccaattgcatatttttttcagtttaaggacctaattaataattctagatagttcaggaatttgtttaatagtttagctgtttttgttttttccagttgcaataattgtatatgcattttctgttggtccatgtacaaggactgcctatactgatgggtttcatctattgcagggaacttttgcttgatttctatacaacttctgggaggagaaaaccggaaaatataatcatattcaggtatgtttttccttctttgagaatgcagcttctgtttatttttcttatttttgcattttgattgttacatctgtgtaaatgttcaacttttatgggtaaatcattatttcacctagtgagatgaggctttagttgttgtatataaaccatgtttgatgtttgatatatgttattattgtgaaattgttcaatgtgtcttgaagtatcttgctatttcaaataatatattatcttgtacattaaccttgtatttattttctatagattgacattcagatatatatttgatttaatgttaatgttattcatttgattcaactgaacattgttttttccgttttctatataatgtgtagggatggggttagtgagtcacaattcaatcaagttttgaatattgaactcgatcgaatcattgaggtactgatgctggtcaattgtgcttttttagtactaatcattagtcatagagaactaatctttaaaattttaggcttgcaaatttctcgatgaaaattgggagccaaaatttgtggtaattgttgctcagaagaaccaccacactagatttttccagcctggctctcccgacaatgtcccacctggcaagtgttctgggtctttacagtaagattttttaatttgaaagtatctgttcccttattatttttttttggcaggaactgttatcgacaataaaatttgtcatcccagaaattatgatttctacctatgtgcacatgctggaatgatagtgagtatcccagctatttaatatatatgtttctgtactgtttttctcgttttgaagttgcatgattgtggcttgtgtggctatctagttggcttttgtatcccttcttgacctttgtccgaagtatgcaagccttttcttatagaaatctatctttctttatctttttttaattccacttgtttgtaactgattttttattgctgatagtctgatagttaaagagaatatttactttgattctagttttttttttggtcagcatttactttgattctagtattccacttgtttgtaactgatttttttattgctgatagtctgatagataaagagaatctttactttgattctagttatttaaagaggtagtgtggaataaaggttggggattcttattttcattttattaaaatagagaaaactagttacagttgaagtatcttctatgaaatggtagttggttgcattactccattttttctgtaaactgaggaattcttccaacgtcaagtttcatttgcattgttattttgatctgagttgagtgcagtattatttctgctgcatcgggcttctaccatacatctttgtacatatttttagttgaactcaattttttttttgttgacgttgaataggatgtttgtaaacgttgttccccccgccccagaatgatctccctttgtacatttgattttgatataatcaactggtgtgtaaaggtccttttttgttttttctgccgtttcctctatgcattgcctggtcttgcaggcatttagggagttgtgaaaaaggtgccccttcacctgccctcaattactgtgttagtgttgtttataaagctgttgtacttgaactacttaatgccaattggttgttaagattacagacatggagggctatatttgattcctctttccacatgtatttataacctataaattaaattaaatgtaggtggacctagttgtgtgtggggaaaggtttttaaaattaaaaactttattaacatttgttttatattctccctctaattgtggtgcccagggaactagtaggcctacccattatcatgtgctgcttgatcaggttggtttctctccggatcagctgcaggagcttgtccattcattatcatatgtgtaagtggaaatttggacctatttgattgcattagactcattttacggtttcaggtaaagatcaatctaaacaatgtaaattgattgtgaatatgggcaggtatcagaggagcactactgccatttctgttggtaattaaattttgtacattatttattccaatagatggttattgttttgacctaattattattcatgattgaattttacctatatataatcttcctcgttgcagttgctccaatatgctatgcgcacttggctgctactcagttggggcagttcatgaaatttgaggacaaatctgaaacatcttcaagccatggtggattgagcggtgcaggtgctgttcccgtccctcagttgcctcccttgcaggagaatgtccgcaacacaatgttcttttgttgaggccttaatgctctgccctgtctcctcaagtggtgaaaatgctgtacataaaactatgtttctaatcttgcaagttatgcggacgaagtttatattgtggtagacttggtcttcttagccatatttagtctttctagcacaagccttttcaaatgttcggggaccttaccttactttttgtagcaagactctctttagcgcaacgtctttttgtagcaaggcttgatcttcagcacgtcttttgttaggcccccccttttttaaggtttaattgcactttttacctcgaatgctgtaatttatagtgaattttacttatctccaacaaattaccttggcgtattttattccaaatttttaagaaacttagattttattgtgttattttactcctaacgtaactgtattttttactcctattttttttttttattttcttggcaaattttatccaattttttttttcaaattt

SEQ ID NO: 173 - DNA, 9053 bp, Glycine max
agcaacactttagagaaaagaaagaagtctttttgacaactaatactaatcaacacgttaaaagaaagataaagatataaagatacacaaaaggagtaaaaagaaagagaaatattaataagatatgtgattagatataagaataaaaagtatcaatatcttttttttaatcattagaaaaaagaaattgattctgtaaaacgtgacaccttttgattggttggaaggagaatacgtaaaataaagcgttatggtcgaacacagtttgtttaagtgtgcataagttgacagaaacactatatatctgtctctcacactccaatcgcagcaacgtttcttcgtgtattcaattcatctctttgttttctcttctctctgctacaacgctgaaggtaacaatgttcttctcgttgtttctttattctctctaagtagacatgcatacatacgtacattttcttgttttgtagagtgagttcttgttttttttttatgtaccctctgtttggctctctctaagtacgttaaggtaacaaacaatgctgttgttctcttctctcaactatgctgaaggttaccacgttatgttgtttggtttctgtttttctttttcttttcttttttcgtttatgctgttattgttgtcaaggtgtgtgttcttggtgtttctggttttaaaattcttgtgttgtggatgtatgaatttccattattaacttttatgcgtgtgtttagccagtagctaatactttttagcttgcatttggcctctttttatgaccaaaagagggaaaaaaattaattattttgtgatttgtcattggtcactgcacggagagcaccatggcatgcttgtttttgtttttttttctgtggcagttgatactttattaggacaatgcaacttgtattttttatattttatgcgttcatatgtaaatttatgatgttaccttacccgataggaagaaggacttagaggaggaaaaaacaggcctgttaaggcccttatcactacaattctgttatttgttagaattttgttacaattctgttgttgctaataaatatatagctcaatcgtgcttatatatggctactcgaatgctagtgcctgtttcttgttattgcttctaacattaccttagtgaaatataccttcaagaaaaaaattaacagcactgttgtgactaacgttcttctttatgtccagtttaaaatatttttgtcgaaggtgcttatacatatttgttaggcattctttttgtcgaaggtgctttaacaactgagttttattgctcctagctgaatcaaaagtgtagtactctagtggtattattagtatgcagataaaaaaaatttcaagtagttgtacttatcttttattattacgaaactgcactcaactagagcctaaattaatttgcattccatcacgtatttctattttttgtttgaatagcaaaaaaattagtcttactttttagcaggatttgagaaatggaggtctcaaaacgtgtgcctatggcgaggaaagaggttgggtccaagggagagcccagacaactattagccaaccattttggagtttgcctagtcaagcccaaggatgatattgatggctacttctaccattatgatgtatgttttcttatctattttgtcacatctcttgtgtgcacgcacgcatgtgaagtatatccatattaatgattgttgatttaatattataaaagtataaataattacatattgtttggttaggttgccatgagttatgaagatgggaaccctgttgaggccaagggtgtagggagaaaggtcttaaatcaagtttgtgaaacatatgttgaactgagaaacatgagttttgcatatgatggtgaaaaaagtctattcactcttggtcctctagcaagtcagaggcttcaatatcctgttgtgttggaggatgtttcatcaaggaggtaaacaaacaagcaatatgctgtcatcacattagcactgtgattatgtgtatactagttttgttgtgttgtgttgtatttatcacaagagggcattaattgtttttcagggttggaaagaatggaaaccctgctgagagtcctaagggaggatatacaaaaagaatgagaattaggcatcagtttcggccaaaaactatcaacgtggatatcaaatatgcagccaaaattccattgcaagcaattgaagatgcattgcgtggtcgggattctgagaaatctcaggaagcagtgagggttctagacatcatactgagacagcattctgcaaaccagtatgtcaaaacataaatttagttaagttgttttcattattcgaagaaaaatgtcagtgacacactctaacatacttattgttagctcaaatgaaattcatttggataacaagaatgggagtctcaactcctcgtattaaacatgtgtcattcatggtttttaataaattttaaccaatagtaaattatgtgttgctagcactcctcttgcttgaaacttgaaatcctgtttaccttggatgctttttttccaggggatacctccttgttcgccaatccttctttcatgacaatcgaagaacctgtactgatataggaggtggtgtgcaagggtgccgcggttttcattcaagctttcgagtcacacaaggaggtttatctctcaacatgggtaagattctcaagtggaatgcttggaaatacatgttacttttgttatggttgattgtttaatttgttgttcttttgtaaagatgtgacaaccacaatgattgtaaagcctggccctgtggtggacttccttctccagaatcagagtgttcagaacccaaactacattgattggaccaaggtgatagttattgctattctatctagtaggagaggtttcatgtgcatgaactgtggttgttatatttatgattattttcatttaggcaaagagaatgctgaagaacctaagaatcagggctaatggtgttgagttcaaaatctctggattgagtgataacacttgcaggaatcagaagtaagtttttcttgtgcttactccatttacagtaaacgaattttattttgatacattgtgagattaaagttttttactctatttatacaaatctggcttatttgtttcttacagatttcttttaaggcaaaagggtacgaatggtgaagtgcaggaaagggaaatcacagttcatgactactttacacgccaaaaactgattggcctgaactattctgctgacatgccatgcatcaatgttggcaaaccaaaacgcccgtcttattttccaatagaggtgctattgagtttaattactgaaaaaatttatattgtcgacaaataagaaatcatctttggtatgatttttaaagtagttattataatggctaagaatcgtatcattcacagtcaattgtgattagataacagaataatatattatttgttcatactcgttttactattttggaagagtttacaatatgattttattcttgttttgcagctatgtgaaatggtctcgttgcagcgttacaccaaggctctaacaaatttgcaaagggctcagctagtggagaagacaaggcaaaagccccaagttaggagacaagctttggaagatgtatgtggaaaattttaaaactgaaggaacctagtaacacttttttttgttgtatgaaatggttgtttatatttttttgcaggccttaagaagcagcagatatgacgatgaacctatgcttcgctcttctgggattaccattgaacctaactttgttagactcgttggtcgtgtattggaacccccaaaggtatgtgtcatttgatcatgttctaataaaagatcgaataaattcataaattaaaattaccatataaacaagttaaaatcagctttttgagaagttgaataagagaacttctactagatttgaagtgagtaagttgagtttaacttatgaaagaagtttatttcagtttactttcttatttttttcttttcagcgggtttatcagatatgagccaacttcttatccttattttgaaaaatactagtaacacattctctaacacattctttttaacacacactaaaccattagttggactttattaaaaactgcaaaatcagttattaaatgagaagattgactcagtaattaatttctaataaattttagttaataatagtgtattaaacaaaaatatgtgaaaaagtgtgttactaatatttctgattctgtttttgctatgcatatatgaattgcttttttatgtcaatatatactattgcagcttatagttggaggagagaagagcatcattccccggaatgggcgctggaatttcaacaataaggtttatttttgctattgttttaatgatacggctgtgtttgtattagcatttagcatgttaaacgtcaaagcttcttttcagtaaaaattgcattcaacatgtattcaaacgcgagaaatacttaaaccaaacaaacacactaagttgaaccaagtttagagtggtttctctaacaatgagtatcatctttcagaaactatatgaacctttgatgattggtcgttgggccattgtaaacttctcaagtcggtgtgacacaagactcctgatagaactcattaggaggtgtgctgcagctaaagggatggtaagatttcccaagaattgtatatgtcgattttattaatcttatttacaactgaaccaaaaagtcaaattttactacaagggtttttctatcccatgcaactttgcacagattaagccaatctacctaatataagaagaatgatggaattgacttgtttattcaaaatcaattaactcaatctgcaaatgcaatcaaaaactcaaaatgtcaaattcaattcattgttgttctaaatgtatttttcttttgtagaccatgagcaatagtctctttgataaagtaattgaagaggatggttgcttcatacgtgaaccaccaaatgtcagggtagagagaatgtatgcaaagctgaggaccactctgccgcacgagaaacctcactttctgttgtgtattcttccagagaaaaagaattctgacatttatggtaggataaacaacttctatacatagtttaagttcttctaaactcttcagttaacacttctctattctaaaatcctaatatcaatatgtaggtccttggaagaagaaaagtcttgttgaagaagggattgtaacacaatgtattgcaccaacaaagattaatgatcaatacattactaatgtacttttgaaaattaatgcaaaggtatatatatgtcttcaaatattgagtttattttgaaatactataacttttgaagagaatataggttgttaaccgatatactgatggtataaaataattttatattattatctaatcacaaatcactatataaataagttcaccaaccatgctacctagttataataaaatctttttatttttataataatgtatgcacaatttctttgatgcagtatggtgggatgaattcgtatctgtcagttgagctttgtaattccattccatttgtttcagctgtaccaaccttgattcttggtatggacgtttctcatggatctcctggtcgatcagatgtgccctctattgctgcggtatgatcttgatcatgtttgcaccatcatgttactacaagtttgcatgtagtgagtgttattatataatatatattcaggttgtgagctcaagatgttggcctcaaatttcacgttatagagcttcagttcgcacacaatcatcaaaagttgagatgattcaatctctattcaagcctgtggctaatactaataaggatgaaggtatcatcaggtgagagcaagagcatattctctaatgatgttatgtgggtgtttattcattgaatgtgtttccttctgtctcttttgatcaaatactaatctattttgttgtttcaatttgcagggaggtgctgttggactttgaaattacttcattcaaaagaaagcctcaacaaattataattttcaggtatatttaaattgattttcaataatttggattttagtcaagaaatatcttttggtgggtagtacatttcttatattacaattatggtgtaaacttctggtctcaattatcagcgccacgtgttttattttagggatggagtgagtgaatcacagttcaaccaggtgctcaatattgagttaagtcaaatcattgaggtactcatacccactaattaatttatatttcgcatctgatagcactattccatgattgaaattgaagtcacctagtttaatcgaaattggattttcaggcatgcaaacaccttgatgaaaaatgggatccaaagttcactttgattattgcccagaagaatcatcatactaggttctttcaggccaatgctagagatcaaactaatgttccaccaggtttgtcaccttaacagcaaaaaaataaatcaaatttgtatttgtcgatttctcttaatcctctatttgctgtgtgcaggaaccgttattgacaacactgtctgtcatcccaaaaacaatgacttctacttgtgtgctcaagctgggatgattgtaagtaccattttcaatgttaaatttgtgtcttttttggcttaaatttgtttttatttctgatatatatttttaatttttgtatctgataaatgataaatttttctttcgaattggatccctaatatttgaatccctaatttttctttcggcattgactctcttctccctttctagctgtgccactttggacaacctctttccccctttggccatggcggaatccaccgtcgtgaccctcccggaactcctctccgtcaccgccgtgggcctggccccctccggcggcatcttggtgggcgtgaacctggagttccctggtttcccttgttgtcaccgctgacgtccaacatcgagatgtgcatctcgcacattggttggtggtgggtttcaatattttttgtgttttttattctgatttcaagattgattttttttttttttgttcttgattctgttgccactgtggtgggttcgcggtattggttgctggtgagttttttggtactttttggttcacggaaagatgaagaagacaaagtgacaaagtggggtttcacagatgggtgaagaaaagggggtggtggaagaaaggggttgcaggaggaggaagaagacacgacgtcatttttacttttttaacagagaacaaatcttcgtgtaatctcactcactcaacttgtacacttaattgatatcacgcgtcacaccaacgtgtttggttataaacagttaagggatttcaattaataacagagacctcaaacaaaatatttaaaatattaggacccgattcaaataaaaaaaattatcagtaaccaaatgtaaaagtcaaatatatatataaaaaagaaacatatttaagctatcattttttatggcatgatattgacctagcaataacgtcaatcttcaatcaagatatataggcaatataactgtcaatcttcaaccaagatatataggcaatataacttttaggcttaattgtattttttattcttttattattgtccactatcaagttcaatttagtcattctactatgttaactgtgcagttataagttcattcattaacttttgaatgtcaaaatttaaagggatcaaaatgcaattaaaccttacttctaataagccatcattaagttcttttatttatcctcgattaagttaaattaaataatattcctaagatgatactgaactcctaataatgcctgcaattttctactgtgacaaacctgattttgttccaacaggggacaactcgacctactcactaccatgttttacacgatgaaatcggattctcagctgatgaagtgcaagaattagtgcattcattgtcttatacgtaagtacatgtagtcacaaatctcatacttaaaaattcaaaaatctctcctacagacgattttgcaacctttctatacttaaaaattcttctaatcttttacaggtatcagaggagcacaactgctgtatcattaggtataatttccattttccctgtatatccaagttttctctaaactatgacttgtacatactatattatattattttaggatctccctcctctaaagtgaatcactcatcattgtaaagtaataaatttcagttattgaagagaaaatcaattatcaatattattgcctctaaatgcataacaactcatagatgtttgagaatatcgatcagttgttaaaattttctcaaatctcaacaacgatgactgagattacttgcttatttgcaccttaaagaagtcaaattgattgttaaaaggttgtagtcaaatgatttctgtttgcaagcatatatatgattctgatgaaggtgtactctcttatgtattattgcagtcgctcccatttgctatgcccacttggcagcagcccagatggcacaatttatgaagtttgatgaacattctgagacttcttcaacccatggtggactcacatctgctagcgcacctttagtacctcaattaccacgtcttcacaaacaagtcatcaactccatgttcttttgttaatattttacatcatcttccttccacaaaaatttaattataaatttgacttttctgctgtccctcccttttgaagctgttctcgtactactcattcaaaaagatagcattttaagagttatgttatatttaattgtaaaaatattaacataactctcaaaaacgtcatgtcgaaggaacagcttggacagggaccagagagaagccaatttttcatatgaatgcctgtcattaggaactatctaggattgtttaaaatcgaatcaaatcgagtgtaaaactgaaaattgatccaagaaatcaatggtgattgatttggtttaattctctaattttccaaaccgcggttgggttcggttctcttaat

SEQ ID NO: 174 - DNA, 9053 bp, Glycine max; identical to SEQ ID NO: 173

SEQ ID NO: 175 - DNA, 5600 bp, Glycine max
gataacagaataatatattatttgttcatactcgttttactattttggaagagtttacaatatgattttattcttgttttgcagctatgtgaaatggtctcgttgcagcgttacaccaaggctctaacaaatttgcaaagggctcagctagtggagaagacaaggcaaaagccccaagttaggagacaagctttggaagatgtatgtggaaaattttaaaactgaaggaacctagtaacacttttttttgttgtatgaaatggttgtttatatttttttgcaggccttaagaagcagcagatatgacgatgaacctatgcttcgctcttctgggattaccattgaacctaactttgttagactcgttggtcgtgtattggaacccccaaaggtatgtgtcatttgatcatgttctaataaaagatcgaataaattcataaattaaaattaccatataaacaagttaaaatcagctttttgagaagttgaataagagaacttctactagatttgaagtgagtaagttgagtttaacttatgaaagaagtttatttcagtttactttcttatttttttcttttcagcgggtttatcagatatgagccaacttcttatccttattttgaaaaatactagtaacacattctctaacacattctttttaacacacactaaaccattagttggactttattaaaaactgcaaaatcagttattaaatgagaagattgactcagtaattaatttctaataaattttagttaataatagtgtattaaacaaaaatatgtgaaaaagtgtgttactaatatttctgattctgtttttgctatgcatatatgaattgcttttttatgtcaatatatactattgcagcttatagttggaggagagaagagcatcattccccggaatgggcgctggaatttcaacaataaggtttatttttgctattgttttaatgatacggctgtgtttgtattagcatttagcatgttaaacgtcaaagcttcttttcagtaaaaattgcattcaacatgtattcaaacgcgagaaatacttaaaccaaacaaacacactaagttgaaccaagtttagagtggtttctctaacaatgagtatcatctttcagaaactatatgaacctttgatgattggtcgttgggccattgtaaacttctcaagtcggtgtgacacaagactcctgatagaactcattaggaggtgtgctgcagctaaagggatggtaagatttcccaagaattgtatatgtcgattttattaatcttatttacaactgaaccaaaaagtcaaattttactacaagggtttttctatcccatgcaactttgcacagattaagccaatctacctaatataagaagaatgatggaattgacttgtttattcaaaatcaattaactcaatctgcaaatgcaatcaaaaactcaaaatgtcaaattcaattcattgttgttctaaatgtatttttcttttgtagaccatgagcaatagtctctttgataaagtaattgaagaggatggttgcttcatacgtgaaccaccaaatgtcagggtagagagaatgtatgcaaagctgaggaccactctgccgcacgagaaacctcactttctgttgtgtattcttccagagaaaaagaattctgacatttatggtaggataaacaacttctatacatagtttaagttcttctaaactcttcagttaacacttctctattctaaaatcctaatatcaatatgtaggtccttggaagaagaaaagtcttgttgaagaagggattgtaacacaatgtattgcaccaacaaagattaatgatcaatacattactaatgtacttttgaaaattaatgcaaaggtatatatatgtcttcaaatattgagtttattttgaaatactataacttttgaagagaatataggttgttaaccgatatactgatggtataaaataattttatattattatctaatcacaaatcactatataaataagttcaccaaccatgctacctagttataataaaatctttttatttttataataatgtatgcacaatttctttgatgcagtatggtgggatgaattcgtatctgtcagttgagctttgtaattccattccatttgtttcagctgtaccaaccttgattcttggtatggacgtttctcatggatctcctggtcgatcagatgtgccctctattgctgcggtatgatcttgatcatgtttgcaccatcatgttactacaagtttgcatgtagtgagtgttattatataatatatattcaggttgtgagctcaagatgttggcctcaaatttcacgttatagagcttcagttcgcacacaatcatcaaaagttgagatgattcaatctctattcaagcctgtggctaatactaataaggatgaaggtatcatcaggtgagagcaagagcatattctctaatgatgttatgtgggtgtttattcattgaatgtgtttccttctgtctcttttgatcaaatactaatctattttgttgtttcaatttgcagggaggtgctgttggactttgaaattacttcattcaaaagaaagcctcaacaaattataattttcaggtatatttaaattgattttcaataatttggattttagtcaagaaatatcttttggtgggtagtacatttcttatattacaattatggtgtaaacttctggtctcaattatcagcgccacgtgttttattttagggatggagtgagtgaatcacagttcaaccaggtgctcaatattgagttaagtcaaatcattgaggtactcatacccactaattaatttatatttcgcatctgatagcactattccatgattgaaattgaagtcacctagtttaatcgaaattggattttcaggcatgcaaacaccttgatgaaaaatgggatccaaagttcactttgattattgcccagaagaatcatcatactaggttctttcaggccaatgctagagatcaaactaatgttccaccaggtttgtcaccttaacagcaaaaaaataaatcaaatttgtatttgtcgatttctcttaatcctctatttgctgtgtgcaggaaccgttattgacaacactgtctgtcatcccaaaaacaatgacttctacttgtgtgctcaagctgggatgattgtaagtaccattttcaatgttaaatttgtgtcttttttggcttaaatttgtttttatttctgatatatatttttaatttttgtatctgataaatgataaatttttctttcgaattggatccctaatatttgaatccctaatttttctttcggcattgactctcttctccctttctagctgtgccactttggacaacctctttccccctttggccatggcggaatccaccgtcgtgaccctcccggaactcctctccgtcaccgccgtgggcctggccccctccggcggcatcttggtgggcgtgaacctggagttccctggtttcccttgttgtcaccgctgacgtccaacatcgagatgtgcatctcgcacattggttggtggtgggtttcaatattttttgtgttttttattctgatttcaagattgattttttttttttttgttcttgattctgttgccactgtggtgggttcgcggtattggttgctggtgagttttttggtactttttggttcacggaaagatgaagaagacaaagtgacaaagtggggtttcacagatgggtgaagaaaagggggtggtggaagaaaggggttgcaggaggaggaagaagacacgacgtcatttttacttttttaacagagaacaaatcttcgtgtaatctcactcactcaacttgtacacttaattgatatcacgcgtcacaccaacgtgtttggttataaacagttaagggatttcaattaataacagagacctcaaacaaaatatttaaaatattaggacccgattcaaataaaaaaaattatcagtaaccaaatgtaaaagtcaaatatatatataaaaaagaaacatatttaagctatcattttttatggcatgatattgacctagcaataacgtcaatcttcaatcaagatatataggcaatataactgtcaatcttcaaccaagatatataggcaatataacttttaggcttaattgtattttttattcttttattattgtccactatcaagttcaatttagtcattctactatgttaactgtgcagttataagttcattcattaacttttgaatgtcaaaatttaaagggatcaaaatgcaattaaaccttacttctaataagccatcattaagttcttttatttatcctcgattaagttaaattaaataatattcctaagatgatactgaactcctaataatgcctgcaattttctactgtgacaaacctgattttgttccaacaggggacaactcgacctactcactaccatgttttacacgatgaaatcggattctcagctgatgaagtgcaagaattagtgcattcattgtcttatacgtaagtacatgtagtcacaaatctcatacttaaaaattcaaaaatctctcctacagacgattttgcaacctttctatacttaaaaattcttctaatcttttacaggtatcagaggagcacaactgctgtatcattaggtataatttccattttccctgtatatccaagttttctctaaactatgacttgtacatactatattatattattttaggatctccctcctctaaagtgaatcactcatcattgtaaagtaataaatttcagttattgaagagaaaatcaattatcaatattattgcctctaaatgcataacaactcatagatgtttgagaatatcgatcagttgttaaaattttctcaaatctcaacaacgatgactgagattacttgcttatttgcaccttaaagaagtcaaattgattgttaaaaggttgtagtcaaatgatttctgtttgcaagcatatatatgattctgatgaaggtgtactctcttatgtattattgcagtcgctcccatttgctatgcccacttggcagcagcccagatggcacaatttatgaagtttgatgaacattctgagacttcttcaacccatggtggactcacatctgctagcgcacctttagtacctcaattaccacgtcttcacaaacaagtcatcaactccatgttcttttgttaatattttacatcatcttccttccacaaaaatttaattataaatttgacttttctgctgtccctcccttttgaagctgttctcgtactactcattcaaaaagatagcattttaagagttatgttatatttaattgtaaaaatattaacataactctcaaaaacgtcatgtcgaaggaacagcttggacagggaccagagagaagccaatttttcatatgaatgcctgtcattaggaactatctaggattgtttaaaatcgaatcaaatcgagtgtaaaactgaaaattgatccaagaaatcaatggtgattgatttggtttaattctctaattttccaaaccgcggttgggttcggttctcttaat

SEQ ID NO: 176 - DNA, 11469 bp, Glycine max
ttaattattgtatatatatatactaggcttaaattgttgttttaatccctcaatttagggtggatactttttcaagtccatgaattttaataaattattttttagtctctaacataatatattaatattttatgtcatttttttagtattttgtgacattttaaatgaaatttaaaataaattagtattatgatttaatttgaaaatagtccattttcttgtcaatatggtttcaacaatttttaaaataattataaaaattgatctctggtattaaaactagttttaaataaaacataattagtgttttagactctgaatttagggtgtatatttttttagtcttaaaatttaaaactattttttttcctgaactttaacattgttatctatcacataataaaattatactttgcgatagtatttaactttcataaattattttataatttttttgtcattaaaattatattttaaacttgtcacaaaaatgttaaagaccaccacaaaatgttgatttattatctcatagaataaaaaaataatttatcaaaatttagaaatttataaaaatatttttaaatttcaggaattaaaataacacactcactacactgaagaactaaaacaataattaagtttatgtactaatatatattttattaattaaatataataaataaatacataaaaaaattatatatataaaatttataaattataaaattattacaagatacgagatactaattataaaatttataaaagctagttaattgtattttgtaaatcacataatcattgcaagaaaaaaaaagtaaaataaataattcaattaatattataaattcatgacaatcatccctctcaaatttctctttatttctttactaatttcacttctatctcctatcattttttgataacaaatatgagaaataaaaatataaaatttaattccaaaaaatataaaaagtgtgagcagtcaactttttattgtcactgagatacaaatttgttactgaaataattgagaacaaataaggaatttgttactgaaataattgaaaacattattgactaaattggataaaaatatcagtaagatatcatatttgaacgtatatataagtaatttttttgttggacaaaaatatcaatatttttttattaaagaaaaatatgagtgatttttttacctacatgtacattgaacagaaaatattaataaattattattattagaaaaaaatattaataattttttattaaacctatatatcataatgtttcttttgaactaatttgttcataaaaatttatttcatttaaaaataaaataattttatgataaatttttattatttttttatcattacaaatataacattataataataattaaaaaaatatattaacaaacataatttaaaacaaaacaatattattcacgcatactttattaattgtgatggagaaaaaaaattaactgccagcgttgcagttgttatactttcttatatttatttgtcagtgaattagaagcaaaagtgactattttttttaataccttttctggttgtcatcctctttccactaaatcccaccaaaaacccttcaaaatcccaaaacccttccaaagataagttgcttgggttcttccttctaccgcccaccgtcccaggattgaactcaactcaggaaactcggactcgtggaatgaacgatggaggttgcgattacgagaggttagggcattttgatttttcattgtctactctttctttgattctgttttttgattttttttttgttctttttcttttcccttgtacgttctgtgtttgattaagcattttggttcttcccctctgattctcggaaaagtaatgaactccaagcgtttttggataaaaaaaagtccattctgtgtcttgttacgtccaaaacgccgtttccttgtgtcagtgacaaacgatttttggccactccgcgatgtcgctgggtaacggtaacgccgcggtccgacaccgagatgttgcaaacgatattgtcgttaccgaccaatatttaaaatcttttcaaaacctgaaccagttttctttttttattattatttggtggtttaggttttcatagattattaggtgtttttgctgattcattgtctatgttccttaggtgtttttagtgctattctccgatcagaattgcagtttcacgtcgggaacctaagcctacttttagtgtaaacatttattatgaggaatatcgaggtgaaactccatttttgattggtgcttaaggaactgcatctaagttttttttcctgaaaggattttagtgcgtagatttgattaaaactaattagtacttatagctatatgttctgtacatgtattatctttatctttaaatagtatctcattttgtatgcaatgtctgcagtttgacatttgctttttaatatgcttatgtttttagctagctcgagccttttttggtggaactagtgttttggtaatcttcatgttccttattaagtttaataattcataataaacactttgtctttatttctgcatagactgctatatcttggtatcatataaaaaatggtcttatataatattcactgcaaatgatgtgttgcccttttacacatttggttcatgttgatatggattatgatatccttctttggatttttttaacgcaaatttatatagcaagcactgcaaatgatgtgttaccattacttatcaatcaatatttaaggttaaaaataaaaacacagactgtgctaatcatataggagtggccaaaacaaatttgagcaatcttttttgtttcttttctttaattacagacccatggtgcttcgtggaaacattcttcttttctaccccagcttgatgtgataatggatatatgacactatcctttagagaaaaactgcatctaactaagctactattcacaggacagataatggtgtgaatttggattgattttcaccatgggttgctttacataactttcatgcggtatttgtttcatacgggtcaaactagcatttctttttttgatcagcaaaagtaagattgtaatatatatagtaataatatcagtacaaggggtactgttgtatatacgacctagcaccatattatgcagaactatggtgtcctaatacgagctatacagcaagaattaagtagccatagatctgactgtaagcttggcgcccaactacacaatatctatattctatatgctaatcccccctgattacaaaacccatccctgatttgacttacctttaggtgaaaagttgtaagcatttttctgataattggtacaactggaacacttcgttgtagaatctttggaaatcctaacttataatatctgtgcttcgaattttaaatatggcctgttctttttgtgattgatgttttacagtgtcatttgtagctaagggaggaatgacggaggaagttcctgggattgtagaagctgctgaacctccaacatcatcacaatcacctgctgatgtgccacataatttggaaacagaacaaatgactcctacaaagtattctattatcagtaggaatggggttgggaccacaggaaaacacatacctttacttgtgaatctctttgaagttgctgttaatgttccagacacagtattttttcagtatagtgtatgttgaccatttctgtctctgcaatttcccttatatgttatcttggactttagcttattgaaggatttccaggttgctattactttcgaagataaacaagctgttgaaagcaagggcattgggagaaaagtgattgataggctttaccaaacatactcttctgaacttggtggcaaaaggtttgtatatgatggagggaaaactttgtacacagtgggtcctctgccactaaataagtacgagttcaaagtgttgctggagaaatcatttacaaaacggtatttcttgtgtatgactgtcttatttatgtcatgttttatttttcccttaaagcttattgttccaactctagcagtagtgccaagagtcctggtgctaatggaagccttcatgaggaaactaaaaggtcaaaacattcatttcagtcaaagacattcatggtggagataagttttgctaccaaaataccacttcagtccattgttatttccttgaaagaggttgagtcggataccaattctcaagatgctttgagagtgcttgatactatactgaggcagcgtgcagctaactggtatctacacatcttctaaagatatcttgattattttcttgaatggaatttaaattttaatcataacctctttggtctaaattagttgaaccattttcttttgaatgtgaagtgggtgtctcttggtaaggcaatctttttttcatgatgactcaagaaatttcaatgatgttggggctggtgtaacagcagtctcaggttttcattccagttttcgttccacacagcgaggattgtctctcaatattggtagaagtgctttcacacatatcttggaatcttattttcataaaattgtattcttttcctgcttacactattcatttttttctagacgtgtcaacaactattatcataaaacctggacctgtaattgattttctgttatcaaatcagcaagtgaaggaaccccgttatattgactgggaaaaggtgacaaacttgtacatatggttaatgaatccgctttaataattgcccgtgatgttttttaatttttggtaatctgtaggcgaaaaaaatgcttaaaaatttaagggtgcaagcaactcatcataaccaggaatttaaaatttctgggttgagtgagaaaccatgcattcagcaactgtaagtgcttgttttctaaaagtcaagtgtctattatatttactagaaataaataagggggaaacaaaatcttaggggtctcttgacccaaaaaactattgagtctgatttcttcctcagttttagtatgaaggttaaaaatgatgacaacaatagcagagggcagacagtggatattactgtttatgaatattttgccaaacactgtggcatagagttgacctcatctgcttatcttccatgtcttgatgttgggaaaccaaaacgtcccgtctatcttcccttggaggtttgttgatattttgatcttagctaaaaaccttgtggttcatattttgtatcaattttattattttgcttcaacagtttagcactttggaccagttatgtctgattactattttcttgccttttctttacttttggtggagtagctatgttcacttgtttccctccaacggtatacaaaggttttatctctgatgcaaagagcatctttagttgaaaaatcacgccaaaagcctcaagatagaatcaaaattttaaaaagtgtaagtttataattgttatgttgttcaattttataattaatatgttaaacttgttaaaatatataggctgtaggaaaatgctatgatgatgatcctgttcttgctgcatgtggcatttctattgagaaacaactgaatctgattgaaggtcgtgttcttgaaacaccaaaggtatgcattgattgattaggtacctgcatgtggcatttctattgtttcacatttttgtgtgcacagaatatataattgaggagagataaaagagaaaatggtgtaaaggaggtggtatcatgataggtacctgttagtagttagtcaagtgtctgttagtgagagagctagttagttaggaaagttgattgaataaattagacatgttgccgttaaataagaggggttgagagggagtggtatggtgaaaaagaattgggactttgggagagacctggatctctttaatatctagggaattctttgaagaggatgcactcaatcaataaagaaatgctattttcttctgggggaaaattttcaagaaaatggcttcaagattgattccaagatttgatggaagtgaggcctattagtggcctgatcaatgcagagcagtatcttggggaaaacagtatacctgaagagttgaaattatcatgggtcggtgcattttgcattgagaggagaaactcttaaatggtgtgtttcttgggagaacaactagaatgcaacttggtggacttttcagaaggcagtgttcaagaaattccaatgtgtgtttgtcttgaagattcagaaactggggggcaagaaaacagatgcagggatgaagttcaagaagatagcctaagaccaatgacgtggagggcagaagttgatgatgcaagcagcagcaaaacataacataagatgacaattttgagagaacagaacaagtggatcatgggcaagaaacgggtgcaggaaagctacaaaaattgggagaaacccaacaaaagaaatccaacaacattttggataaagaatcagaaaacaaaagcaaaaatgaagttcttgagatcaagaatcaaagtggcagagatgacactgggatcggtctatttgtcagttgcatagaggagcctagaattgggggaagccctatgtttgacatgagggaagagccaatgactgaaccaatgacaacaatggaggttttggatttgggtagtgcaatgaacccaccacaggagctcaataaggtagagcatcttgatgatcgtcagctgctaccatgtgcagcggtgcagttaacaagggagccatgggatctccatataattacagagcctctgattctctgtctcacagcaaatataccatagaaggaagcacactaaaggagcacaggggcattcacatgtttgtgtttaacctgggaggagtggaagctattcttggaatgctgggtgcaattggcttggtcatcatgccttaataagttgcacataaatggaacgtcatttcagcagtcagaggtcattcacctcaccttcaggataaggtgtatggttagggagagtcattagtagttggttaagtgacttagttagatagttaggttagttggttgaagaaataaggcatgttgcctttaagagggagtgatatctagtcatttggtgaaatataattgggacttgagagaggcctggatctctcaaatttccagggaattctttgtagagatacagtcaatcaataaataaattctattttcttccatttctgatccggtttctatcatttccttcaattatctgagaattaaatgcacacattgatacaattctatttgagacacacagttgaaggttggtaagaatgatgattgcatcccccataacggaaggtggaattttaataagaaggtattgcattatttttcacattcagaaagtgttcaggacttactttttttaagagttatctaaaatttggttaactagtttagtaattgacgatgctatatttcttatttatagacacttctacaagcatcacatattgattattgggctgttgtcaacttttctgcaagttgtgatactagttacatatcaagggagctgatcagatgtggaatgagcaagggcattgtatgtcaccaggctttgtattctaatgtttgatgctatatttaatctgctttctttcttctttttatttgattaatccatttcaaatgtactttaaatatctacgcagaacattgaacggccatatactttgatagaggaggaaccacagttgagaaaatctcaccctgttgcaagggttgaaagaatgtttgacctgcttgcatcaaaactgaatagagagccaaagttgattctttgtgtcttgccagagaggaaaatttgtgatatatatggtatatctttaggcaaatgtttctatggtttcttttatatcaaatattttttattcaccttatgatcattcatcaactttagggccttggaaaaagaagtgtctgagtgaaattggtgttgtcacacagtgcattgcccctgtcaagatcactaatcaataccttactaatgttcttcttaaaatcaattctaaggtaactgagtataactgatatttttacaaacataactatttttgacttgataacatcacgtatagtttaaataatctattatgcctgcaatatatagcttggaggaataaattctctgttggcaatagagcattctgggcatcttcccctgattaaagataccccaacgatgattttggggatggatgtctctcacaattcacttggtcgattagatagtccatcaatagcagctgtaagactagtttggttttgtatttcttgtacctctatatttttggatttttggttatctctgcagcatatcgttctgttgtataatgttggattgtaggttgttggatctcgacattggccactgatttcaaggtatagagcgtctgtgagaatgcaggcatccaaggtggagatgattgatgctctatacaagccattggaaaatgggagtgatgatggtattatcaggttagagtaaaatgtatattgaacttctgttttgtatttatttaggaaaaaatgcaaaaaataccctgaatttcatctcattttgatgtagcctaatgggatccctgtaaacaaaaattatattgtatagaagggccagtggaggaacaagcgtagttattggactatccaacaaaacccgcatattagaggatatattccagtagaacaatgacccagagggtagagatgctactgagctggctgaagtttattagtaatagcatagtgaagcaggggggttaaggggaatttagcttatggtgtgagaaaaagggaagcagtttttatttttatttttcccccattctgacactagattaatgcatcatatcaattcctttaacagagttctatccaatagcctgtctgtgtatccaatgctatatgcattgttcctaaatcatttgttaaaatatattatgtgacaattatttatgttgtttatgcttcatgactatgtacaagatgtgtaatatgaggacattattatttctgtttatcatgacttgcacatgtgcacactgaattcttcttaattattaagatttggatttttttcttgcagagaattgcttttagatttctatgattctagtaatggacgcaagccaactcaatttattgtattcaggtgtcattctatccctgttttatttgatagatatccagtcatgcatgtttttaagtgaacttgtttgttggtcaaatgttgtaaactggaaaatgctgatgttacttattataaaaaatcattaatgtatgatgtgctgcttatacttatgttgtttaccactattttttttaaagtttgagaaaatttgcatttttgtgttaattatgatatggatatttttccataatttttctaaaaatcatcttttggtccctcatttatggaaatgtgacatatgtagtccttatttccataaacaaggggtgaaaacgagatatgattttttgtaaagaacaaggaccacatctgacatttccaaaaattagagaccaaaaggaggcaatttatttttgagggactaaatccacaacattgtcctctttatagatactaaaaacatatttaaccccgtgaataaatacaattgtatccattaaatacaaattaatcaactcactgaaatcaacaacaaattatctaatacagtaggtgtctaattttaggaaactaatgatattcaacaaattatgtctaaaattattatgaattgtatatctaaaattagtatgaattgaaccagtatttggtgagtggttattaaattcaaaatttattaaatatcacttttggttgtctcaatttcctttatcacttgttaaatatctgaagtatgttttcatgttcagggatggagttagtgaatcacaattcgaacaagttttaactatcgagcttaaccagataatcaaggttatagtgctactctgtcattgactagtttgataatctgattgattgctataatccttatagttacacatttttctgtgtgtatacttgaattactcattgtgctatttaaaaaaattgggaaaaagttaaatgataaacctttgatgatcctttcctaattttagaatgatgataaactattctaattacaggcctatcaacatcttggtgaggttaatgttccccagttcactgtgattgtggcacaaaaaaagcatcatattaagctgtttctgcctaatggcccagaaaatgttcctcctggtatgacacttatcttgttcacttgcatacagtatcacccaggatcgttgtaatataaattttcctcttcagggacggttgtggatacaacaattacgcatccaagaaattatgatttttacatgtgtgctcatgcagggatgcttgtaagtttacctatctagcttccacagccgatttcttcatttatatccattttactagcattttagttgcatgtggtaatagtgaagtgtatttgtctaccaattaaatttctgatgtttcaactttctcacgggccttcttttttctgtttcctcatcaaataatagggaacatccaggcctgtacattatcatgtgctacttgatgagattggtttctcggcagatggcttgcaaaatttgatccattcgttgtcctatgtgtatgcattcttcctttttgtttatacaaagtttcactacccctggcttatgcatgtatatacgtatttcaggaaccaaaggagcacaattgcaacctcagttggtaatttaatctactcctctgatatataactgtcagaattgtcgttttcacgaaaaaaatgtttaatttaataatttatgttttataataacttcccctcattttttccttcagtggcacccatatgctatgctcaccatgctgcagctcagatgggacaacttttgaattttgatgattcatcagaaacaggttcaagtcctgcttcagagggaggcatccccatcccagagcttccaaggttgcacaggaatgtcaggagttccatgttcttctgttgaggtgtgtagatgacaggtgctagtaaatacatttagattgatcaaaagtgtaaatgtacatttggtataacctgcaaacatatgaagcccaaattttgtttgatggggagatggattcgtgggctagggtacagtctacatattagtgatatgaattgtcattttgagacatcaatcacggtaattgagtcgcatgggcttactagcttttttgcatatattgcagctatgaaatatttctacccttccttttttttagagaaatgtgattttatgtcaaatgctctgatttagtgtgtttggttggatatttggggagcttttaagtcatttgattagctattaattttgacaattttgtttggcacactaaggttttagaggagc

SEQ ID NO: 177 - DNA, 10984 bp, Glycine max
tgcgatagtatttaactttcataaattattttataatttttttgtcattaaaattatattttaaacttgtcacaaaaatgttaaagaccaccacaaaatgttgatttattatctcatagaataaaaaaataatttatcaaaatttagaaatttataaaaatatttttaaatttcaggaattaaaataacacactcactacactgaagaactaaaacaataattaagtttatgtactaatatatattttattaattaaatataataaataaatacataaaaaaattatatatataaaatttataaattataaaattattacaagatacgagatactaattataaaatttataaaagctagttaattgtattttgtaaatcacataatcattgcaagaaaaaaaaagtaaaataaataattcaattaatattataaattcatgacaatcatccctctcaaatttctctttatttctttactaatttcacttctatctcctatcattttttgataacaaatatgagaaataaaaatataaaatttaattccaaaaaatataaaaagtgtgagcagtcaactttttattgtcactgagatacaaatttgttactgaaataattgagaacaaataaggaatttgttactgaaataattgaaaacattattgactaaattggataaaaatatcagtaagatatcatatttgaacgtatatataagtaatttttttgttggacaaaaatatcaatatttttttattaaagaaaaatatgagtgatttttttacctacatgtacattgaacagaaaatattaataaattattattattagaaaaaaatattaataattttttattaaacctatatatcataatgtttcttttgaactaatttgttcataaaaatttatttcatttaaaaataaaataattttatgataaatttttattatttttttatcattacaaatataacattataataataattaaaaaaatatattaacaaacataatttaaaacaaaacaatattattcacgcatactttattaattgtgatggagaaaaaaaattaactgccagcgttgcagttgttatactttcttatatttatttgtcagtgaattagaagcaaaagtgactattttttttaataccttttctggttgtcatcctctttccactaaatcccaccaaaaacccttcaaaatcccaaaacccttccaaagataagttgcttgggttcttccttctaccgcccaccgtcccaggattgaactcaactcaggaaactcggactcgtggaatgaacgatggaggttgcgattacgagaggttagggcattttgatttttcattgtctactctttctttgattctgttttttgattttttttttgttctttttcttttcccttgtacgttctgtgtttgattaagcattttggttcttcccctctgattctcggaaaagtaatgaactccaagcgtttttggataaaaaaaagtccattctgtgtcttgttacgtccaaaacgccgtttccttgtgtcagtgacaaacgatttttggccactccgcgatgtcgctgggtaacggtaacgccgcggtccgacaccgagatgttgcaaacgatattgtcgttaccgaccaatatttaaaatcttttcaaaacctgaaccagttttctttttttattattatttggtggtttaggttttcatagattattaggtgtttttgctgattcattgtctatgttccttaggtgtttttagtgctattctccgatcagaattgcagtttcacgtcgggaacctaagcctacttttagtgtaaacatttattatgaggaatatcgaggtgaaactccatttttgattggtgcttaaggaactgcatctaagttttttttcctgaaaggattttagtgcgtagatttgattaaaactaattagtacttatagctatatgttctgtacatgtattatctttatctttaaatagtatctcattttgtatgcaatgtctgcagtttgacatttgctttttaatatgcttatgtttttagctagctcgagccttttttggtggaactagtgttttggtaatcttcatgttccttattaagtttaataattcataataaacactttgtctttatttctgcatagactgctatatcttggtatcatataaaaaatggtcttatataatattcactgcaaatgatgtgttgcccttttacacatttggttcatgttgatatggattatgatatccttctttggatttttttaacgcaaatttatatagcaagcactgcaaatgatgtgttaccattacttatcaatcaatatttaaggttaaaaataaaaacacagactgtgctaatcatataggagtggccaaaacaaatttgagcaatcttttttgtttcttttctttaattacagacccatggtgcttcgtggaaacattcttcttttctaccccagcttgatgtgataatggatatatgacactatcctttagagaaaaactgcatctaactaagctactattcacaggacagataatggtgtgaatttggattgattttcaccatgggttgctttacataactttcatgcggtatttgtttcatacgggtcaaactagcatttctttttttgatcagcaaaagtaagattgtaatatatatagtaataatatcagtacaaggggtactgttgtatatacgacctagcaccatattatgcagaactatggtgtcctaatacgagctatacagcaagaattaagtagccatagatctgactgtaagcttggcgcccaactacacaatatctatattctatatgctaatcccccctgattacaaaacccatccctgatttgacttacctttaggtgaaaagttgtaagcatttttctgataattggtacaactggaacacttcgttgtagaatctttggaaatcctaacttataatatctgtgcttcgaattttaaatatggcctgttctttttgtgattgatgttttacagtgtcatttgtagctaagggaggaatgacggaggaagttcctgggattgtagaagctgctgaacctccaacatcatcacaatcacctgctgatgtgccacataatttggaaacagaacaaatgactcctacaaagtattctattatcagtaggaatggggttgggaccacaggaaaacacatacctttacttgtgaatctctttgaagttgctgttaatgttccagacacagtattttttcagtatagtgtatgttgaccatttctgtctctgcaatttcccttatatgttatcttggactttagcttattgaaggatttccaggttgctattactttcgaagataaacaagctgttgaaagcaagggcattgggagaaaagtgattgataggctttaccaaacatactcttctgaacttggtggcaaaaggtttgtatatgatggagggaaaactttgtacacagtgggtcctctgccactaaataagtacgagttcaaagtgttgctggagaaatcatttacaaaacggtatttcttgtgtatgactgtcttatttatgtcatgttttatttttcccttaaagcttattgttccaactctagcagtagtgccaagagtcctggtgctaatggaagccttcatgaggaaactaaaaggtcaaaacattcatttcagtcaaagacattcatggtggagataagttttgctaccaaaataccacttcagtccattgttatttccttgaaagaggttgagtcggataccaattctcaagatgctttgagagtgcttgatactatactgaggcagcgtgcagctaactggtatctacacatcttctaaagatatcttgattattttcttgaatggaatttaaattttaatcataacctctttggtctaaattagttgaaccattttcttttgaatgtgaagtgggtgtctcttggtaaggcaatctttttttcatgatgactcaagaaatttcaatgatgttggggctggtgtaacagcagtctcaggttttcattccagttttcgttccacacagcgaggattgtctctcaatattggtagaagtgctttcacacatatcttggaatcttattttcataaaattgtattcttttcctgcttacactattcatttttttctagacgtgtcaacaactattatcataaaacctggacctgtaattgattttctgttatcaaatcagcaagtgaaggaaccccgttatattgactgggaaaaggtgacaaacttgtacatatggttaatgaatccgctttaataattgcccgtgatgttttttaatttttggtaatctgtaggcgaaaaaaatgcttaaaaatttaagggtgcaagcaactcatcataaccaggaatttaaaatttctgggttgagtgagaaaccatgcattcagcaactgtaagtgcttgttttctaaaagtcaagtgtctattatatttactagaaataaataagggggaaacaaaatcttaggggtctcttgacccaaaaaactattgagtctgatttcttcctcagttttagtatgaaggttaaaaatgatgacaacaatagcagagggcagacagtggatattactgtttatgaatattttgccaaacactgtggcatagagttgacctcatctgcttatcttccatgtcttgatgttgggaaaccaaaacgtcccgtctatcttcccttggaggtttgttgatattttgatcttagctaaaaaccttgtggttcatattttgtatcaattttattattttgcttcaacagtttagcactttggaccagttatgtctgattactattttcttgccttttctttacttttggtggagtagctatgttcacttgtttccctccaacggtatacaaaggttttatctctgatgcaaagagcatctttagttgaaaaatcacgccaaaagcctcaagatagaatcaaaattttaaaaagtgtaagtttataattgttatgttgttcaattttataattaatatgttaaacttgttaaaatatataggctgtaggaaaatgctatgatgatgatcctgttcttgctgcatgtggcatttctattgagaaacaactgaatctgattgaaggtcgtgttcttgaaacaccaaaggtatgcattgattgattaggtacctgcatgtggcatttctattgtttcacatttttgtgtgcacagaatatataattgaggagagataaaagagaaaatggtgtaaaggaggtggtatcatgataggtacctgttagtagttagtcaagtgtctgttagtgagagagctagttagttaggaaagttgattgaataaattagacatgttgccgttaaataagaggggttgagagggagtggtatggtgaaaaagaattgggactttgggagagacctggatctctttaatatctagggaattctttgaagaggatgcactcaatcaataaagaaatgctattttcttctgggggaaaattttcaagaaaatggcttcaagattgattccaagatttgatggaagtgaggcctattagtggcctgatcaatgcagagcagtatcttggggaaaacagtatacctgaagagttgaaattatcatgggtcggtgcattttgcattgagaggagaaactcttaaatggtgtgtttcttgggagaacaactagaatgcaacttggtggacttttcagaaggcagtgttcaagaaattccaatgtgtgtttgtcttgaagattcagaaactggggggcaagaaaacagatgcagggatgaagttcaagaagatagcctaagaccaatgacgtggagggcagaagttgatgatgcaagcagcagcaaaacataacataagatgacaattttgagagaacagaacaagtggatcatgggcaagaaacgggtgcaggaaagctacaaaaattgggagaaacccaacaaaagaaatccaacaacattttggataaagaatcagaaaacaaaagcaaaaatgaagttcttgagatcaagaatcaaagtggcagagatgacactgggatcggtctatttgtcagttgcatagaggagcctagaattgggggaagccctatgtttgacatgagggaagagccaatgactgaaccaatgacaacaatggaggttttggatttgggtagtgcaatgaacccaccacaggagctcaataaggtagagcatcttgatgatcgtcagctgctaccatgtgcagcggtgcagttaacaagggagccatgggatctccatataattacagagcctctgattctctgtctcacagcaaatataccatagaaggaagcacactaaaggagcacaggggcattcacatgtttgtgtttaacctgggaggagtggaagctattcttggaatgctgggtgcaattggcttggtcatcatgccttaataagttgcacataaatggaacgtcatttcagcagtcagaggtcattcacctcaccttcaggataaggtgtatggttagggagagtcattagtagttggttaagtgacttagttagatagttaggttagttggttgaagaaataaggcatgttgcctttaagagggagtgatatctagtcatttggtgaaatataattgggacttgagagaggcctggatctctcaaatttccagggaattctttgtagagatacagtcaatcaataaataaattctattttcttccatttctgatccggtttctatcatttccttcaattatctgagaattaaatgcacacattgatacaattctatttgagacacacagttgaaggttggtaagaatgatgattgcatcccccataacggaaggtggaattttaataagaaggtattgcattatttttcacattcagaaagtgttcaggacttactttttttaagagttatctaaaatttggttaactagtttagtaattgacgatgctatatttcttatttatagacacttctacaagcatcacatattgattattgggctgttgtcaacttttctgcaagttgtgatactagttacatatcaagggagctgatcagatgtggaatgagcaagggcattgtatgtcaccaggctttgtattctaatgtttgatgctatatttaatctgctttctttcttctttttatttgattaatccatttcaaatgtactttaaatatctacgcagaacattgaacggccatatactttgatagaggaggaaccacagttgagaaaatctcaccctgttgcaagggttgaaagaatgtttgacctgcttgcatcaaaactgaatagagagccaaagttgattctttgtgtcttgccagagaggaaaatttgtgatatatatggtatatctttaggcaaatgtttctatggtttcttttatatcaaatattttttattcaccttatgatcattcatcaactttagggccttggaaaaagaagtgtctgagtgaaattggtgttgtcacacagtgcattgcccctgtcaagatcactaatcaataccttactaatgttcttcttaaaatcaattctaaggtaactgagtataactgatatttttacaaacataactatttttgacttgataacatcacgtatagtttaaataatctattatgcctgcaatatatagcttggaggaataaattctctgttggcaatagagcattctgggcatcttcccctgattaaagataccccaacgatgattttggggatggatgtctctcacaattcacttggtcgattagatagtccatcaatagcagctgtaagactagtttggttttgtatttcttgtacctctatatttttggatttttggttatctctgcagcatatcgttctgttgtataatgttggattgtaggttgttggatctcgacattggccactgatttcaaggtatagagcgtctgtgagaatgcaggcatccaaggtggagatgattgatgctctatacaagccattggaaaatgggagtgatgatggtattatcaggttagagtaaaatgtatattgaacttctgttttgtatttatttaggaaaaaatgcaaaaaataccctgaatttcatctcattttgatgtagcctaatgggatccctgtaaacaaaaattatattgtatagaagggccagtggaggaacaagcgtagttattggactatccaacaaaacccgcatattagaggatatattccagtagaacaatgacccagagggtagagatgctactgagctggctgaagtttattagtaatagcatagtgaagcaggggggttaaggggaatttagcttatggtgtgagaaaaagggaagcagtttttatttttatttttcccccattctgacactagattaatgcatcatatcaattcctttaacagagttctatccaatagcctgtctgtgtatccaatgctatatgcattgttcctaaatcatttgttaaaatatattatgtgacaattatttatgttgtttatgcttcatgactatgtacaagatgtgtaatatgaggacattattatttctgtttatcatgacttgcacatgtgcacactgaattcttcttaattattaagatttggatttttttcttgcagagaattgcttttagatttctatgattctagtaatggacgcaagccaactcaatttattgtattcaggtgtcattctatccctgttttatttgatagatatccagtcatgcatgtttttaagtgaacttgtttgttggtcaaatgttgtaaactggaaaatgctgatgttacttattataaaaaatcattaatgtatgatgtgctgcttatacttatgttgtttaccactattttttttaaagtttgagaaaatttgcatttttgtgttaattatgatatggatatttttccataatttttctaaaaatcatcttttggtccctcatttatggaaatgtgacatatgtagtccttatttccataaacaaggggtgaaaacgagatatgattttttgtaaagaacaaggaccacatctgacatttccaaaaattagagaccaaaaggaggcaatttatttttgagggactaaatccacaacattgtcctctttatagatactaaaaacatatttaaccccgtgaataaatacaattgtatccattaaatacaaattaatcaactcactgaaatcaacaacaaattatctaatacagtaggtgtctaattttaggaaactaatgatattcaacaaattatgtctaaaattattatgaattgtatatctaaaattagtatgaattgaaccagtatttggtgagtggttattaaattcaaaatttattaaatatcacttttggttgtctcaatttcctttatcacttgttaaatatctgaagtatgttttcatgttcagggatggagttagtgaatcacaattcgaacaagttttaactatcgagcttaaccagataatcaaggttatagtgctactctgtcattgactagtttgataatctgattgattgctataatccttatagttacacatttttctgtgtgtatacttgaattactcattgtgctatttaaaaaaattgggaaaaagttaaatgataaacctttgatgatcctttcctaattttagaatgatgataaactattctaattacaggcctatcaacatcttggtgaggttaatgttccccagttcactgtgattgtggcacaaaaaaagcatcatattaagctgtttctgcctaatggcccagaaaatgttcctcctggtatgacacttatcttgttcacttgcatacagtatcacccaggatcgttgtaatataaattttcctcttcagggacggttgtggatacaacaattacgcatccaagaaattatgatttttacatgtgtgctcatgcagggatgcttgtaagtttacctatctagcttccacagccgatttcttcatttatatccattttactagcattttagttgcatgtggtaatagtgaagtgtatttgtctaccaattaaatttctgatgtttcaactttctcacgggccttcttttttctgtttcctcatcaaataatagggaacatccaggcctgtacattatcatgtgctacttgatgagattggtttctcggcagatggcttgcaaaatttgatccattcgttgtcctatgtgtatgcattcttcctttttgtttatacaaagtttcactacccctggcttatgcatgtatatacgtatttcaggaaccaaaggagcacaattgcaacctcagttggtaatttaatctactcctctgatatataactgtcagaattgtcgttttcacgaaaaaaatgtttaatttaataatttatgttttataataacttcccctcattttttccttcagtggcacccatatgctatgctcaccatgctgcagctcagatgggacaacttttgaattttgatgattcatcagaaacaggttcaagtcctgcttcagagggaggcatccccatcccagagcttccaaggttgcacaggaatgtcaggagttccatgttcttctgttgaggtgtgtagatgacaggtgctagtaaatacatttagattgatcaaaagtgtaaatgtacatttggtataacctgcaaacatatgaagcccaaattttgtttgatggggagatggattcgtgggctagggtacagtctacatattagtgatatgaattgtcattttgagacatcaatcacggtaattgagtcgcatgggcttactagcttttttgcatatattgcagctatgaaatatttctacccttccttttttttagagaaatgtgattttatgtcaaatgctctgatttagtgtgtttggttggatatttgg

SEQ ID NO: 178 - DNA, 10095 bp, Glycine max
aatttgttcataaaaatttatttcatttaaaaataaaataattttatgataaatttttattatttttttatcattacaaatataacattataataataattaaaaaaatatattaacaaacataatttaaaacaaaacaatattattcacgcatactttattaattgtgatggagaaaaaaaattaactgccagcgttgcagttgttatactttcttatatttatttgtcagtgaattagaagcaaaagtgactattttttttaataccttttctggttgtcatcctctttccactaaatcccaccaaaaacccttcaaaatcccaaaacccttccaaagataagttgcttgggttcttccttctaccgcccaccgtcccaggattgaactcaactcaggaaactcggactcgtggaatgaacgatggaggttgcgattacgagaggttagggcattttgatttttcattgtctactctttctttgattctgttttttgattttttttttgttctttttcttttcccttgtacgttctgtgtttgattaagcattttggttcttcccctctgattctcggaaaagtaatgaactccaagcgtttttggataaaaaaaagtccattctgtgtcttgttacgtccaaaacgccgtttccttgtgtcagtgacaaacgatttttggccactccgcgatgtcgctgggtaacggtaacgccgcggtccgacaccgagatgttgcaaacgatattgtcgttaccgaccaatatttaaaatcttttcaaaacctgaaccagttttctttttttattattatttggtggtttaggttttcatagattattaggtgtttttgctgattcattgtctatgttccttaggtgtttttagtgctattctccgatcagaattgcagtttcacgtcgggaacctaagcctacttttagtgtaaacatttattatgaggaatatcgaggtgaaactccatttttgattggtgcttaaggaactgcatctaagttttttttcctgaaaggattttagtgcgtagatttgattaaaactaattagtacttatagctatatgttctgtacatgtattatctttatctttaaatagtatctcattttgtatgcaatgtctgcagtttgacatttgctttttaatatgcttatgtttttagctagctcgagccttttttggtggaactagtgttttggtaatcttcatgttccttattaagtttaataattcataataaacactttgtctttatttctgcatagactgctatatcttggtatcatataaaaaatggtcttatataatattcactgcaaatgatgtgttgcccttttacacatttggttcatgttgatatggattatgatatccttctttggatttttttaacgcaaatttatatagcaagcactgcaaatgatgtgttaccattacttatcaatcaatatttaaggttaaaaataaaaacacagactgtgctaatcatataggagtggccaaaacaaatttgagcaatcttttttgtttcttttctttaattacagacccatggtgcttcgtggaaacattcttcttttctaccccagcttgatgtgataatggatatatgacactatcctttagagaaaaactgcatctaactaagctactattcacaggacagataatggtgtgaatttggattgattttcaccatgggttgctttacataactttcatgcggtatttgtttcatacgggtcaaactagcatttctttttttgatcagcaaaagtaagattgtaatatatatagtaataatatcagtacaaggggtactgttgtatatacgacctagcaccatattatgcagaactatggtgtcctaatacgagctatacagcaagaattaagtagccatagatctgactgtaagcttggcgcccaactacacaatatctatattctatatgctaatcccccctgattacaaaacccatccctgatttgacttacctttaggtgaaaagttgtaagcatttttctgataattggtacaactggaacacttcgttgtagaatctttggaaatcctaacttataatatctgtgcttcgaattttaaatatggcctgttctttttgtgattgatgttttacagtgtcatttgtagctaagggaggaatgacggaggaagttcctgggattgtagaagctgctgaacctccaacatcatcacaatcacctgctgatgtgccacataatttggaaacagaacaaatgactcctacaaagtattctattatcagtaggaatggggttgggaccacaggaaaacacatacctttacttgtgaatctctttgaagttgctgttaatgttccagacacagtattttttcagtatagtgtatgttgaccatttctgtctctgcaatttcccttatatgttatcttggactttagcttattgaaggatttccaggttgctattactttcgaagataaacaagctgttgaaagcaagggcattgggagaaaagtgattgataggctttaccaaacatactcttctgaacttggtggcaaaaggtttgtatatgatggagggaaaactttgtacacagtgggtcctctgccactaaataagtacgagttcaaagtgttgctggagaaatcatttacaaaacggtatttcttgtgtatgactgtcttatttatgtcatgttttatttttcccttaaagcttattgttccaactctagcagtagtgccaagagtcctggtgctaatggaagccttcatgaggaaactaaaaggtcaaaacattcatttcagtcaaagacattcatggtggagataagttttgctaccaaaataccacttcagtccattgttatttccttgaaagaggttgagtcggataccaattctcaagatgctttgagagtgcttgatactatactgaggcagcgtgcagctaactggtatctacacatcttctaaagatatcttgattattttcttgaatggaatttaaattttaatcataacctctttggtctaaattagttgaaccattttcttttgaatgtgaagtgggtgtctcttggtaaggcaatctttttttcatgatgactcaagaaatttcaatgatgttggggctggtgtaacagcagtctcaggttttcattccagttttcgttccacacagcgaggattgtctctcaatattggtagaagtgctttcacacatatcttggaatcttattttcataaaattgtattcttttcctgcttacactattcatttttttctagacgtgtcaacaactattatcataaaacctggacctgtaattgattttctgttatcaaatcagcaagtgaaggaaccccgttatattgactgggaaaaggtgacaaacttgtacatatggttaatgaatccgctttaataattgcccgtgatgttttttaatttttggtaatctgtaggcgaaaaaaatgcttaaaaatttaagggtgcaagcaactcatcataaccaggaatttaaaatttctgggttgagtgagaaaccatgcattcagcaactgtaagtgcttgttttctaaaagtcaagtgtctattatatttactagaaataaataagggggaaacaaaatcttaggggtctcttgacccaaaaaactattgagtctgatttcttcctcagttttagtatgaaggttaaaaatgatgacaacaatagcagagggcagacagtggatattactgtttatgaatattttgccaaacactgtggcatagagttgacctcatctgcttatcttccatgtcttgatgttgggaaaccaaaacgtcccgtctatcttcccttggaggtttgttgatattttgatcttagctaaaaaccttgtggttcatattttgtatcaattttattattttgcttcaacagtttagcactttggaccagttatgtctgattactattttcttgccttttctttacttttggtggagtagctatgttcacttgtttccctccaacggtatacaaaggttttatctctgatgcaaagagcatctttagttgaaaaatcacgccaaaagcctcaagatagaatcaaaattttaaaaagtgtaagtttataattgttatgttgttcaattttataattaatatgttaaacttgttaaaatatataggctgtaggaaaatgctatgatgatgatcctgttcttgctgcatgtggcatttctattgagaaacaactgaatctgattgaaggtcgtgttcttgaaacaccaaaggtatgcattgattgattaggtacctgcatgtggcatttctattgtttcacatttttgtgtgcacagaatatataattgaggagagataaaagagaaaatggtgtaaaggaggtggtatcatgataggtacctgttagtagttagtcaagtgtctgttagtgagagagctagttagttaggaaagttgattgaataaattagacatgttgccgttaaataagaggggttgagagggagtggtatggtgaaaaagaattgggactttgggagagacctggatctctttaatatctagggaattctttgaagaggatgcactcaatcaataaagaaatgctattttcttctgggggaaaattttcaagaaaatggcttcaagattgattccaagatttgatggaagtgaggcctattagtggcctgatcaatgcagagcagtatcttggggaaaacagtatacctgaagagttgaaattatcatgggtcggtgcattttgcattgagaggagaaactcttaaatggtgtgtttcttgggagaacaactagaatgcaacttggtggacttttcagaaggcagtgttcaagaaattccaatgtgtgtttgtcttgaagattcagaaactggggggcaagaaaacagatgcagggatgaagttcaagaagatagcctaagaccaatgacgtggagggcagaagttgatgatgcaagcagcagcaaaacataacataagatgacaattttgagagaacagaacaagtggatcatgggcaagaaacgggtgcaggaaagctacaaaaattgggagaaacccaacaaaagaaatccaacaacattttggataaagaatcagaaaacaaaagcaaaaatgaagttcttgagatcaagaatcaaagtggcagagatgacactgggatcggtctatttgtcagttgcatagaggagcctagaattgggggaagccctatgtttgacatgagggaagagccaatgactgaaccaatgacaacaatggaggttttggatttgggtagtgcaatgaacccaccacaggagctcaataaggtagagcatcttgatgatcgtcagctgctaccatgtgcagcggtgcagttaacaagggagccatgggatctccatataattacagagcctctgattctctgtctcacagcaaatataccatagaaggaagcacactaaaggagcacaggggcattcacatgtttgtgtttaacctgggaggagtggaagctattcttggaatgctgggtgcaattggcttggtcatcatgccttaataagttgcacataaatggaacgtcatttcagcagtcagaggtcattcacctcaccttcaggataaggtgtatggttagggagagtcattagtagttggttaagtgacttagttagatagttaggttagttggttgaagaaataaggcatgttgcctttaagagggagtgatatctagtcatttggtgaaatataattgggacttgagagaggcctggatctctcaaatttccagggaattctttgtagagatacagtcaatcaataaataaattctattttcttccatttctgatccggtttctatcatttccttcaattatctgagaattaaatgcacacattgatacaattctatttgagacacacagttgaaggttggtaagaatgatgattgcatcccccataacggaaggtggaattttaataagaaggtattgcattatttttcacattcagaaagtgttcaggacttactttttttaagagttatctaaaatttggttaactagtttagtaattgacgatgctatatttcttatttatagacacttctacaagcatcacatattgattattgggctgttgtcaacttttctgcaagttgtgatactagttacatatcaagggagctgatcagatgtggaatgagcaagggcattgtatgtcaccaggctttgtattctaatgtttgatgctatatttaatctgctttctttcttctttttatttgattaatccatttcaaatgtactttaaatatctacgcagaacattgaacggccatatactttgatagaggaggaaccacagttgagaaaatctcaccctgttgcaagggttgaaagaatgtttgacctgcttgcatcaaaactgaatagagagccaaagttgattctttgtgtcttgccagagaggaaaatttgtgatatatatggtatatctttaggcaaatgtttctatggtttcttttatatcaaatattttttattcaccttatgatcattcatcaactttagggccttggaaaaagaagtgtctgagtgaaattggtgttgtcacacagtgcattgcccctgtcaagatcactaatcaataccttactaatgttcttcttaaaatcaattctaaggtaactgagtataactgatatttttacaaacataactatttttgacttgataacatcacgtatagtttaaataatctattatgcctgcaatatatagcttggaggaataaattctctgttggcaatagagcattctgggcatcttcccctgattaaagataccccaacgatgattttggggatggatgtctctcacaattcacttggtcgattagatagtccatcaatagcagctgtaagactagtttggttttgtatttcttgtacctctatatttttggatttttggttatctctgcagcatatcgttctgttgtataatgttggattgtaggttgttggatctcgacattggccactgatttcaaggtatagagcgtctgtgagaatgcaggcatccaaggtggagatgattgatgctctatacaagccattggaaaatgggagtgatgatggtattatcaggttagagtaaaatgtatattgaacttctgttttgtatttatttaggaaaaaatgcaaaaaataccctgaatttcatctcattttgatgtagcctaatgggatccctgtaaacaaaaattatattgtatagaagggccagtggaggaacaagcgtagttattggactatccaacaaaacccgcatattagaggatatattccagtagaacaatgacccagagggtagagatgctactgagctggctgaagtttattagtaatagcatagtgaagcaggggggttaaggggaatttagcttatggtgtgagaaaaagggaagcagtttttatttttatttttcccccattctgacactagattaatgcatcatatcaattcctttaacagagttctatccaatagcctgtctgtgtatccaatgctatatgcattgttcctaaatcatttgttaaaatatattatgtgacaattatttatgttgtttatgcttcatgactatgtacaagatgtgtaatatgaggacattattatttctgtttatcatgacttgcacatgtgcacactgaattcttcttaattattaagatttggatttttttcttgcagagaattgcttttagatttctatgattctagtaatggacgcaagccaactcaatttattgtattcaggtgtcattctatccctgttttatttgatagatatccagtcatgcatgtttttaagtgaacttgtttgttggtcaaatgttgtaaactggaaaatgctgatgttacttattataaaaaatcattaatgtatgatgtgctgcttatacttatgttgtttaccactattttttttaaagtttgagaaaatttgcatttttgtgttaattatgatatggatatttttccataatttttctaaaaatcatcttttggtccctcatttatggaaatgtgacatatgtagtccttatttccataaacaaggggtgaaaacgagatatgattttttgtaaagaacaaggaccacatctgacatttccaaaaattagagaccaaaaggaggcaatttatttttgagggactaaatccacaacattgtcctctttatagatactaaaaacatatttaaccccgtgaataaatacaattgtatccattaaatacaaattaatcaactcactgaaatcaacaacaaattatctaatacagtaggtgtctaattttaggaaactaatgatattcaacaaattatgtctaaaattattatgaattgtatatctaaaattagtatgaattgaaccagtatttggtgagtggttattaaattcaaaatttattaaatatcacttttggttgtctcaatttcctttatcacttgttaaatatctgaagtatgttttcatgttcagggatggagttagtgaatcacaattcgaacaagttttaactatcgagcttaaccagataatcaaggttatagtgctactctgtcattgactagtttgataatctgattgattgctataatccttatagttacacatttttctgtgtgtatacttgaattactcattgtgctatttaaaaaaattgggaaaaagttaaatgataaacctttgatgatcctttcctaattttagaatgatgataaactattctaattacaggcctatcaacatcttggtgaggttaatgttccccagttcactgtgattgtggcacaaaaaaagcatcatattaagctgtttctgcctaatggcccagaaaatgttcctcctggtatgacacttatcttgttcacttgcatacagtatcacccaggatcgttgtaatataaattttcctcttcagggacggttgtggatacaacaattacgcatccaagaaattatgatttttacatgtgtgctcatgcagggatgcttgtaagtttacctatctagcttccacagccgatttcttcatttatatccattttactagcattttagttgcatgtggtaatagtgaagtgtatttgtctaccaattaaatttctgatgtttcaactttctcacgggccttcttttttctgtttcctcatcaaataatagggaacatccaggcctgtacattatcatgtgctacttgatgagattggtttctcggcagatggcttgcaaaatttgatccattcgttgtcctatgtgtatgcattcttcctttttgtttatacaaagtttcactacccctggcttatgcatgtatatacgtatttcaggaaccaaaggagcacaattgcaacctcagttggtaatttaatctactcctctgatatataactgtcagaattgtcgttttcacgaaaaaaatgtttaatttaataatttatgttttataataacttcccctcattttttccttcagtggcacccatatgctatgctcaccatgctgcagctcagatgggacaacttttgaattttgatgattcatcagaaacaggttcaagtcctgcttcagagggaggcatccccatcccagagcttccaaggttgcacaggaatgtcaggagttccatgttcttctgttgaggtgtgtagatgacaggtgctagtaaatacatttagattgatcaaaagtgtaaatgtacatttggtataacctgcaaacatatgaagcccaaattttgtttgatggggagatggattcgtgggctagggtacagtctacatattagtgatatgaattgtcattttgagacatcaatcacggtaattgagtcgcatgggcttactagcttttttgcatatattgcagctatgaaatatttctacccttccttttttttagagaaatgtgattttatgtcaaatgctctgatttagtgtgtttggttggatatttgg

SEQ ID NO: 179 - DNA, 10095 bp, Glycine max; identical to SEQ ID NO: 178

SEQ ID NO: 180 - DNA, 13981 bp, Glycine max
tagttctttaatttaatttttttagattctaatttttatttcttctattttctttttacaactttctagcctttcattaatgttgtacatcaatggttcaatttcgagttgtgcaatttttttaaacatctgaattagtaaaaattgattaatttgagtttcattttttttcttttaatttgatccaaattgactcgttaatatctctaaatgtcagtttgactagttaaaattatggtactcaacaggatatgaaaaacaattaatattctacaaagacacaagttataaaaactttttttttatcttggacattatttttaatataatttatattaaatttaatgtgttcatcgaaataaaagtgagagaaaaatttaaataaaaatctagtatttttttttaaaataattatgtaagttaattattattttttcagttgttaaataaataaaagtgaggataaatatgtatttttaatattttgtgtatgaaacaaaattatcccatgatttttttaataataaaaattagagatttatcctaacctatttaatttgtgttttctcctgatgatttttttacatgtgaaacaaatttttttatcctgtaatcatcttcttaatatttttgtttattaagttcaaattttctttctctttttattacactttcttacctagtaatctgataaaagtacatgcatactagtgtttcattttttatttattttctttcttcccaacctcacgttaccaaaacaaataaaagagtgaaatttcattgtagaaacacactagatagtatttttttgtttacccaagacaaatattttatttctttattgatctgtgtttctttttatccatttactcattcattggtatggacataaaagaaatataaattttaaaaaaatcaaataagtatatataattttttaccttgcttaaatttgtttctctctgttttgttttttattcatccacgcagacgtagaggtaattaagctataaaattaaatatataatataattatatatatttaattgtaataatactatgattgaaatatataatatattttataaaataacactagctttatgatatttatggtttaaaattcgataaaaaataaaatacatatttaattttattaaagttattgttgttaaaaataaaataaatatttaaaattattaacatattaaaatacattcatgataaatatattaaaaaataagattaatttgaaatatgaatttgataatatcatataataactaatttaataaaaacttgagaataaattaaaatattttttaaaatttagaaaataaaattaaactcaacaaataaaaaaagatttaatctgacaatgaaacatcagcagttgtatgtgactctttatttttacataaatttgtttctctgttctttatattcaatttttaatccccaaaagaaggaaaggagcgtacgcgtgtagactgtagagtcacaactgttactaaaaaagttgacccttccctctcactggaaactaatgttcccgcgcgtgtggccattttgaaaaaaatctgcttttcattcgctcagacacttttttgtccccatctcttttcattcgctcagcgatacgctaccatggctaaacgcaaaacatccgacgcctccgatgcacaagacgacactgtatcgctgcttccttcccaacgcaataaggccaagcatcctaactctaactccaacgcctgcttcgccggaaagcccattccgcccgccgaggccctcgccaaatggccccaccgatatccctccgaggtcttctttttttcttctcaaccttcctacgttcaaaatcttttttttttttatattgttctctccatttttgctcattttgtttttcttgtatataaataatcaggggaaaaagaagggttcagctagaacctcaaaagagtgagtctttttattttctttcatattttatatttgtctatttcatttcttgttatagctacaactttaacactgacatgtatgacatgtatgtgactgtgtagggctacgagtgaaaacagtgaagttatgccggcacggtgtcattatcgtcaagctaaagtggatggggttgtttataacctctatgacgatgcttatgtcaaggtattggatcttgctttggaattttacactttggtaaaaacagaacatgttgaaaaaaaaaattaacattcttgttgaactattttaggccgaagatggaaaaccagattatattgcacgaatcgttgagatgtttgaaactgttgataaggaacaatgttttacggctcagtggttctacagggctgaggacactgtgagtctcactttttcaatgacttgtctttttaataatttttcattatcttttaactgttttatggcttattttgctttggagttttgaatgagtgcaggtgataaaaaatcacggtgaccttgttgacaagaagcgaatttttatatctgatgtgaaagatgtaaatccccttgactgtattgtttccaaagtcaaaatttacaaaaaaagtccaagtgtaagtgcttcatagtcactttgttttgtgcaaatgcttgatagtttatcattttatttaaggattatttaagcttttggaatccttttatatatatctatcttttatcagccaatgctagttgttagtttcttgttagaatgttagtggaagattcgaacccgcgaggtttccctcctttctcctttcaacccttagacccccctctcaaccaccaagccatgcttgtaaccctcttggaatccttttatataagttttagatcttgcttataaatttcttggataatctagtcaagataaactctcttgagctcattacaccaatgctatggttttgtactcatgcaggtggcttcttttaactcatcttctgttgaaggatagtcactttttattaaagaatttattttcctcttgcctttcaaaagaattaaataaaataagaattatgctgtttacgtcctgtaactttattatgtggttaatagtgtttgaaatttgtatactacaggtagatttgacttcaaagaagggaaaactcccttcttgtgattactattatgacatgaagtacactgtgccgtatctaaccttttccaacatcgtcaacggtaagaatgatgtggtttttatagatgactaatgaatggtctatcttgtttttgcacgacactttgctgaattttgtcattttatgtgtttttctctcacaatccagaaacagttaaaacagagagtgatgcatcttccacaatttctagtgaatctggatccaatggttgcgttagtaatgctaatctagctaatggaaagactactcaaaataatagttctggttcctcggagtggactttgctagacttgtattctggttgtggagccatgtccacagggctttgttttggtgcatccttggctggaataaaacttgtcactgtatgtagagctgttcttttgagcattttagtttttagctgttattttgaacaatttataatgattttttttttttattatttcaaagaggtgggctgtggacattaatgcacatgcatgcgaaagtttgaagctgaaccaccctgagactcaagtaaggttttgttaacatgtaattgatattgacacttgttattgtatcttctactgatattgcttccccaaaataacaatcaggttagaaatgaaccagctgaagacttcttaaacctaataaaatcctgggccaagctttgtgaagagtttgcattattaggatcagaacggttagattctgatccagacatggatgaagatgagaatgaagctgtgagaaaagaagagtcaggaaatcaatctgattcagaggaatttgaagtagaaaagttacttgctgtgtgctatggtgatccaaacgacgtcaaaaaaccaggactatattttaaagcatgtttccttcaagcttcataatacattaattggtttgcatatttagtttaatgttgttaatgttattaggattgacttatttacgttatagttctttgcgtgccctatgttttaataggagtctaatttttgggggaaaaatgcatgtatgagtgagtatcaatttaggttatgacacaacacgcacgtaccatcatccaatgcaatcatcttaatatttatggctttggttttttcatatcttgaatttggtgatttaaattattaatttcatcaaggcaggcaaagaggattattaatgtagatagcagttcttaaaatggtgcaacatttgctgcatatatatatgactataatttaatgtatttgatgtgataagatatgtacataattacatggatatgacgaaatgtttaaagaaaataaaatatagtttggtgttaatgttaaaaacgctcaatagcttgtagtcttgtactcatttttgaagtcataattaacgaaatacaatttgcaataactattttgatactttaaactatgaagtgcttgaactttgatactttaattggcttccttatcttttgtgctgaggtaccaagaacacctttagtagtaaactcaaaacaaatgtttgtcaaagaaggtaactttaggttttgtcagcatgtcccaacttaattggatttgatcttattcgatttccaagtgttaatttagcctctcatttttttcttcctgtgcaatgaaattccagttattgatccattctgatttttgccattaaatcactcaggttcgttggctgggttatgcttccagctatgacacgtgggagccaatagaaggattgaggtaaaccccttgtcatcaaaattattattctctccagctttgctttgtgaaatttttgtttgttatgcactttaggccaagtgcaaaattctgactcttattattttgtgccagtgattgcaaggaagctatgaaagattttgtgacaaaaggctacaagaaaagattattgcctcttcctgtgagtctctccattctaggataaacttaaagtcctggtttacacgctagtactggttacacttggagcggtttgtcaattgattttgtaacacttagcccttgtgtagggtgatgctaactttatttgcggtggacccccatgccaaggagtaagcggtttcaaccgcttcaggaatgcagcagctccattagaggacacaaagaataagcagttgcttgtttacatggatattattgattttttgaagccaaaatatgtcctcatggagaatgttgttgatattttgaggttttccggtggttatctggggcgttatgccatatgccgtcttgtagctatgaattatcaagcaagaatgggcatgatggcagcagggtcttatggccttccacaatttcgtatgcgtgttttcctttggggagctcgtcctactgaggtaagcttatttatgcatgtagattctattcttttggcggtgttgaatatttgttttattctatgtatggttacttagctagcttacttttcagaggagacaacaaggttaggttaggtcagtatgtgtaagttgtctctctcttctctttgtaccctttatatatgccattcaaaagcaattaatgagatgagagagagtgagaaaatttcctcacttattcaaatcttcaacttggcatcagagctgagttctccgacatcgttcgctaccgctaacgttcgttgcctccatcgccggccgccaccgtcttcggctactttttcttccggcgaacccagggttgggtgtgccttgaagagcgcgactttctcctggaagtcgcgccgccaccgtctcgcgctaattctggcgtgtgaagtccacgtgccattgtccagtcatcgggagcttactggacttgtcctggcagcctcgccgtcctctcctgagcaagtttcaggccttgtctttcgtttttggcgagtccttgtgttagcccttgtgtttttctcttctttttcgttagggttttcgttttttgatcagaaatagcctcctttggacttgttttctctttctctggaacaccaaccatcacaattgcaaagctcaactggaagaattatttattttggtctgtttcagtggagctttggtttctaggccaagggtaccatgaccacttagagaaaggtgttgatgttgtcctaaatgataaacgacctgaatgagaaaagcttgactatcaattgtgtaatgtgttatggcaatcagttgagccagatattttggatccttagatcgtttaaaacatgtcgctctttttggaagaagacccaagagatctttgccaatgatattcaaagcttgtttgatgcaaccatgaaggtttcagcccttaaacaaactagccatgacatgattgcacatgtaggtaaggctcgggctccagtgaaagagttgaaaaggttccttgtgggtaattcatttatctcaccattactcccatttattgatgaagcttgcacacaagaccatactccccctgagcaacaaacccaggaggttgcttcatataaatatcctcctcaagatcactatggaggaagacatttttaatataaagctgatgaagagaccaatgatgcatgacaatcatagcaagaaacagacgaacaatagtgattttggctacaggagaaaaagtatcacaataatcaagaccatatatttgtttgtagcctttagctaccgagcgatccttaagtcgatcaacctcaccattgggcccaactttaacagtatagacctatctataacccacaagtgttttgccaggaggaagaggaacaagtttccaagtatcattattttcaagagcctgcatttcatcaatcatagcttgttgtcagccaagatgatcaagtgcctcatggacattggaaggaatagtaagggaagataatgagaaaacaaaagaaacatatgaaggagacaaatgatgatagcttaagaaattataaataagataaggattacgagtagaacaagtatctttcttgatgacaatggaccaatctgagtcagaatgatgagaagaagtggaaggagaagaaggatctataggttgaggattggttgaagacggatgaggatcacgagaagaagcttcaggcattatagatccaacttgccttgtcctgtgttgatatgtaatgagaggtggaggaacaactttaggtgaatttggtggagaagatggaacaaccctgacattttggtctgagttacctagaggacaaggagaaggaattcgaagtacaacctggagagaagaggaatgatccatggaagggtgagaagaagggtgtgtctttaaagaaggttacatccgtagatatgtaatattgttttgtggttggagagtagcacttgtaacctttttgaaaatgagaataacccaaaaagacacatttgattgatctagcaaaaagtttgtctaaaccaggagaaagatcatggacaaaacaagtacaaccaaatactttaggagaaatatgaaataatgggtcatgaggaaaaataattgaatgaggaatttgattttcaagagaagaagacattttgttaattaagaaataagcagtaagcactgcatctccctaatggtgtgtaggaacattggaatttaatttaacattaggaaacgtgcaatttcaagaagatgatgattcttcctttttgctataccattttgttatggtgtttgaggacacatggactgatgcagaataccttttgaagataagaaggaagagatatcatgagagaaatactctttagcattatcacttctgaaaatcttaattgttttgccaaattgattctcaatctcattatagaatgacatgagtataggcaaaagtttagatctgtctttcattaaataaactcaagtacatctggagaattcatcaataaaggttacaaaatatcgaaaatcaaaagatgtaacacgacttggtccccaaaaatcaaaatgaatggtagagaaagtcgagttacatctttgtacagtttgaggaaataatgacctaacacgttttcctaattgacaagactcacattctaagactctaagattcttaagactaggaaccgtcattttcagttttggtagacttggatgacccagacaatcatgcacaagtttgggttttgaagttgcaaaataggacacaggaaaactggattctaagtagtaaaatcttcgtgattcacgtccttctccaattaatcgacccatcccatgttcttgaataataaatgatttagcagtaaaggtgttaacttgttggcaagtgtatcaaatttgtcacaagtagtaaagtactcggaagtccgagtgtcgaattcaaagggattttgtttgtacttagattaatgcaaatccaatttaaaaacaatagatcaataatttaaaataaagataagaaaatataagagataagataaagatttaaaagaaaggataaaagatttaaagataaaaatggaagatagagaaaataaaatatttaaattaagatatgataaagataaaagaaaataggagataaaagataagataagtaaaagataaaaataaaagataaaaataaaataaaatcagaattgggacttggcctgccttgtttgcctaggatgtatgagtttacttgccttgattcctcacgatgacaagcctattttatttatctatttttcaaattcttttgcaaagatccaacaaataaaatgcatgatgtatgaattttagatgtttgcaagaatgcatggacataaaattatcattcctaggaatgactttcctatgaaatcctttgtttttgttttagtagttactcttacgagcgtctaatctataaaaccaatgcatgcatatcttctttaaatcttatttagaagttatgttgctcctgagcgtctaatccctaatagaatataaagataaataatgcaagataaaagccaaaaagataatagaatagaaaacacctttgcattgataaatagtgagtacatcatacatcgcttggcttttaggcctgccaggccttaactaggggtttagctattcatgatcattgagggctttacaatgaatgaggtataagaattgagatgagataagaggggtgaaagaaagagagtaaatgaaacccctaggagagggggttttgtggtctctttctcctccttggcttcactgttggaatggaatggacttgggcctaatgttaaaaatcttgctcagtgatattttttttgatattttttggatttattttgcttttaatcatatcttcctgagacttcttgatattttggatattttcttgatctttttctcttttaatctctcattttcatatttgcaagtcataagtaagaaaattatcaaatcttaatatttaagccaaagataactgctaaataaacatttttaaagatatttttattatcaaaataactcatatttagccgttataaaaaggttgtaatttaatgagcgagtcaactgacttaatgagattagattgtatggacattgaggaacaaataaaacataattcaatttcaatgagggagataatgaaacttgagcacttccttgagacgcaactttggagccattagctacagtaacaaggtgcggaatttttggaaaagaaatggatgaaaatgaagacttattatcagagatattatcagaggcacctgagtcaagtatccaagaactaggattttcaatggattgagaaatacaggttgttgaaaaacctggtacagatgaagattgtgcttggttgttgggcttctcggatttgagctttaaatactcctgatactcttcatcagagaacctagactccgatttctctgacttagacacctgtgctactttgtcaggaaagtcatgcaatgaataacagttttccttagtgtgacccatcctcttgcaataggtgcaatgaggacgtccacctcttccactgcggcctcctctgttattgcggcctcttcctctcccacaaggtgccaccatagttaaagtttctgcagcatcagtaagagtttcatccttcaatacatgaggcacgcgaataaatctagtgatgagggaatccattgatggaacttgatctccagcaaggacttgatcacacacatgatcaaagtctgagtgtaggctcctcaagatgagaaacatataaaacttgtccagtttcctattaacctcttccaggctcctctctatgggttgaagcaatctcctcgagcttgatttggtaaatttagtcatgttgttcaactttttgggttgaaataaagtgaagctgatcattctattttttattgtcatacatcccctagaaagtgtgtttatctaatggtctatgttgatgatatagtgatcacaggaaatgatgctactaagattgtccagttaaaagagcacttattcagtcatttccagaccaaagacttgggatatctgaagtatttccttggtattgaggtgtctcaatcaggagatggtgttgtgatttctcaaaggaagtatgttttggatattctggaagaaacaggcatgcaaaattatagacttattgatagtcctatggacccaaatctgaagctcatggcagatcagagatgtctatcttgacctcgagaggtataagagacttgtgaaaaaactcatttatctcaccattacaagacctaatatctcctttgctattggattagttagccaattcatgcaaaattctcatgttgatcattggaatgctgccatgcgtattcttagatatgctaagagagttcctggacaaggattattgtatgaggacaagggtaatacacaactatcggggtattgtgatgcagactgggctggttgtcctatggataggagattcacattaggttattgtgtcttcattggagggaatattatctcttggaagagcaagaagcaaactgttgttgctcggtccagtgcagaagctgaatatcgatctatgactatagttacatgtgagcttatgtggattaaacaatttctccaagaattgagattttgtgaagttgtgcaaatgaggttatactgtgataatcagactgctctccacattgcttcaaatccaatctttcatgagaggactaagcacatcgagattgattgtcatttcattcgggagaaactattgtccaaggagattgtcattgagttcattaattctaatgatcagccaatagatattttgactaagtccttaagaggacctaggattctgtctatatgttccaagcttggtgcatatgatttatatgttccagcttgagggagagtgttgaatatttgttttattctatgtatggttacttagctagcttacttgtcagaggagacagcagggttaggtcaggtcagtatgtgtaagctgtctctctcttctctttgtaccctatatatatgccattcaaaagcaattaataagatgagagagagtgagagaaaatttcctcacttattcaaatcttcaactggcgggataacgttaatgttgtaaatgggaaggtaaatgacttaactattttttttctttgttggatagaaattgcctccatatccgttaccaacacatgaggtggtgtcaagaggttccgttcccactgaatttgaagtaaggactaatagactaagacaatttttctccattttcctcgaaaagcattgtctttgattttaatcaccggtatctgattgttgttgtcataatgcaggaaattacagtagcttatgataaaaaggatacctgtcatctggctggcgctcttttacttgaggatgcaatatcagatctaccacatgtatgtttattttgctctgcatttgtttattaagtttgttggcttgatatgaaattttgattttgatcccatttcttacctctttttcaattttcccttaatgaggttacaaatgatgagaaccaagatgaaaggaactatgaagctccttctgaaactgaatttcaaaaatatattagattgaagaaaaacggttagcttttgtatttgcttttgccattttgcgttttaaagcatgcttatgttgtttatactttgcatcaaggtctttgcctttgccagtgtggtaaactaaattctctgagcttctttaagacatagtagtagttgaatattttgtcatgctctacgttgcttttgctatgtctagaattttgttttggtggttgactgttgtttaatgtggtaataatatttgtcacatcgctttcttctcatgcaacaagtgcatagtactaccgtacagaatggatattgacattatacgttctctgttttgaagagatggtgggtagtatggctagtgctcaaagcgcaccagatagaatactatatgatcatcgtcctctgcagttgaacaaagatgattatgaaagagtttgccagattccccagaagaaggtaggttccataacttgaccgtatgtgctgtcagaaatttattttactctattctaaatttagatggtgcttgcttacttttctagggtgcaaacttcagagatctacctggtgtacttgtgaatggcaacaaagttcaatgggatccatcggttcaaagagtgatgctagactctgggaagcctttggtactagtcttttgtcaccttttcttagggacattattttgacacaacccctttgttgagtgccataatttatctctaatttattttattttgtggtcatgcataggttcctgattatgctatgacatttgtccgtgggacatctagcaagtaagtatatgcatatcacgtgatttccgttatgtttttggtcgtttgttatcaaaattcctaatgtaacttactggggggaaaacacaggccatttggtcgtttgtggtgggatgaaattgtgtcaacagtggtgacaagggccgagcctcacaaccaggttattattttcactttgtacattatttgatttggtaaacaaatggcacttatgcaaatatctcagtacaaactcttttaattaatgttgcatttcaagtaatgttatattgttatctacaaaatgattttgatgcatgcatttttctattaaactcatgtttttctgcatgtattataatgcattgtctcaatcaaaatgttattttattgtcaggccattctccaccctacacaaaaccgagtacttaccattagagagaatgcgagactacaagggtttcctgattgctataaactttgtgggcctgtcaaagagaggtatgtgaacccacaagttattttgttttagtttatcagtgaaatcatttaatactcgttatctcccttttactgtcaccttccttaccacaagttataactccagtcctatactaaattattttccctttttggccctcaatgattctatacttttatccataatataggtacatacaagttggaaatgctgttgctgttcctgttgctctagcattgggatacacatttggtttggcctgccagggattattgtcggatgataatcccttgacaaccctccccttcaagtatccaagttgtcttgccctttcatctcttgcagaaactgagaatgataacgaatcaagttgagattgttcccacacaatcccgttctctgtcattgccatgttaaacttgtccatatttccaactttccattttaatgcaagagtgagtgtacactaaaaggccgaaattttgtatcaataatgattgtatgtacactaatgacattgttcataatgatataagattcactttggtaatggttttgtgaaatttaagttgtagttaagaat

SEQ ID NO: 181 - DNA, 8119 bp, Glycine max
ttggtttatttttattgttaaaaattagtacttattttgtttatttttagtttctccttaaattgttttttttaagattcatatgtatttttttttaagatcgttcgaagtatttttttaagcaaaagggacataattatacatcaaagtaggaatagaaatcctaattaggttgatatagttgctttgattgatcactgtcacacacaagaaatatattgatagaaaaaaaagagaatgaacaaaacacttgaggaaccaaatcaaacccaagaaaaacaaactatttgttatttgcaccaaaactaactaacctgtctgcataaccattatcttcacgataaatgtaagtgatctttaaatttgttaggaaaaaacggagttgtactgccaaaccaacattttgcaacgaccaagggtaacacaacaaggaagaatttgttctcaaccacaagaaaagccggccattagctttaggattatctgtgacattaatagcaaccataacctcaacaaaaaatgccaaattgatatccaaattgttcgaagcattgttacttgctattgttaacccccttttttgctataaggaattcaaacctgattttcaacattacgagaaatcaacctcttttactaatcacatctataataaaaaatttaaaatttgagtttaagagaaagtaaaataaaaataaattttttgtttattaaattcaaattttctttctatggttcgcccttaagaaaaaaataggcaacatcggttcgaatccgataccgataaagggctttttccttcttctttttttgggtacgccgcttcttgctttcaccttctttctaagtaatctgacaaaaatacatggataatagtgtttcctttgttttttattttcttccttcccaacctcacgttaccaaaaaaaaaaacaaataaaagggtgagatttcattgtataaatagataattgattttttgtttatccaagacaaagaatttatttatttactcatctcatatctgaataacataaaagttaaattactcatttaattttatagttttatgatttttatttttttaattcttataatttgaaagtaatttttttaatttttattttaattattttttagtccatataattttaaaaatgatttttttagtttttttagtttctataatttttaaattaaaagataagaaaattaaaatataaattaaaaactaaaaaaatacttttaaattatgagaattacaaaagaattaaaatataaattatagacactaaaaaaattacctttaaattataggatctaaaaaggtaagaattaaatatgaaatgaataatttaagataacatggatataaattaaattaaaaaatcaaataagttgaatgaaattttttttaccttacatagattttctctctctaattttaagcgttagcgagtggcgtacgcgtacgtgtagagtcacaactattagtgaaaaatttgaccttccccgtcactggaattcatgttcccgcgcgtgcggccattttaaaaacccccccttctcttttcctcactcactttttgtctgcatctcttctccgcttgtccctctatccatcactggaagcagcgatacgctgccatggctaaaaaacgcagcgcatcagacgccaccgatgatgcacaaaacgacaccgtatcgctgcttccctcccaacgcaagaagcccaagcactctgctcctaaccccgacgcctgcttcgtcggaaagcccattccttctgccgaggcccgcgccaaatggccccaccgatacccctccgaggtcttcttttttcttctcaaccctccttcgttcaaaatcgttttttttatttattattattctctccatttttgctcattttgtttttctcgtatatatatggataatcaggtgaaaaagaaagctccagctagaagctcagaagagtgagtcttttattttattttatatttgcctattgtctatttcacgttagttacaactttaactctggtatgtttgtgactgtttagggttacgagtgaaaacagtgaggttatgctggctaggtgtcattatcgtcaagctaaagtagatggagttgtttataacctctatgatgatgcttatgttaaggtattggatctttttgctttggaattctatactttggtaaaatcagaacatgtttgaaaaaaaattaacattcttgttgaattgtttcaggccgaagacggtaaaccagattatattgcacgaatcgttgagatgtttgagactgttgataaggaacaatgttttatggctcagtggttctacagggccgaagacactgtgagtctcactttttcaatgacttgtcttttgttttttttataataattttcagcatcttttaactattttatggcttatttgttttggggttttgaatgagtgcaggtgataaaaaatcacggtgatcttgttgacaagaagcgggtttttatatctgatgtgaaggatgtaaatccccttgactgtattgtttcaaaagtcaaaattttcaaaaaaaacccaagtgtaagtgctttatagtcactttgttttgtgcaaatgcttgataatctattaatttatttaaggattatttaagcttttggaatccttatatatatatatgtgtgtgtgtgtgtgtgtgtgttattttgattcaccaatgttagttgttattcttttgttagtatgttagtaggggggtttgaacccatgacctctccctcctttttcctttcaactcttaaatccccctttccaaccatttagtcaaccttataactatccttttatataacttctagatcttgcttattataataattttcttggaaaatctagtcaagatgagctctcttaagctcatttcaacaagctttatagtcaagcaagtaaatgaattataatcttgataagaatttattgaataaatggttaactatgctgtttactaatgctatggttttgtactcatgcaggtggcttcttttaactcatcttgtgttgaaggatagtcactttttcttaaagaatttattttccttttgcctttcaaaagaataaaataaaataaaatcaaaattatgctgtttaccaaaacatgccctgtaaattgattatgtggttaaaagtgtttgaaatttgtatactacaggtagatttggcttcaaagaaggcaaaattgcctttttgtgattactattatgacatgaagtacactgtgccatatctaacattttccaacctagtcaatggtaagaatgatgtggtttttatatgaaattactagatgactaataaatggtctcttttgtttttttgcactgtactttgctgagttttgccatttgatgtgttttcctctgataatccagaaacagttaaaaccgagagtgatgcatcttccacaatttctagtgaatctggatccattggttgcgttaataatgctaatctggcaaagagaaagactactcaaaataatagttctggttcctcgcagtggactttgctagacttgtattctggttgtggagccatgtccacagggctttgtttgggtgcatccttggctggaataaaacttgtcacagtatgtagaggctgttcttttgagcattttggtttttaactgatattttgaacaatttataatgattgtttttttattatttctaagatgtgggctgtggacattaatgcacatgcatgcaaaagtttgaagctgaaccaccctgaaactcatgtaaggttttgttaacatgtaattgatattgatacttgttattgtatcttctactgatactgcttcctcaaaataacaatcaggttagaaatgaaccagctgaagacttcttaaacctaataaaagcttgggccaagctttgtgaagagtttgcattattaggatcagaacggtcagattccgatccagacatggatgaagatgagaatgaagctgtgcaaaaagaagagtcaggaaatcaatctgacttggaggaatttgaagtagaaaaattacttgctgtgtgctatggtgatccaaacggcgtcaaaaaaccaggactatattttaaagtatgttgccttcaagcttgcacattacattaattggtttgcatatttagtttaatgttgttaatgttattaggattgacttattcacgttacagttctttgcttgtcctatgtttttctttaaaatttaataggtgtctaatttttggggaaaaaaatgcatgtgtgaatgagtatcaatttaggttatgacacaacacgcacgtaccatccaacgcaatcatcttaaaatttatggctttggttttttcatatcttgaagggtagttatttggtgatttaaattattaatttcgtcaaggcatggaaagaggattatgtctgtattaatgtagataacagttcttaaaatggcgcaacatgtgctgcatagatatgactataattaatgtatttgatgtgataagatatgtagatagctatttttacaaatctaggacatgggtataacgaaatgtttaatgaaaataaagtatagtttgatgttaatgttaaaaacgctcaataacttgtagtcttgtactcattttaaaatcataaataacgaaatactatttgaaataactattgtaccaattaagttcatgaagggcttgaactttgatactttaattggcttccttatcttatgtgctgaggtaccaagaacacctttagtagtaaactcaaaacaaatgtttgtcaaagaaggtaactttaggttttgtcagcatgtccctgcttaattggatttgattttattcgatttccaagtgttaatgtagcctcttatttttttttcttcctgtgtaatgaagtttcagttaatgatgaattctgatttctgctgttaaatcactcaggtgcgttggctgggttatgattccagttatgacacatgggagccaatagatggattgaggtaaaccccttgtcatcaatattattgttctcttcagctttgctttgtgaaatttttgtttgttatgtaacactttacgccaaatctctgcaaaattctgactgattattttgtgccagtgattgcaaggaagttatgaaagattttgtgacaaaaggctacaagaaaagattattgcctcttcctgtgagtctctccattctagaataaacttaaattccttgcttacacactagtaccggttacccttggagcggtttgtcaattgattttgtaacacttaacccttgtgcagggtgatgctaactttatttgtggtggacccccgtgtcaaggagtaagtggtttcaaccgcttcaggaacgcagaagctccattagaggatacaaagaataagcagttgcttgtttacatggatattattgattttttgaagccaaaatatgtcctcatggagaatgtcgttgatattttgaagttttctggtggttatctggggcgttatgccataggccgtcttgtagctatgaattatcaagcaagaatgggcatgatggcagcagggtcttatggccttccacaatttcgtatgcgtgttttcctttggggagctcgtcctactgaggtaaggctatttatgcatgcaaattttattgttttggttggataacgttaatgttgtaaatgggaaggtaaatgacttaactactttttctttgttggatagcaattgcctccatatccgttaccaacgcatgaggtggtgtcaagaggttttgttcccactgagtttgaagtaaggactaatagattaagacaatatttctccattttcctcaagaagcattgtctttgattttaatcaccgggatctgattgttgttgtcataatgcaggaaattacagtagcttatgataaaaaggatacctgtcagctggctggtgctcttttacttgatgatgcaatatcagatctcccacctgtatgtttatttggctctgaatttgtttattaagtttggtggcttgatatgaaattttgattttgatcccgtttcttacctcttttttatttataattttccatcaattaggttacaaatgatgagaaccaggatgaaaggaactatggagctcctgctcgaactgagtttcaaagatatattagattgaagaaaaacggttagcttttgtatttgtttttgtcttttaaagcatgcttatgtttattctttgcatcaaggtctttgcctttgcctgtgtgtgaaactagatatctatgagcttctttaaaacatagttgaatattttgacatgctctacgttgcttttgctatgtctagaattttgttttggtggttgactgtagtttgatggggtaataatattcacattgctttattcccatgcatcaattgcataatactaccgtgcaaaatggatattgacattatacgatctctgttttgaagagatggtgggtagcatggctactgctcaaagcacaccacgtagaatactgtatgatcatcgtcctcttcaattgaacaaagatgattatgacagagtttgccagattccccagaagaaggttccataacttgaacttatgtgctgtcagaaaatttattttacattattctaaatttagatggtgcttgcttacttttctagggtgcaaacttcagagatctacctggagtacttgtgaatggcaacaaagttgaatgggatccatcggttgaaagagtgatgctagactctggaaagcctttggtactggtcttttgtcaccttttcttagggacattattttgatgcaagtcctttgttgagtgtcataatttatctctaatttattttattttatggtcatgcataggttcctgattatgcaatgacatttgtccgtgggacctctactaagtaagtatatgcatatcacgtgatttctgttatgtttttggtcgtttgttatcaaaattcctgatgtaacttactggggaaaaacacaggccatttggtcggttgtggtgggatgaaattgtgccaacagtggtgacaagggccgagcctcacaaccaggttattgttttaacactgtacattatttgatttggtaaacaaatggcactcattcaaatatctcagtacaaactcttttaattaatgctgttgcatttcaagtaatgttatattgttatctacaaaatgatttttcgcgcattcatttttttaattaaactcatgttgccatcttagtcgtttggacttgttatggcagtagtagttttctcttggttatgattttctgcatgtatcataatgcattgtctcaatcaacatgttattttattgtcaggccattctccaccctagacaaaaccgagtacttaccattagagagaatgcgagactacaaggatttcctgattgctataaactttgtgggcctgtcaaagagaggtatggttagctgggttcagaatccacaagttaatttgttctactttatcagggaaatcattcaatactctttatctctcttttactatcaccttccttaccccaagttataatttcaagtcctatactaaattattttccctttttagccctcaatggttctattcttctatctataatacaggtacatacaagttggaaatgctgttgctgttcctgttgctctagcattgggatacacgtttggtttggcctgccagggactgtctgacgataagcctttgacaaccctccccttcaagtatccaagttgtcttgccctttcatctcttgcaggaactgagaatgataacgaatcaagttgagattgttcccacacaatcccttctctctgccattgccatgttgaacttttccatatttattcaaattttccattttaatgtaagagcgagtgtacactagaaggccgaaaagttgtatcaatgatgattgtatgtacactaatgacattgtttataatgatataagattcactttgttaatggttttgcaaaatttaagttgtattaaaaacaaaatgtatttaagaattaattaaacttgaga

SEQ ID NO: 182 - DNA, 10154 bp, Glycine max
gtagataattaaaactaaatatttaaaatgcatgtctcaattttctaaaaattagggatcgagatatgtttattgtaataagattttatttaaattatgaataaaataaatactaacaacacactcttttaacacactctatattattaattaaaattaattatatatcacaaacttttagtctcaagtgtgattctatgagtgtctaatgtgattttgtagttttttttactaaatttatataatagtacaaatgtgtgttacaaatagtgtgttcctactttgaatgatataaagtttatattttttttcaaatagtaagaaactgaatataaattgttatcgcaaacaataaaaaaatgtaagcttaataatctgaattttaaattaggtcttaaagataaattttcatgtgtcattcaattttaaaactatgtcttaaagaagaattttcacgtgtcatacaaaaatgagctttttttttaacaaattgacccattaaaacaattttggtactaccagacttattatccctagtggtctctgatcttaagcgtgtgactcacattgcctcacatcgtctataattttaaggtcttattttgtgtcatacaaaaattctctaaggtcttattttatgtaaatctttcctcacacttattctttaaagatcccatcattataagttggaatattattaacatgatttatttctcaataattattcaatttccatatagatctttgtttacatgattatgtgactttcatgcaaggaattaggtttgattgttgaatcacattgcctcagtaaaatattaataataaatatatttgtacaaaaattaatagtaaattatggtgaaagtataaaacatttgttagtgtttctttttccattgatgggcttaaaataagtgtttagattgcattttgcttgaccttgcaaatacttacctaaataccttaatttttttttaaaaaactcaatttttccttcacaaaaaacatttttaaaattatatttaacttatgcattattagtaacacaaacaaggttagaaacaatttgaggaccacacatgtgtttggaacttcattatgtcacaagagacttgtgttaaataaatatccttgttcacaacaaaactactcaaagtagtttccaattttcacatttgttacaagcattcttcttgttaaatgcataaccaaacgcctcatatacactttttacacatccaaaaactaaataattttttttattatttaatggattaaattatcacattaaggaaccaccctaatttatatttccccgaaaaaagaaatcccaatgcattgcgtttagcccaacttgggaaacagtaaacacaaaaagaagcccaattgtaaagaaaaatatcccaaacccaaaagttcccattttacccctcagaccgaagagacgacttcagaaaggcaatgcattgttgtttccatctcattcattttcgccttcccgcccactccctccctcttcaaaaaatttcagcgcctactataaatactctcgcgcttccccattttcaaaacactcactctttctttctctctctaatttattttcgcactcgccgcaccactctcctcctccgcctccgccatgcctagcaagcgcaagaccagatcctccgcctctcccgctgccgcgccgccgagcaagcgcgcctccagatcctccgcctctcgcgtcgccgattccgcaccggtcaaatctgaagccgaggaagttgtggcagcttcctctgtcgtcaaagaagaggcgcaagcaagcttcacggacgttactgacggcaacgttagcgatggcgaggggactaacgccagattcgtcggagagcctgttcccgacgaggaagcccggcgccgctggccgaaacggtaccaggaaaaggtggttttttcttttctgccacagtaaaaacatttgaatttttggaaatgaagcgatgtgcttattattattagcacaacgcttggttatgttttgatactaagtacactaaatttcgattaaaatgacgattgtgaatttggtttttcgatctcgaagacacacgaaaatagtttggaatgtttcatataactcttgcaagatgcaaaatcaatattactattgactgaatgactgcctcatgaaaatgattttgttttaattgtgttttgggccaacttggtcctgtttttgaatataatcagctttaatttagtctgctgatttcctggtttatttaggattaaaaatggattaaggtttagaaaattagcttggtcaaaattgagcacgtagttagacacaatcaaaatttggcacctagcttatgtcattgtggttggcatcagccccatttagattagctttttagcttgtgagaatttttaagatttcaattgaaagtaatcttttttttttttttttaaattttattgaaattcccttatgaatttatagttatgaataaaaaatttatattcatgagtttatggaaaaattaaggtgtattcgttgttttcaatatcaaaagtttgatttattttatgtttttaatttttcaactgaaattattgttttttaattttttaattaatatttccttatgattttatagttacaaataaaaattataattacacatttatttataattaaattaagattaatacattggttaacttaattggttgagtaaaatgtgtactttattattagtatttgatttctacttataaaacaaatttcaaaattttaatttattatataatactcttaaaataacacagaaaatgtgcttaagtaaattgagcgtaattttacgttaatagctggttttgtgattttttactttttagttgcaactctgtatcgacaaacttcagtgttttaaagttgattttcagttacaaccccaaaatttttaattttagttattattttttgttgcttttaggaaaagaagcaatccgctgggccaaaatcaaacaggtatgttgtatgttaggacctgaaaaccttttaacattgttaattgtcatttcacatccctttcgttggagctcctcacagttggtcacaatttagtgatgatttttttgactctgttcgtatgcacagaaacgatgaagacgaggagattcaacaagctcgacgtcactacactcaggcagaagtagatgggtgcatgctttacaaactttacgatgatgcccatgttaaagtgagtcagaatttaattccatctatcataaacagttgtaacatttatgcttcaaacttgactggttcaggttgaattgatttgccattgcctcattgtttatatatgttggaaaacaattgcgctgaaaactagaaatcactgtggtcttggaagctataagtgatcagttatagattgatatgcaattatttaaattgtatgtctggtggtaaggtgtgttctccaagttgtatgatcatactcgaaacattgaaacaaaatattagacttgtaaaaaatttctatattttaataattgaatgggtatatatgtacttgttgagccatcacatattaaccttttgtatcattgattattgattatattctttgagtaattttgaggttgttgtgtgtacatttttgatatttaggcagaagaaggagaagacaattacatttgtaaaattgttgagatatttgaggccattgatggggcactgtattttacggcacaatggtattatagggctaaagacactgtaagttatattttgttctttgtttttaaatcttatgagatgtttgttttcaattattatttgatcgtaattcatttattttgaattcctcttctactttacaggtcattaaaaaacttgcatatctcattgaaccaaagcgagttttcttttctgaagtccaggatgacaaccctttggattgtctagttgaaaagctgaacatcgccagaataacattaaatgtaaatgcgctggttgcaattatattttatgtcattttctttatttttcgagtgcaattattaataatattaattttgagatttttgtaaaaattttatttattttcaggtagatttagaagcaaagaaggaaaccattccaccttgtgattattactgtgatacacaatatcttttgccatactccacatttgttaacttaccatcaggtttccttttatctatgtactttttgtatcctgttgtcattttttaaattgcttctcagttttggtatataattttcactcagaaaatggggaatctggtagtgaaacttcttctacaatatcttctgaaactaatggaatcggaaaatatgaggtgaactctcaacctaaggaagcttttcttcccgaagaaagtaaagatccggagatgaagttactagatttatattgtggttgtggtgcaatgtcaactggtttgtgccttggtggaaatttatctggtgtgaaccttgttactgtgagttctttgcttgttctgattaaaagcaattctttgaataaatcttgttttgtctgtgtttattttgatgccgttctttttcaatagagatgggcagtggacttgaatcaacatgcttgtgaatgtcttaaattaaaccatcctgaaactgaggtaattccatgtttctttgcttttatgtaaatttgttcacttcggtttagcttgcatccttgaaatacttaatatttttcaaggtagatttctattagtatgggtgacaagaacttgtgtccctggttaattgccttgcatgttaaaaagtatgattttgactgaaaaatttaggtgcaagggttagcactattgtagtaaggtaactctatctttatggaagtaagtcgatactcctaattgacttgacaagagcaaatgggtgtgaaacctgtactgactaagtgctctgcttggatgaattcaatcccagcaccagaggagtaacctttgtgttgagagtactgggtcttaatgaatcttattttggcaaaacgttctaaatgcttcttaatttaatgttgcttgcattaataactctgaacattaagtaggatgctaaactccacatgagtaggtttgcatttcttttcaaattttatattttaatgggttctgccttgttttggagtactgataccggtattgtttactcttctaatcaggttagaaatgaatcggcagaaaattttctttcattattgaaggagtggcaggaattatgtagttacttctctctagttgaaaaaaaggtgtcacatgagaaatatgtgaatctttttagtgaagatgacgatgacactagcagtaatgaagaggttaatagtgaagatgacaatgaactgaatgaagatgatgaaatatttgaagtttctgaaatccttgctgtctgctacggtgacccaaataagaaaaaagaacaagggttatacttcaaggtagtcattgttgagcgacaagctttttttcccctctggttgtaattgtaactccttagtttactacgttatctatttttgcctttttgccttagctaagattattttcattgcttttacttgtttgtctttaaggttcattggaagggttatgaatctgccctggattcttgggaaccaattgaaggtctaaggtaagccaaaatatttcagacttgttgctaatccttggaagtaggcattatagttctatttcagaactaggtgttgtgttattttaaagacagtacataggtatgttattttttttttttttttttgacaccaggtatgttttgttgatgtataataatatccatatgaagtaatgagttcacttaaaaaatataaggagttgcagccatggataaagtatatgcggttgtccaataaacgcttattgtttaaatttgctctattaattttttcatcaggggttgtaatttgctgcttttccctttaaagaaacttccttgctcaaaggatcaaacttctaaggatttttgaaatgggatgcagattttgttttcatttatatttcaatggatgaattctttttattctataataattggatattttaaagttcaattttgattctcatgtttttttgttttggataattcatagtagttttattatattcagacatgaggcaaattttgctgatttaaatattaacactgcaacagtaattgcaaggaaaagattaaagaatttgtcagtcgaggcttcaagtcacagatattgcctttgcctgtaagttccaacttccatctgttttttggtacactttctttaagaattgtatttaaatggaggtacgcattttgatataataaaatatgggtaattgtgttaagtatgcaacttatgatgtttgttgctgttgttgcttagggagatgttgatgtaatttgtggtggacctccttgccaaggtattagtggtttcaaccggtttcggaacaaagagagtcctttggatgatgagaagaacaaacaactagttgtttttatggatattgttcaataccttaagcccaaatttacattgatggaaaatgtggttgatcttgtaaaatttgcggaaggctttcttgggagatatgccttgggtcgccttcttcaaatgaattatcaagcgcgtttaggaattatggctgcaggtgcttatgggcttcctcagtttcgtttgcgcgtctttttatggggggctgcaccttctcaggtgattaatatttatctttatttttggggtatagggatatagtatgtgtttaattgtatttctttatgcgatgcagaagttgccacaatttccgcttccaactcatgatgttattgtaaggggtgttattcccttggagtttgaggtatgtgtaaattgataaaattcgctatatccatattttgaatttgaataattttggtgcatagtgggagtaagcatatgattttacctttgtataagtggtgtattatttaagaggttataatagagtgtatcctgcttattcactaaaaaaacttgttctatgttgcttggagataaacactgtagcatacaatgaaggacaaaaggttcaactgcagaagaagcttttattggaggatgctatttctgaccttcctcgggtactcttacgttattgttgcatctcccaaaccctgtctatttttgttgtgttaacttgtttattaatgagctttactttgtcaatgtgttttataggttcagaacaatgagcgtcgtgatgagataaaatatgacaaagctgctcaaacggagttccaacgattcattagattaagcaaacatggtaatacatcattaaatgtttatgcttgtgatttatagtaattcatgcataacagtatcgacacttctgtcaaagtctgcttggacacatttgttagtaatgactttgattgctcgttcatggtcttgcttcttacatcaaactctactcatttaggtctttcattttttggactagtaactgaaattaaattaacaaatattactattttggaaatttacatgtttttaaaagaatgagatactaattatgaagtggagagcatataaaagttaacggacttaccgatttagacacgcctgataatataatatatatcttgtctcgacttttgatgtggatttatgtggcaaactttccgattgattattcatttaatgaatgcgcagaaatgttggagcttcaatctagaacaaaatcgtcgaagtctttgctatatgatcatcgtccactagaattgaatgcggatgattaccaacgtgtgtgtcggatccctaaaaagaaggtttttgtttaccacaatttaacatttatttgccattatatagtactactatttgtaagtttaattttctaataatgaatttttattgttatagggtggatgcttcagagatttaccaggtgttcgtgtgggagctgataacaaggttgaatgggatcctgatgtcgaacgtgtatatttggattcaggaaaaccattggtaaccgataaatttatggcagtaaaacttttttattactatttactgttgtattgatgtttaattgttcagcatgcttacttgcctcaataaataatgttcctgttggtgagtttattatgtttggttttgttttgggcaaaactgcactcttaagttaatagcaggaggtatagaaagacattattgaataacatcttttgatgagagatatgaacaagaagctttaggtgttttcctatgaaaccagtaaacaaacatctaatccatggatatttgaatctgagtacttaatgattgcatgtcttttgatgactgcatgtatagatgtcatgatgggttgtcatttctcatgtatttgtacttaaatatgaatgcaaacgtgcaaaacattacgattatgcagcaaatactaaaattgttctgttctcccatcttttttctctgttctttatgtttatggtgtttgtgttttatggtttcatacttattgctgtcttaatttaaacggtaacacattttatttacttgagcatcctgtttttataattttattttgttttaagtatcttttttcgtgaaatgcactaattcaaaaaatgcatattatttaacatttaacttatgactttaattatcatgttttatcaatgtaatgactttactataaaaaaaatatttttcagtatgttttttaaaataattattataaaaattaaattattttatacttgtctttataatatgatttcattgacgtcacaggttccagattatgccatgacttttgtgaatggaacttcatcaaagtaagttttcttaaatattttggattttaagtccagtttgtgttgactcagattttatttatgcgagaaatttgatttattttaaatttttggtgcaattctttttcttttcttataattgtttgttgaaaaatttatttaaattaactcctaattcttagtattgtaattcttttagaccttttgctcggttatggtgggatgaaactgttccaactgttgtgacaagagcagaacctcacaaccaggtattatatttattttttaaaaattaaagtaaaattcaactgtgggatgtgacatctttatcaacagtcaattatataaatttaatgtaaaaaattataatttcttaacaatttcttctaggacccatttgaacaaaacaacttaattggaaaaagaacttacattggtggttaaagttactttgattggatatgtatgttaaaatgtgtttatacatgttcatgtgtttggatacactttttaacatgcatatccaaaccaatcaattatttttgttgttgaaggatggaaaaatcaatcaatttatgatttgttaaagttaaagtgatttaagaattactttttaaatgatgatttttaggcttgctcaaattcaaaagtgaatcttagaacatacgaaagtttaatttgttttatcatgtatttgcacttttgaatggtcattttacgtagcctgctaaatattgtttttaggcaattttacaccctgaacaagacagagtgttgacgattcgtgaaaatgcaagactccaaggttttccagatttctacaagttgtgtgggccggtcaaagaaaggtaacttttgtttatgtctttggctctttgcactttagctgcttgtgtttttgggatgtctccttgatttgaatttgatatttgttttcaggtacattcaagttgggaatgcagtggcagttccagtagctagagctttaggatacacactaggccttgcatttgaagggtctacttctacaagtgatgatccattgtataaattacctgataaatttcccatgattagggatcgggtttcttctgtatcttccgaagatgatgtgtaattcaacaacttttaataagttgcgattttgcatctgtgcaactataatttatgtatgatcggaaacattgttgtattatccagtctattgtttgagaaattgttcaatttatatattgaagcagcatttttagaaggcgcttaatttactgatgatatatataattgtagctagagttttactggtcttaatgatggt

SEQ ID NO: 183 - DNA, 5752 bp, Glycine max
tggtaagaccttgaatgctgtaatgctcatgaaagaggtgggttaagccatcaagactagtggtgtaaagaagctgattcttttcttggctcccacagttcatcttgtcaaccaggcatgttacacagttttttttcttccctttctgtttttgcttcctgttagtttttttctttgacaaatgtggtattgaaagcttaaagctctcaaatttttaacataacagcaactaacatggtcttaatttgacaagtctcattgacttagaggtcctacataccctcccttaaactgaactgcaaactgcagtcagtttacttctggtgcctagcagatctctttatctcaagaacaactacagcttcaagggctcagtcataatgccagcaatttgatcttttgaatcacagtgcaccaagtcaacaatccaatcttttgttaaatcataaagaagataaaatcttatgtgaatgtgtttacttctaccatgtaaacaggattctttgaaagtttaggccctgttcagagtgtttttaggtttttagttttaaaattttcaaaatttaaatccggttttagttttcagttttgatattttcaaaaaagaaatgggttcagttttaaaatgacctaacacattttgaaaataaacattttgtggggcacccagctggaaggtacaagtcaccaacaccaccctttcctaagtgtgcaactctcttcagtcatccacaaatagtacacattcacccacgcctttttcacctttagatctttctgttgctgctccttgatggttttcctctgagcctttgtcggcttaaccccatttgctaccgtgagaattcttgtctccaccaaatgctaatactccttagatcgaagaagattctacatgagcatagcccaatggtcataatggccatcaaacttaggtttggctggttgcacaaaattgcttccttttgctgccatctcaccctcccctattttgttcaccaaatgtttctctcacacattaggggaccacagttcctaacgtacacaaccgggccacttatgtggagctctaatgccaatttgttgaaagcttaaaacagagaaatctcagtatgggagttcaaaagctctattattcaataacaaaactgtggctctatgctggccttacaaaacaggaataaaatcaaaatataacatccatgtttacattacctaaagatatgataagtaaatctggcaaggaatagaagctatactaactacttataactaggactttattaacataacagcaattaagatgatcttaatatgacaagtcttgttgacatagaggtccaacatgtggctgatgagatgttgtactcttccttcataacaaagtgtggctgatgagatgtactcttccttcataacaaagtgtgtggtttattcagttacaggttaaacttatttggtgtttgactgtttgtgtccactttgcagcaattcaagaatatgaaatttctgactgattttcaagttgaggaatactatggagctaaaggagttgatacatggagtttgaagatgtgggagaaagtgattagtaacaatgatgtatgtttattgtttaacctgctaattgattgtcttactttttttgcggtggcttttactttcattgatttgtgcagtattgttttgggcccaatggcatttaccttaagatctcttatagtcttattaaagttaatttattgtataattatatagcttacatattttcattcattaatcatgggacacaagatattacataattaagaacttgtggtattttctttgccactatcttggtccatggccctccatccttgctcaacattgattgattctccattttattttatgtgatatttcggcctgaaaagtgtataattaattcaactactgaattttttaattgttctgaattcctagccttgaataatagttaattagttatatcaactgtaacgcccttgattgtcgtcttcttggcggcttacatattacaacacttcacacggtgacacttcacacggtgacacttcactcaacattcttattggtcagaaccctctgtaggtagcctttttcgagatctcgaaaatttgtttcgactgctttcaggagtaatgactatcttgggaagtttttcgctggatgtgttcttaagactattgctgactgtgttgaagctctgataggagcatactatgtagatggtggactctttgcttcacttaatgtgatgaaatggcttgggattggtgttgaacttgaactatcatcacttgatgaagcaatcactgctgcatctctgagtacatgtgtgccaatagaaagtgatattgcaagccttgaaaagaaaattgagtatgaattttcagtcaagggactcttactggaggcaatcacacatttgtctgagaaagaacttgggattggctgctgttatgaggtagttgcgaagtttcatatattatttaagtaattgatatttaacttgtaaaagtatagtacgatttattgaatttatggcagaggcttaaatttcttggtgactcggtattggacctgcttatcacatggcatctttatcagagtcacacagatattgatccaggggtgttggctgacttacgttctgcttctgtcaataatgacaattttgctcaagttgctgttagacataaccttcaccagcaccttctacatagctcaggattattagtgagccagatattagaatatgtgaaggtcatttctgaatcagatcccagatcacttccaagtattagagctcccaaggtttagttttgttgatcattatggtttattttttataatataaagttacttatatgattgtaattacttatttgaatttctgttgcattatgttttgaattggaatatatttgatttagaaaccaattacaatgcttgaaactcgttacaacatattttaccaaatctggttgttaactgtattattcagtgtattggggttgcaccatgtatacccaaatatgtacaacaaaaatgctatctaaaagataaaccaatctaaaaagtaaaatataaaccaaacttatctaaaagataaaagataaacccatcttatctaaaagataaactacttatctaattacaatcaacaacattattttccttgatttgcaaattgttttccatgttttcaacaccaaacgaagatgagtgaaattcattttatttcaatgactttattatattacccatacttggaatggatcaaatggataaactaataaaggcaaaattgttaatcaattatttaaaattaggattagaaataaatcaaatttacacaaatgcaaccaaattttgttggttttcgacatgcacacaacacaaatcaaggcgatttacaaaatcaaagcaagtcctattttataaagattatcatttataaatagagacaattcctgaagcatgtggctccaaacatatacctggcacttcttttaagttgtaacattgttatttttgttataaatgtcaggcacttggagatgtagtggaaagtattgtcgggcctatactaattggtaccaagctaagtcttgaccaagtgtggaacgttttctatcctctattatctcccattgttactcctgataaacttgaattgcctccatttcgtgaattaaatgaattatgtgattcacttgggcattttgtaaaagtaaaagaaaattgtgaaaaaatgggatcagcaatgcatgttgaggttagtgtacagcttccaaatgccctattggttcgtgaaggaaaggggccaaataaaaaaactgcaaaaggagaagctgcttttcatttgttgaaggatcttgaggtttgttgtttaatgattgtgttctggtccagtccagtctaccttacctgaaatgaataagattttttgggcatgaattttaatttatttttttatgaggaacttgatttgtaaagttgattagttattttaattttttttcatattactgctatctttatttgtatatatttcgatgaccacttggcttatacttgtgatgctacagaagcggggaattttacatggtagtctcatgtccaagggaaaaagagacaatcctgaccatatctatgattcatttcatctcaaaagggattctagtatttgttcttctctaattgaagaacattcctcagagccagcatcacataaaaggcacacattggatgaaactaacttaactgcatgtaagttgcctcccaagtcccaaagactcttgcagtgacatctctggttttgatagcaagttttgtcttcccagtgacagtgtccacttctgggaaattttctccattagcttctttgtatggttgttaagtgttttgagtttttgagaagaaacagacaaattagagcaaattgaagtgatgggtttatttccattgtctatcatgcaattttcttattcttttgttccattttacccatgcatataattttggtctatctaaaattatttatgaagaatggaaaaatatcagctattcagttctgtgagacatctgaattgatcactcctgctgtagcattcattaaccaaatcatagataatgctatgagtgttgtatgaagctagtttgatggggttttgttcctatctcaaagcaaatatgttttaattttcagcttaatgtgaaaagaagagaaagagagtagagtagatatttttctttgcacctagttaaattggtagaaattcaattcagatatcatcatatttgtcaaatataatatattaaggggctgcaaatgaaaggattggtgcttagtggtctctctaccttgtcttctttttgtcattttaaacccgtttattccctgctattttcaaatccaagggcaatgagttaatttattatctacctatagattaacttcattttggattcatgttacacagttaattgatcaatgaatatgaaagggaggaccacggaccacactatatgatgtatgtaagaaattacagtggccagtgcctgcatttgattcaagagaatataaagataggtgagtccgccaactaatttgtacttttaattgcttgagcaactttaatctgaaaagatttttttattatgtagtactacatgaaggatttgtgtgtgtaatatgtggagaacagaattgatccctaaacttaaaggactgaaatcatctagcaaaggaaacaatcaactagctacagaaactgaatgaaagagtattacaaaatcaaacaatatagatcatactcaaaatgtcatataatatttctcatacttattctgatttctgacaatccaatgtatttgaagcatggggtttctttttttagggaattgtttgcaccaccttacatcatgcatttcaaaaattggtttgatatggcaaaaaacggattttaaatgatattattgtttatatatgatttgcagataatattttgttctagaatcggtagtgctgtgacatgtgaatcggacaagtttttattttgtcacagatctctatttgaatcctgtgaagggctgcaaggaagcaagggacaaaactgtttctttgtcgaaaattaccttgtgcatacccaattatggtaatatagaatgcaaaggagaagctagaagtgataagaagagctcctttgactctgctgcaatttaa

SEQ ID NO: 184 - DNA, 21767 bp, Glycine max
gacatcccaaccttgccggtaaatatattagtggctatttttattgccgtttaaggcaaaatatataattgcattaaaatgtctgagtgtcatcattatatattgacgtgtggttaatataatgaatcagacttaaaagtccactaccgcaaggcctattgcatgtgaccctaggaatggcaaagagcatctaactttcctgccaagtgaaagtcaacctaacttgtatcataaattttctgatgccaaactgagagaggaactgtatagaaattaaccatgtactcccatatcaacatataccaaagcttatagtgttgcttgaaatctgtgtttctatgcaccatgtttgttcttggaccagttcaaatcaggtgtttatgtacagaaaagattcagtttccttttgataatgttttctaagcttttagctgttctaaataagtaagctttaaaggttattgtcaatggaatgcgccccaccatggaccgagcccgaggctaggggtgccctttcccactttgtttctcatatttggatatatgctttctaaggcttgtatagtattagagttattaggaagaaattggttacctctggtagcttttctgttaaatgctagttacaacttatcatcatttccatgctttgtctataaatttgacatcatgtactgtcaacagtgtgagatatcattttctaccgaatatcataaataaagaaagtgtttctttctcttattagtgtttcctgatatatatatatatatatatatatatatatatatatagtggagaatatagcgcctgcagctacattagccgtgttggacaagctcgaagtgaaacttgttggcattgatggtggggtgcgctttttattgtcataaaagtaaaaaaaaaataaatattttataacaaatacgttcctccgtgccaagtaacctatttttactaatagttacacttaatcgcgaaatatatttgtcacactcctataaactaaaatttgtatatttttattttttatgattgtatttgttagcaaattataaaagtgactattaaaaataaaagaagaaaggataacgggaaaaaagaaagaaagaaaaaataaaaacaaatttcgccatgtgaaacttttaacacatatttttatttaggtgtgatcacacatatgttatcatatatctaaaaagaatatatatatatatatatatatatatatatatatatatatatatatatatatatatatatataaaaataatataatataatttatagtgtgattaaaaatataaaaaataaaaaatattgacaaggtgtttaaaataaaaattgattcatattacattactcttattcttatcaaatcaaaggaatagttaaaaactaactaaggaatagttaaaaactaactaaagccagttcacctcaacttgaaatgaaataaattattattttttttttcttcaccctttggaaccttggatcaatcgttggacacttaacctaaccttttcgttccaccgagtcacatgaagaaaaatatgacaaaccaatcttgtccaacacagctatttcatttttactctcgcaagatgcatagaagtttgctttggcactgtacacctcgtctactctagcaaacaaacaaacccgacgtatacttctgaaactcacttgactacttcacattcacactcactgttctgcgttgcgtcctacgtagtaaccaggaccatgaattccaacattgattcaacagaccatagccaggatcaaagcagaaaacgaaacctacccgatgctgatgattctccggcgccgaatttccacattgattcatcagaccataaccaggaccaaagtaaaaaacgaaagcaacccaatgatgaagattctccatcgcttgaatcgccttgttccaacatgaaccccagaaggtgcctttttttccctctgtttttttgggtagacacttcatgaattttgcatcttcttcatttttttatttaagaaaagccattttatttgtttgccccttcttttcgagttttgcatttggtgcgggtaatgttgcaatatgcatgcatgcccccatttacgcttttcgtgttttaggcataagggttttggaaataataatgataaagattgcatttttcttattttctagatcctttctcttcgagtttgataataaagattgcgtttttttttgttattttcttgctcctttctgttcgagtttgatcataaagattgcgttttttttgtcattttcttgatccttcctcttcgagtttgatcataaagattgtggttttgctattttcttgaccgagtttgacagagggaaaattttgtttcttttatcaatcatgcgttttgggttttccctataggtatcagatagaggtgtatgaagttgcaaggagaaggaacactatagctgtgttggatacagggtcaggtaagaccctgattgctgtaatgcttatgaaagaggttggtcaagccatcaagactagtggtgtaaagaagctgattattttcttggctcccacagttcatcttgtcaatcaggcatgtcacacagttttttcttccctttctgcttttgcttcctgttagtttttttctcccacaaatgtggtattgaaagcttaaagctctcgaaacagagaaatctcggtatgggaattcaaaacctctattattcaataacaaaactgtggctttatgccagccttacaaaactcgaataaaatcaaaagataacaaccacgttcacattacctaaagacatgataaatctcattaggaatagaagttatgctaactcctaataactaggaatttattaacataacagcaactaacatggtcttaacgtgacaagtcttattggcttagaggtcctacatatcctcccttaaactgacctgcaaactgcagtcagtttatttctggtgccaagcagatctcttaatctcgagaataactacagcttcaagggcttagtcataatgtcagcaatttgatctttcgaaccacagtgcaccaactcaacaacacaatcttttgttaaatcataaagaaaataaaatcttatgtcaatgtgtttacttctaccatgtaaacaggattctttgaaagtttaataaatgagctatcgtcacaaaacaccacattgaactcacaaagtggcaccaacaatagacccacagtaaggctttttggttgcacatcttctcttcttcacagcttcttgagcaatatccttcttatgttgctttcggtactgtctatgttttatattattcctgattttgtatttattattagaatattctatttcctattaatcattaattgattgatcttgtaatcaatactgattcctttttccacattattagcatgaggtgtggtctacattaacacacaacattacacagtaaaatactgttatatggtatctagagcttaagttattcttgacagaggaataacgaaaattgtgttccaccagggtcagtaggtccctggtggatctctttgctaacatctctctttccggcaatttccccccttttcgccacaacattccttccgtgtgaacagtaatgcgcaaacggtgagtgcgcttacactgccactgcattgccatcagattgtccacatacaagctaactataagaaatcttcttcattgttctgtctttgtaaacaaagtgggctgacaaaaacatttttctaacatctccttggcaaaataggattcaatattattgtaccaaacttgaggagcttgcacatttattcttcacttgcagcaatatcctccctttatggtgggagacaatgtcctgggtaaatttatcaacagcaatgcctcaaaatcctaggtagggatcactacctgcagcatggacacggggttgctgaagggaaaaagtcgacaagatggaagtgttggtggattgccttaacatccacaatctggcagcacagaaataaaatagtcttccaaaatgctacttttgatggaagtaaattgatggatgatgcggtccttttaatctggacatggatcaaaaccatggagaaggactttgtaatgcatattaatcaatggtcatccaatctcaaggaagggtttaaaagttaggagggactgggtgtggatggattatgtaacatattagtgtgttttcagcttggtccagcttaaaggatggaaccctgctggatgcataattacccatatgtatccatagtaccactggtactatttcaatctataatatatctatttttgctgagcaaaaaaataaaataaaatatagggctttttgattcttctcatacccttaaggttgctcaataaacactgcctcattcaactcaccatgcagaaatgcacttgttacatcaggctggtacacagtccacctttgtgggctacaagggcaagaatcattctaatggtatcccgactagctactggagcaaacaccttggtgtaatctattccaaactggccacaagccgagctttatatttatcaacctcaccattgtcattcaacttgctcttaaatatcgatttcactcctattttggctccatctagtaatgctgctaattcccatgttccattcttctcaaaggctttgatttccaaatccataattatgagcatttggcagcttcttcgaatactgaagttaggggtggactctgatcaatccaaaccaaattgatgagaaaaatctgaattggttcaatttggattttaaaataccaaacccaaagacattggtttgggtgtttgaaacttgcagaacccgaactgaaccaaacaataacgattctgtgtgcaagttggatcaattgaaggaggtgagcttgtacactcatactattttatgagttggactgcaaaattgacaaccacagttaacttcttctgggtaggggtgatcaaattctcttttgggaggactcttgggtggaaagagggattaggttaaaagataagttcccggaattatacaatctctcatctcagaaatttcacacagtggcaacgatgggaaccttcagtgaatctgggtgggaatggagcttttcttggaggcgaaatctgtttgatagtgaaatgggaagagcttctgagtttattgatcaaactgctgcaattaggccttctacagctttaaaagattcttggttatggggagctgactcaaaaggaattttttccactaactctgcctaccttgatattaaagctgatcatcttaatgaagatcaatgtcttggtttccagcacttatggaacatcaaaatccctcctagagccctagtatttgcttggaggcttctatgggacagattgcccactaaggataatctacttaggaggaatgtcactattgataatgacctgtgccctttttgtcagaacaaagctgaatctgcctcccacatattcttcttgtgtcctaaagttatgcctctatggtgggaattcagctcatgggtaaaggaacctagagtgcttcattggagacctttggataatttcatccagcatttctctacggcaggtctgaaagacaccaacagaaagtggaaaatctggtggatagcagctacaacatcaatatggaatcttagaaatgacattatcttcaacaataagccttttgtcatctctaaattggtggataatacaattttcctctcttggtcctggatgagggggtgggaaaaggattttcatgttccttttcaccaatggtcctcagctatggtagtagcttttaagtaatgtttgtcttgttgggatgggttgtttggtttttgttgggtcggtagcttctgtttattgcggtttgtttcaggaggctctacctcctgtggtctgttatagtacctctggtactttgtatcttctatctttaaactaatatattatatttttggccgttaaaaaaaaaaagttaacttcttcaacagtagtactccaattgcacttgtcatcttccatgatagttcgaccaatagcctggaaaaggtagtttttcacctttagatctttcagttcctgttccttgatagttttcctctgagcttttgtcggcttaatcccatatgctatcatgagaattcctgtctccaccaaatgctaatactccttagattgaagaagattctacatgagcatagcccaatgttcataatggccatcaaacttaggtatggcttgttgcacaaaattgcttcctttcgctgccaactcaccctcccctattttgttcaccaaatgtttctctcacacattaggggactgcagttcctaacttacaccaccaagccccttttgtggagctctaatgccaatttgttgaaagcttaaaacagagaaatcttagtatgggagttcaaaagctctattattcaatagcaaaactgtggctttatgccagccttacaaaacaggaataaaatcaaaatataacatccatgtttacattacctgaagatgtggtaagtaaatctgacaaggatagaagctaaatggagatataagattagggagggggaagaggccgcgggttcgaatcccccaactgacatttctaacaaaaactaacacactaacatttgccgattaataaaaaaaaggaatggaagctaaactaactacttaaaactaggactatattaacataacaacagctaacatgatattaatatggtaagtcttattgatttagaggtccaacatgtggctgatgagatgttgtactcttccttcataacaaagtgcatggtttattcagtcacaggttaaacttatttggtgtttgtgtccactttgcagcaattcaagaatataaaatttctgactgattttcaagttgaggaatactatggggctaaaggagttgatacatggactttgaagacgtgggagaaggagattagtaacaatgatgtatgtttatttattaacctgctaattgattgtcacaaagatactttaggcttactttgtttcggtgaattttactttcattgatttgtgcagcattgttctgggcccaatggcatttaccttaagatctcttatagtagtcttgttaaagttaatttattgtataactatatagcttacatgttttcattcattaatcatgggacacaagatattacataattaagaacttgtggtattttctttgccactatcttggtccatgtccctccatctttgctcaacgttgattgattatatggtaccattctgtggttgtcatgtgtttatgatgctcttactggtttttgattctccatttttattttatgtgagatattagcttgaaaagtgtataattaatttaactagtgaattttttaattgttctgaattcctagccttgaataatagttaattagttatgtcaacagcattgttgtggtgaaatattattcaaactcttgtttgattagtttgtaataacacaatgaatcaacaagtattcattttaaacaagacagtgtattgttaatttcattcttaaatttttggggtttacttagtgttttgtaaaacaaagaatattctatagaacttagtcttaaagcatttatggtgtttagatttgaagctcagaatttctggcacttgcaatgattcttaataatgaatttgtaccatttaaaacaactctgttttttggggaaattgttgttatttgataaaataaataggatgtattaaaggaaaaaaaatcaatgtggagagcattcgaactgctcccgtgtgttgaatatttctgctttattattatatttaaattcttttatcacaactataagtattaacaagcatcactaagttgttttcacttttgatgattatcatttatggttctaagtgaattttcaaatagccttttgtgtgaacctcaagtctcaattatgctgataaactcatgaatacccttgacttagatctatggttgctattaatatctttctgtcttttaggttctggttatgacaccccagattcttttggatgcgttaagaaaagcattcctgcgtatggaaatgatatgcttgattgttattgatgaatgtcatagaacaattggcaatcatccttatacaaaaataatgaaggtgaggctacaaaatattatcctttttttccttgtaggtcatgcatgatttctctatcttcttgtcaattaaaatttttggggttagagaatagatttacaaatagctattgtcttatgccaatgaaggaattttatcaccaagctaatgaaaagccaaagatttttgggatgacagcatcacctgttggtaaaaaaggtaattgtttatgtgccaactttgacagcatcaccggttgaaaaaggctttccttgtaatttgtgactatccaatttattccccaatcctcatatagagggttcttctttgtttatttattttgtagttagttttgcttcttcattctcattttaaaaaaaaatccttgtgattcatcaatacaacatccattgtaaatttgaatgtcttatttctttcactaaaaagagtaaatgaaaaacacacttaagaagacaaatcagtgaagatgactatgactacctacagtaagaaagaaacaaaaacactaaattagaagtagaacaatcttctgaaactggtaaatagctagtacttgattcattttgttcaacttacttgtgccccggaagtgtattgttttcacatgttttattagagtgtgcccccatttttaaatttgtgacctgttaagtatcaccaaatttcttaccttccctgtcatatagtatacttttttcttaaattgtatgatgtatgtctgttttaaaagagtttggtcctatttatttcccctcgattaccttccccatgatggggaaaaatttgttttgtgatctgactgctaaaatctctgtatagttttttttttaattatttgatagaatgaaagggccttttagggtaaaaatctactcaatctgccttgcctttgtgctgcttccacttacacaaaaaatatatattttagattcaacattcttgtataagtcttccaacgtgattatagaaactgaaaaacattaataaaaaaagagaaaaatttaaaagtgtatttgtacttgttttacttgtatttgccacccaatttcaaaacaacaaatgcttataatatagggggcaaatgctcaaaattttgaaaattaggtggcaaaatgcatgacatattgaaagttgggtggcaaaatgtgcaaatttcatagtttggtgacaaaattcgcaaaaacgtgaaagatagtggcaaaaagtgcaattattcttgtaacataaaaaataaataaaaaataattttattttaggaaaaatactatagtaaaatgtttaaattttttcgggttaaatttaattttttaattagtataaaacctttaacacatttttatactctatttctttaacttctatctttcctatttatttttctcttatttctttccattctatttcatttctaatctatatagagcaaaaaagcccttccaagggacagctatggttttaatcaatatgttttgtgcgaaagatgaaagttttagccattgctgcaatttgcaatttaaaaaatatggatatgcaatttatctctgcttcaaatacaaccatcaagttaactttcttttcatataaaataaaagctctccagcaagcgtatttatctagttattttaaattagaatttgatgtatttatgccatgatttgctgtgccctgcctcctgatgaagctcttcactgtgcatttttttaatgattgcttttttcttaaggaattattattttgtgatgttcatattacgacaatcacttggagtccatattgtgaatataaagacttgctataatatgtaatttatgtattatatcctgaatcaggtgtttcctctactatggattgtgaggatcagatatcagaacttgaaagcatcttggattctcaggtaattaatctcttgactttgatttgaactaatttttccacgagtgcacttgtgatagtatgtttataccaataaaaggtaaatgcttttttttgtttttttctgtagagatatactgttgaagatcggacagagatggataggtgtgtcccatctgctaaagagagttgtagatattatgaccaagcacgattttctgctttgagtttgaaaccaaagattgaagccttgtcgttcaaggtatctgtgggtcatcttgctatgtacaaaatacactgcttttctgccccgtactcgttatttcttacagcaaaagatactgactgaatttaatctgtttggacagtttgatgcattgttatcagaaaatcaaagtaactataaggatgtggaaaataaatttaagacactttctcagcggatgtccaatgaacttgcaaaaattttacattgccttgaagatcttgggatcctatgtgcttatgaggtatttatcaaactttcattgcggggaaaaagttgtgcgatacagaaaaagaaagggaagcttttgtttaatggaattttaaagctgacataatttctgatgtttttaacaagggtttactgctgccagtaaattattaatgttttgtaattaaggaagagtcactgaagtctctatttttgaattggggatatattttgttaaccaatccattgcttcttataaatcagatgaaaaatatcaactctcacccacttaaagttttttgctttgaggtggggtagaaagtcttcctgatatgtaaaaatatcaccatatagtcgcattgaatttacacatttatatacatacaccaataaggggttattgctgatggtaaattattaatggtttgtaattaagcaagactaattaaagtttctctgtttttgaattgggtttatattttgttaacaaatcaatttcttcttattaaatcaaattaaagatatcaactctcaattaacccacttaaagttttggctccgaggtttctttcttttaccttcactgattatgtgtagcaagcaaatcttaatgatatgtaaaaatatcaccatatattagaataaaatgtacatatttatacacatacatcagtatgtacatgtagaaattgacaagccaccagatttttttaatcataggcttatcttttgttcctgacacacacacattataacatgtctagctttacgcaggctgttaaaatctgtcatgagaatttttccaaatctgaaggagagtgtgaaatttacagaaaaggttatcttcaatgtataacttttcttgaagaagtaatcaaattaatcgaagaatccctccatcttggtatgatttttttatagtatcttcccccctccccctatttgggctattgatgtttttgaatctttatgcatttttgagaattgaaattgcaagtatctatatctaattcaggcaatctggaatatttttattagtttatctgctactagtatattttaagaaattctttcgaactctatttgtcataatatgtggcaagattttatgctgatgctatagtatgtagcaatattttatgtcaacaacaattttttattcatgtttctttggttttagaatagttagtttcctctttgaaagggccccatttgcagactttccattggtgcattctgcttttgacatcacaagcaatctgttgcaaagccaaaatgctgtggataaatggatcttcctttgttggtttcatattcagttcataattagccaaaaaattacagtagcatgtccttttagacagcttttggagaaatgacacatgctaaatgcttatgaggctatggtaatttgttcattcattgcactttgccttaatctttgctaactaattaactattattgctgcagctgataaaaagattttggaggttgattttaattattctcaggcagaagatttgggatacatatctcccaaattaattgaacttattaaactctttcagtcatttgggtatggagctatgatctgccgttctggtcatataaatagtttttctatgcaataaagttgtattacatatcatggtaaattggtaatctatcattctttgtctttatagagaatctagtcaggtgttgtgccttatttttgttgatagaatcattaccgcaaaggtgatccaaagattcgcaaagacagttcccaatatttctcatttcacagtttcctatttaactggtaacaatacatcggttgatgctctggctcctaagaggcagaaggagatattggattctttccgctctggaaaggtattttgtttattgcatcatgtgaaacaaatgatgtacaataaatttgtcctaaatgttggtgttgaaaatctaataatagattattaattctttttttaggtcaatctattatttactactgatgtacttgaggaaggaattcatgtgccaaactgctcatgtgtgatacgttttgacctcccaaagacagttcgtagttatgtccaatctcgtggaagatctaggcaggcaaactcccaatttgttgtgatgttggagaggcaagtattctgattttcacaatctgtttgatgttggagatttcttctcccctgaacactcttagtacttatttaaggattgtgcagtccagattttgaaagaataatatgcaagctgggaatggaaaacatctgttctccagcttgagggggagtgttggaaatatgagcatttaatgtttatttcctttccaagtagcttagttaatatttagctgagttcaatgtatcttggaaagttgtgatattttacttgttctcttgaaaatagctttagttatttattatctatgtaatcattctgattataaatagatcaatctgctgggtggaaggataaccgaaaagcatattaagaaaatagtctttgtttctctcttttcacacttaattatcaacattaacccttgtatctacaggggaaacttgaagcaaagagatcaactctttgatatcattaggagtgagcggtccatgactgatgcatctatttataaagaacatgaatctagtttaagggcatgtatggtggggaaaacaaatgcatactatgtggaatccactggagcatctttcactttagattctagtgttagtctcatccaccgatactgtggaacactccctcgagataagtaagattatatcctgttgtccttgtatgctttttaactatttgaaattgaaacatagtctttacatacttctgcatgcaatttggattaggtactcctgtgtaaagcccaattttgagtttctgtctgtggaagggggttatcagtgtaaattaatattaccatctaattcagctttccaaacaataattggtccttctggaaaagatatgcgtttggcaaagcatcttgcatgtttcgaagcttgtaagaagctgcatcaaatgggtgccttaaatgaacatttggttccattaattgaagattcttcagaagatgaccatattgtgaaaaataaagaatcaagttctggtgcaggtataatttatctgctaattatttttcatttattttttttatcattgtctgtaaattgtggggaaatattttgcttaatttgaaattttcattaacacctcagacttcccaaacaatggctgtgcatatttcaaatatcatttgcaatttttttaatacaatttttatcccttttaactacatgcagcactgcacaaattgatttaataataaatacttacaaaacatcacccccgtgtattttgtttgcaaacaaccactacgaacttctgaatctgtgttgcaaaatttgcataattgattttttaaattcatacaaaaaccatttgtctgccgatgtgtgtttggattagctgtgagcaaaagattatccattagttgattatatgtatgatttatttttttcaaatcaattattataagattagtttcatgtttagaagatgtatgtactgaaaagtgatttcatggtaatatgtttatttggattgtatgaaataatttaaagaattgttttttggtggcaaaaaagtatttctctgccctagttgtgaaataagcaagaatcaataataaagcttcaattttatggggaaaaaattgtttttaccctaaggcatcaaccttttcaaaacagtgtttatgatgataaaagtctattatatggtagtttttcatttgtacttctatttttgtaattaatttttttttccttctaattattcaatatttttcaatgttagaaatacaataaattaaatagatactattggtcaaatgcaagcatgtgatgaattatttccatttattaggtataaggtaaactattgtgagtttatcaaccctcaacaagattacataaactcatgagtttgacaatttatgatgttatgttaggtttggatatttggtatttttaatattattttggtataaggtaatgattttattgaccctccacaagtttacacatgctcccaagtttgacaaccatggactgaatgagtatgcatgcagatttgaaatgtttaagcttcatgggacctatgtcagaatgtgtcggatgttgcattgttccttttatataggaatctactgaatgtttgtttgcattgaaatgcatgttgattttgctttgcttttgacatttgaagggaccacaaaaagaaaggagttacatggaaaagctaacattcatgcattaagtggtgcatggggagacaaactcactagagtcaaatttaatgcgtataaatttgaattcacatgtaatattgtaagtgaaatatactctgggtttgctcttttgattgagtcagagcttgatgaggatgtgggaaatgtaaatttagatctttatttagtctcaaagattgtgaaagcttccgtctcttcatgtgggcaagttgatttggatgctgaacaggtataaaaataaggattgatccaaagtagtatataggactaatctcattttgttttgaaagttaacttgatgctttgttctctactagatgatgagagcaaaatgcttccatgagctttttttcaatggtttgtttgggagactggtcttgaagtccaaatcagcaggagaaagggaatttttacttcagaaagacacaaactcattgtggagcccaaaacacttgtatttgcttctaccactagagaaattgaatgatatctgtgagggatctttgcaaattaattggtgtggaattaattcttgtgcttctgctatcaaatttttaaggaggaaattttctttggtcactggagattgtgatgataacggcacaatcacatcacctcatgataccagttcatcagagatggaatgtgtaggagcaaacaagattcactttgctaattgtgtggttgatgctgataatataaaagacagggtagttttggccattcacactgggaaaatatattgtattattgagatcgacagtaacctatctgctgaaagtcctttctatggaaacaatgaaaaatcaaaggaaagcattaccttctcggattatttcagcaaaaggtgcataaattgttttatcccgcctcatgctttttcttgcccaatcaacttaaaattttgatatactttactaaacaacttaaaattttgatcagttatggaatttcactgagacatcctggacagcctatgttacggttgaagcaaagtcataatccacacaatcttcttttcaacttctatgaggaaggttagttgttcctaattgaagtttttatcttgtggctcttaaatgctgtttcaaatttctgtattatgattttaatgagatttcatataaaattaaaatttaccatctcagttgaagttgtcttatggaatcacatttgacaccctgatgatttgaaaaaatgatagcagatatgaccttctctattactttctgtcttgatagaatttatgtgaatcctgcatgcaccatcactttgattatgatattttctttgagttgagcagatgcacgagacaagtcatcaaaaattggccctgcagcctcaaaattgccagtgcatgttcatattcctcccgagcttctatacattcttgatgttaaaagagatgtgttgaaatcactgtacttgctgccatctctgatgtaccgcattgaatctttgatgttatctagtcagcttagagaagagatagatggtcaaactagcaagttcaacatacgtagctcactggtttgttctatatacgattttgaataaaatactcattgattgttgatgtctattttcattatgataatcttatgcgttttttttttctttttgtatatgatagattctagaatcacttacaactttgagatgtagtgaaagtttttcaatggaacgtcttgagttgctaggagattctgttttgaagtatgtggtgagttgtcacctctttcttaaatatcctaaaaaacacgaaggacaattatctgccagacgatcatcggctgtttgtaactcaaccctacataaactggggacagatcgcaaattacaggtattcattactgtttttgtttttttggtagcaaaacaaattctgatgactcgggagacaatcaaactcttaaccaaatgatgaaaactttgataccatttaaaaaaccattggatgattcatcaggtttagctgctggaatagttattttctaacaaatacaattccacgccatgcatttattcatggcatgaatgttatttgtctactattatggatgtcagtatcaatattgaaaactataatttacgttaggcaagtccgggaaattattattttcattgttttcaacagattaaaatttgcatatagaaaaattataaaagtcctttcagttcccggaccatcctgcttttgtaattcccacctttatttttgtgttttttttataatttatcattatgggatttttaatagtgggcaagcattggaatgaattaatcacatgtttttttgtcatgttatccgttagggatatattcgagactctgcttttgaaccacgccgttgggttgctccaggacagcgttctatacaccttgtttgttgtgattgtgggttggaaacccttgaagtgcctttagatgcaaaattccatactgaagatccaaaagttgtggttgggaagttttgcgacagaggtcactgctggatgtgttctaagactattgctgactgtgttgaagctctgataggagcatactatgtagatggtggactttttgcttcacttaatgtgatgaaatggcttgggattggtgctgaacttgaactatcattggttgatgaagcaatcactgctgcatctctgcgtacatgtttgccaaaagaaagtgagattgcaagccttgaaaagaaaattgggtatgaattttcggtcaagggactcttactggaggcaatcacacatttgtctgagaaagaacttgggattggctgctgttatgaggtagttgcgaagtttcatatattctttaagtaattgatatttaacttgtaaaagtttcttaatatgatacacatataatacgacttattgaatttatggcagaggcttgaatttctaggtgactcggtattggacctgcttatcacatggcatctttatcagagtcacacagatattgatccaggggtgttgactgacttacgttctgcttctgtcaataatgacaattttgctcaagttgctgttagacataaccttcaccagcaccttctacatagctcaggattattactgagccagatatcagaatatgtgaaggtcatttctgaatcagatcccagatcacttccaagtattagtgctcccaaggttagttttgttgatcattctggttaattttttattatatagagttacttatacatttgtaattacttatttgaatttctgttgcattatgttttgaattggaattgattagatttagaaaccaattacaatgcttgaaactcgttacaacatatttaccaaatctttttgttaactatattattcagtgtattaggttgcagcatgtatacccacatatatacgacaaaaatgatatctaaaagataaaccaatctaaaaggtaaagtataaaccaatcttatctaaaaggtaaaagataaactgcttctctaattacaatcaacaatatgatttgccttgatttgcaaattgttttccacgttagcaacaccaaacaaagatgagtgaaattcattttatttcaatgactttactttattacccatacttagatggatcaaatgggtaaactaataaaggcaaaattgttaatcgattatttaaaattaggattagaaacaaatcaaatttacacaaatgtgaccaaatttgattggttttctacatgcacacaacacaaatcaaggggatttacaaaatcaaagcaagtcctattttataacttcccaaataaagattagcatttataaatagagacaattcctgaagtatgtggctccaaacatatacctggcacttcttttaagttgtaacattgttatttttgttataaatgtcacaggcacttggagatgtagtggaaagtatagttggggctatactaattgataccaagctcagtcttgaccaagtgtggaacgttttctattctctattatctcccattgttactcctgataaacttgaattgcctccatttcgtgaattaaatgaattatgtgattcgctcggttattttgtaaaagtaaaagaaaattgtgaaaaagtgggatcagcaatgcatgttgaggttagtgtacaacttccaaatgccctattggttcgtgaaggaaagggggcaaataaaaaaactgcaaaaggagaagctgctttttatttgttgaaggatcttgaggtttgttctttaatgattgtgttctggagttttcttttccctttttgttagttttaaggtcttctaaaatctgcccatattatcttaatctgagtcggtcaatagtttatttagggagaatgtttattttgagaactcccacagacttctttcttttttatgaataagaagctagtagacgcttctagggaaaacattagtcaaaattattcctgataataaaacatgggtggttttatggtagataacaataatgctattaaatacttaggcaagctgtagaatatacacacctaaacatataaaatggagagatataagcttctcaatttgatcatgcttgaaatttcccaaaagaaaacataatggaccaagctaacaaaatgtataaaatatttcacccacctttctccctggttagtttcaaatttgtccttctccaagtgctgaactttttgtatagcctagcttctttaattggccccaagaaaggattccatactcgataacaaggtaagaataaatagctagcagtactgcctacttttgcgctaaacacaattacaaagcaaaccatcataaatttttctgacattatttgtcgtccagtccaccttacctgaaatgaaaaagatttttttggaatggatttaattttttgatatgagtgaagttgattagttattttaattttttctcatactactgctatccttattagtatatattttgatgaccacttggcagaagcagggaatttcacatggtagtttcatgtccaagggaaaaagagataatcctgaccatgtctatggttcatctcatctcaaaatggattctagtattctaattgaagaacattcctcagagccagcatcacataaaaggcacatattggatgaaactaacttaactgcaagtaagttgcctcccaaagactctttgtaattggtttctaaatcaaatagagcaagttgaagtgatgggtttgtttccattatctacaaatgaaaggattggtgcttagtggtctctctaccttgtcttctttttggcattttatacccttttattccctgctattttcaaatccaagggcaatgagttaatttattaactacctacatattaacttcattttggattcatgttacacagttaatttatcaattaatatgaagaagggaggaccgcggaccacattatatgaagtatgtaagaaattacagtggccagtgcctacatttgattcaacagaatataaagataggtgagtccatcaactaatttgtactttcaattgcttgagcaacttgaatctgaaaagtacttttgttatgtagtactacatgaaggatttgtgtgtgtaatatgtggagaacagaattgatccctaaactttagggattgaaatcagctaacataggaaacaatcaactagctagagaaactgaatgaaagagtatttcaaaatcaaacaatatagatcatactcaaaaccgtcatttctcatactcattcttacaatccaatgtatttgaagcatggggtttctttttttagggaatcgcttgcaccaccttacatcatgcatttcaaaaattggtttgatatggcaaaaaacagattttaaatgatattattgtttatatatgatgtgcagataagaatattttgttctagaattggtagtgctgtgacatgtgaatccgacaagtttttattttgtcacagatctctatttgaatcctgtgaggggctgcaaggaagcaagggacagaactgctttgtgtcgaaaattaccttgtgcatacccaattatggtaatatagaaagcaaaggagaagctagaagtgataagaagacctcctttgactctgctgcagttcaaatgcttcttgagctgcaaagactgggaaaagttgaaattgatcctctcccttctagttaggggaagagaaaggaaagaaaagggaagggaaggaaaagaaaagggagagaatataagagaagggatagtaccccaattttgtgcccccaaaaaacatgaactgttgttttgtgccattgatctggtaaattctctcagattaatggcagaggaccattagtttacagtatttttggggttgcaaatttgtggtactagtattgtgaccaagaagagaaaatgattggaaaaaaaaaggattgaaaaaaatgaggtggtgtttgagaagattcaagtgagaataaacagaagtccttttcctttcctttcctttcctttccccagggaaggaaaagaaaactcaaacagcaaaggttgatcaattttattcataaaacataaaattgcagaacatgactttgacgcaataatattgcatgtacatgaatgtagtagctgttcttagggcacttgtgcatgtatgtagtatcttgttcaatttttttccgtacataatttaagttgatttcatcttcatatacacgaagacacttttatcctgacttgtcaatcctcatctcactctggcacgcggtgatgtgcaagtgcaagcataaagttgcaccaaagtatctaagtctttcaataaagaatgttgggcgtgggccgggtgggtctttgaagtatgaatatggtaatttcatttattattgttatctattgtgttatttctt

SEQ ID NO: 185 - DNA, 6649 bp, Glycine max
ctccaaaactcagaggatagaagtttcctctgatcacaatcaactggttgctcttcacaaagtcttacctccacgtcatctaactcatctaccacagtccttatcccaaaggataaattcccataaacctccttatgccactccttgagcttaagcttctccttcaaaacaaagcacttccaactttggacctggatctaatcccaccaacttcacaaatcatagatgttccaaccaacaattataaaaatatagggccccgatccttcacacctaccttcagaaaagtgagcaatggttgttttattccttataaattatatttgttttatttttaattcttaaaataatttagataagactttgaatattgaaaaaaaaaattataaaaataaaattaaaacaaacataatttataacaattaaaaataaaaaaagtcataagaaaaaattaaaaggattaaataaatatttaagtctttttttaagtgtctttttttaagcgtcattttttatctaatgaatttgtcttgatattgctgtttttattaaattttacttgagtgtgtcaaatgtattgatggtaatagtacttttcatctatacatttataattttttttcttcttctcacttattctctcctactttctaactctctctctctctgtttttttagggttaattaagtttttagtcatcaaattatgaggattttaaattttttatccataaactattttttaaaatagttgattttaaataattttttgttattataaatagtccttaccgttaataatctttattaagtgataagttgtctatttaagtgaatataaatatcaccatagactccagatgagaaggatgaattgttaatctgtgtcgcaaatcttctcatgggtgattattgtacgtttatgtgtgtttagagcgttaggattcaataatcactatcctctcttccttttgcattttaataacataatattctaattatttatctaaatataataaaacttacatggtatgtatgtgatatatatacatgtgacatttaatctatcttgtttcatgacacttcatcacttaacaaaagacattaacgacaaagattatttttaataataacaaattattttgggatcaaattttttaaaaaaatatgttaggaacaaaaattcaaaagtccatagtttgaggactaacaacttaattttttttttttatgtaacagttactgtgcaaaaactaaaaagcttattgcacgggcacactcctctgcctctcacttttattttacagcattcattttttttttcatttatcacttttttcataaaaattgaattgtctaaactaatctagtaataataataaatgccaaagaaaaaaaagagtgtatgtaatacaaaagagcgtgtcagagaatgttctagaacttacgatgtattcaatttaagattcctcaaggtgggccattttttgagtctgttcgtttttctctatctctgttccttaaaagcaaactcatacttcacgttcttctgtttcaactctcaattaacaaacccaaaacatgtttctcctttgatcttgttcttctctagtacgcctcatgcagttccacaactacgtggttagcaacatttttcttcttttttctcgggttccttaagttttaataccaatgtaacaatgtagtttccgtaaccttgtagttttgaggcatcttccgttcattcttctacgacttgggttctttagttttaattccaatggaacagtgtagttctcgttacgtagtacttttgtctgcctcagtttttaaaacacaaaaatgaagttttagttttactgcagcatttcattgtgtaattaattccttaatttacttgttttctcactctctgatacattgatagtgctacgaacataggaaacttgtttgtggagtcgagagttcttacttatctgctaagtcatggtatgtttcatgtcgttccctctctaaatttaccattactcattctatatcatacccatacaaaaaactttattttagctcaaggttaaagcttcagcgactaatttgtttcactgccattaagcttgaatatttgaacacctgcggtttagatttgttgattacaagtttggtagttagaaatagaatattgattaagctttgaaaactcattcctttgttgagtttttttttgttgtaaaattatgtagggttcagaaggtgatgatagctctcccagtgactatgattggaacactgatgatgagcttgaggtgtttggaatacctccctcggatccaaccatttctagtcaagagagctgtgaagatagtgtgggggtaaatcctgcattcagttacttcacaatgattttgctaagtttgagactttcatctctctgaagttcctaggatatacctacaatgatataatgatatagaaggacctaagaggggattttgtgttgctcttgtccctcgtgtattcacttgtccggtggttaaattcacacataatgtgtctaaccctttgtttgtttgcaaaaatgatttgtggacactaagaagctatgtgacacctaataagagaaagagagaaatgtaagtatgataataagaagagatagataaaaaaaaatgataaaatgttatatatcgaggtatttggactagagaggtgttcaccaatcattacttgtttgtttgagaggaaagagaaaattttgaaatttgaattgaagaaaaaattgaattttatctttaaaggtcaatttttctcttcaaacaaattaaagaaaatgtatagttatctgtgttggtgcaaatttgttttttgtatttctttttataatgttgaagtattctgtgttctgtttaggagagtagtgcaagttgctcgagcgctaaacattccaagctgattcatctcttcgtgggaatgggattttccagagagacagtgatcaaagcaattgatgaaaatggttctttttcacgtttaatatattcaataactattacctgtttactacttctagtacttgtcttgaaatgataacattttgttttttgtccgtggtaggaagagataatgaggaggacattatggaagctctgctaacacttactgctgtgagtatactttaagtcaatcaacgggttttaaattatttcaattttttaagttattagttttcacttccaggattcagtgcattatatatgttgattctgttgaagtagaacaaatgaattacaaggaataacgaattgactttacagggaagaatctgaagttctagagtgtatcatggattcatggtaggaaaattataagagtaggaatgtagctcatgtcattggattaccaacttaccacaattgcattaccagatgaagtctaaaactctaaatttaatataaggttctccattacttgtatttgatctttaattttctgatacaaggttgattaaacaattttggtacatctaatagtaagttcacatgtcatttctagttagtgggtaacatatatctatattgtgaaagtatagaagtttgcagcagctggtggatatattataggtcgtggttgattaggtatatatatgaagcatttagaacagtaggctttgttttacaaactggcacgtgaatagaaactagaaactagagagatgttctttgcagatacatacttaatctggatggcctggtttgttatgctgacattgtgtatatgggttccatttaactggttccttttatgcaggaaaaacccttaacagtagagaaagatgaggcattgtccgtacttgtcaatatgggatacccttttgaggaggctttgacagctatagacaaatgtggtgcgtatactttactatataattgttactcatatatgttattaacactttttatgtttcttatttctttttcttccgttttttcccactatcagcagcattaaatgatctcagatggataattaaatcctgaaaaatgagctaacaaacctttagttttaaaactttgagcttaaatttctcagtttgcattttaacacatttccttattaaagtgataatttcaacataggatagatgaggtcaaattatagtgataatttcaacataggatagatgaggtcaaattatgaacatctctttggtttgaatacaatgcaaataattagtcacgaaaccaaatgagttttactaacctaacatgcaatgcaaggatagggctcctactttccatgtagcatgtagaaatttgtctagtggtagttctttaatattttggtttctcgtttggcaggtcctaaggcccatatcagtgagctagcggatttcattagtgcttctcagttagaaaagggtcttcactcaccgcaagagtcacctaacaataaacatgatgcatctgattatacgcatgaaaaggtgtggtttacagtcctatcaaattagttttattaagtcttcttctaattaaaatgtcagtaaatcaagtacttttctcaaaattatgttatatcttcagccctgtcaaccaagtggtgaatattatcttcatacaagtaagaaagtaaaacttggattgggtatatttaatgaagccagtcaagtgatttcaagaaagttcccaagagaagtagcaaataaaccatacttctattttgaaaacgtggctcttgctcctaaaggagtttggaaaactatatcacgttttctttatgagattgaaccagaatatgttgattccaaatacttttgtgctgcaacaagaaaaagaggatatatccataatcttcccacccacaaccgctcccccctgcttcctatcccaccactaactatccaagaggcttttcctacaactaaaaaatggtggccttcatgggatagaagaacaaagctcaattgccttctaactagagtagcccctggcccagttacagagagaataaggaaactccttgagaaatttggtgatgaacctcctctacatgtccaagaaaatgtacttgtagagattagaaagtggaacttggtgtgggttggaaaaaacaaattggcacctcttgaacctgatgaatatgagatgttgctgggattcccaagggatcacaccagaggtggtggagtcacccggacagagagatacaagtcacttggaaatgcatttcaggtatgctattgaatcttacactatatgtactttttaagagtttttacagtgatgatatgataactaaatgaaaaaaaaaatcaaacttctttctattgtaggacaagtcgacaacttgtagttaaatgataattttaaaaggttctaatcaaacttaggcttctttttgtattttaactcttaaagatgtatttcatttgtccctaattataagattttttccattaattcacgtcctttaattaaagtagttaatttagttaatcatattaaatctatcaattatttatactatcatatcaaaattacccttttcttatctatgtattcatttaattgtttttcattaatgtttggagaaagaataattaagtaagaatatataggaaaaaaataattaatacatctaaaaatttaaaaaaaaagtcttataaaaagaaacaaataaatttctgaaaaagtatttgagtaaacaacttatttactatgctgttatcttataaggactaatgccataaacatcaaactttttttttgacaggagaccatcaaacttactgaaatatgctaaaaagaacatattttgataaaaagcttgagttgtgatactcgtacaacattttatagaacattttttgtgtctctctctctttgtgatacatgtatgagttgttgtatgagtatcatttctcaaaaagcttatagtagtcttaagttcaaataagatttccataagttctttcaaacaccctcttggcttcctttgaaaaagctctttgactgaatgtaaatggaattgatttcaggttaatacagttgcctaccacctttcagtgttgaagggtcgttttccaaatggcatcaatgtcctgtctcttttttctggcatcggaggtgccgaggttgctctgcatcgacttgggatgatgcttaaaaatgtggtatctgtggaaatagctgaggtgaacagaaacatcattcgcagttggtgggaacagactaaccagaggggaaacttaattgaggttgaagatgtacagaaagtctcttcaaatgagctgagccagtggataaccaagtttggtggatttgacctcatcattggaggcagcccctgcaacaacatttctggcagtaatagagttagtagacatggactagagggagagcaatcttcactattttacgaatattttaggattgttgaggcagtaatggaaatacagagagatgagcttctgtgaaacaaaaaaaagtacatcagtggattttgttaattcccatttttgtatggaacaactaaaaattatgtacacataataggaggaggagaatccaatagatccaagaaatgtaacaaaacatttgtaatttcgaatttatcttatattggtaatgtttttatgttctttttgtcacac

SEQ ID NO: 186 - DNA, 6649 bp, Glycine max; identical to SEQ ID NO: 185

SEQ ID NO: 187 - DNA, 7892 bp, Glycine max
aatctcttaccaaatggactcaaatgatcaagtcccacaatcacaaaattcccttcacccaaaatattttgactcaagaaccttattccaaaggtcaccattattgttaaataaatactatttatattttgccaaaagagtaaaattgaaaaacaatatatctttaacccttaacccctcccccataagcctttggagaacatattttttccaactcacccaagatacattctccctcccatcctcacacttcacaaaaatcttttttgtaatgtgttgaactattgacaagtatatcaatttgcacaagtagtaattaaaacggtaagtccaagtatcgtgtccacagataatttgttttacttagatgtcgtatattcagtgtgtaaacattttcaactttggtaataaaaatagagagacccattcattgtttgattttctttgattaattcttctaaacttaaacaaatgacaaattaaacacaaagatgtagaacgaaataaatatcaaaataaaagcgtcggggagtattctattgaacttcctcttgtcgtactaataaatttttctctatttaacattactctagcattcttgcaccatcgatttactcagaccatgattcattacatgaaagagcctaactctcttagtttgtgttcttgattcctcaacaaactcattctaatggagttgtactacgcacaagatgcaaaatatattagattactgcactctattcttagatatacagacctctagctgctctaccaagttctaaggattctaagcattttccaacacccaaaacctaaccaagcatacaaatggatgattaaaccacaagtatgtacaataaacacagatagaagcaaagaacactaaaaataatattaaataaatagttagaagttttacattaagaatgttcagtagagaaactccccaacaatgaagtttctagccctccagtaacaaggagagctcaatacaaggagaaaacaatgtttgaatgaaagaaaatggtgaaagtatgaaaaaaatgtcttctctttagctctggtgtcgtcttccttctatctcaagtcgtcactccctccaacttcctctcttctcagtgttcttaaagacttttgggcttctcagcatacgaaggcgcgttcagttgtctatttttttaaaataaaataaaaataataacaatttttaaccgtcattatattaaattaattattttaaaatttaaaatataagcaaagttaaattttattaacaaaaaagtaataaaatgaaacatttgagagtaaaaactatttttttaaaacttaatatacgaaaagtaaataataaaaatttaaaagaacaatttaaacaaatttttaatgataaagaattatttatttattttatatttaaaaaccatttaaacataattttgtaaaataaaattaatgttatattaaccctaattcactttgtagagtatgatttctacatttctttccatttcttttccttactcctcccgaaaacaaaaccagctctagagctggtgttgcaatcaaacggttcagatcaaaacacgtggactgatttgtgagaaactttgtccctgattaacgtgtccccagcgggagtggaacacagaaattttcacagaaaaaactgcgcgagtatggaaagtttttccatgcttgtgttgttgcattgtccctgaatttgtacttgattctgggacgtcactcagtctgagtctgtttctgcaaatttcaaaaccctctctctcgttactcgccatcactagcgagtgctccttcttcctcttcgcgaaattcgtatgcgaagaagggttgtgttctctctctttgccgtttttgtttgtttaattttgtgtagttttacgaggttgaatttgagctgacgtgcattttttttgagttttgtgcagaggtagggattcgcgctcctgctttctcagactggtagggattctaatcgtggtttgtgaatctctgtgttgtttgaatttgtaatcggtgttgaattcgtttgtttagggtttggcatgattttaggcttgtgtgtttgattagcttagttttgtgtgatgctaatactcttacttctgtgcttgggcagcctaattatcttttattctgcgaagtaactgagagattgaagatggtatgagcatattttggttctttacgagtcctcattcttagtttctttgggagaatatcttagtttctttttggcagggaggagatgattctggtttggagagtgacaattttgattggaacactgaagatgagcttgaaattcagaactataactcgtcgtcttcatgtttaacccttcctaatggagatgctgttactggctctggagaggtaagcttttagagactttttctttttctttatgttttgagtggttgaatattaagaattttgaggatatattaccagaaagtttaagataatgcaaatacgttgtctttggcaactataaattttcttttgggattttggccttctctaattccgattgttgctggcgtacttgataaccaactaaccataatgaaccaaaatgataaactaaccttgcaggtcaatgcagaaagaaaaaaaacttccggattgaaaccatacaaaactatttttcatgtataatgtctattttactgtttagattttgtggaattcatacatgtattaatttttagctactaatgtcctattctctcccccttcaggcaagctcgtctgcagttttggctaattccaaggtgcttgatcacttcgtcagcatgggattttctagagaaatggtttctaaagtaattcaggaatatggtaaagcatttctttattctatttaaatatagatttgattcataaagttcacaaataaatattgctctgatgaatatccaggtgaggaaaatgaagataaactacttgaagaacttctcacatacaaggtgagttaatgttttcataagtcttgagcattgttgtgacctttgtctctttgagctattattgaattataatgaatttctcttccgtagttgtcttgcctcatgttttcgaaattaataaagagtttcatttccatattgtgaagttgttagcatcttacaatctacacaatgaattgtgaatcttgttggttttcattggtagttaatttttttgggccatcctgtctaatctggagagggtgagccttgtagcaagggtaaggttgctatcttgtgacttggaagccacaagttcaaattttgaaaacagtctctccacgtgcaagggtaaggttgcatacatctacacatagcagtcaataatgcactatagcggattggtggaactgagtggccatggactgctatgggattcaaatagcataatggtttttatcagtggccaaaatagtggcttttcatgtgctatggcactatagcggcgctaccatgatatatccttcaaaaacccatttttacccctggaactctgttgtttggggtatttttaggtaaaatattccacaaaaagttacctctgttttgacctttgatccttcacactttatacgactgttttttcacgtgttcttttcttcttttagactgcccatatcacatttttctaatttttatctaatttgctatacacttttctatttttgtcatcatcttttttttatatatatatatttcccgacaatgttcttaattctcttagattgtgtgtgtaatttgtgacttgttattcatcttgaattcctttaattttggtacctttcattttgattcttttgttctactgacatatttttagatttctttctgatatctttaatataccatttgcatattataagtttttgactattatgttacaattgtcttgatatttttgttttcatatttgcaggctctagaaagttcttcccgtccacagcagcgaattgagccagatccttgttcttcagagaatgcagggagttcttgggatgatttctcagatactgatattttttctgatgatgaagtaatctcttctttttgtgctttgatgttttttttagactgtatgatctgattcatcttatatcttgttattatctgcctttagtgtcatctagtgggatggtttctgcttgtgctataggacatgcaatgtggcatgtaatcattttcaaacatgaaacagattaggatggtttgtgtttctttgttgggcatcttagggacttgtacaatttcattttcctacttcaaagaaaaatgaaatgtcatcatgcttccacttgcttttacaaacatttatgagaggtctggaattgcttgctaggaaacaataaaggggcatgttatatattataagaaacagcctgcttattttatttgatattttttgtaggaaattgcaaaaactatgtctgagaatgatgataccttacggtctttggtgaaaatggggtacaagcaggtggaggctttaattgccatagaaagattaggtgcgttttgtatgatccattcatatgtatggcttgagttgttagcttgttatttttgcaaaaatgatagaaatttattttattattgttgcttgttgtatgatactgattcattatcttcaattggttttgagcaccttgatttgtgtcccttgggcaattgagccattaaataaaaaaaaatattgctgctcgattatttttgtttcctaggtttaaggattgatattctatttactgtaagttgttggatattttatatgagctcttagcacaagttgttgtcacatttctaaaatgcatctctgaaagctttttctgggtgaacacttcatattcctaatgtttgatttagacatactaaactcttttacattggaatttgaatacttgtagtttcaaatgtgattatgagtgcttgaagaatgaagaacaaacattgtcatctaaacaccttgcattatataatatgctttagttaagtgtccagctttatgaagatttaatcatatagcctttttgaaaggtccaacactattagtttcatagagatcgggatcaactagtccagcaggaccatggttttgaagttattcttggaatctttttaatgaatcaatgctatccatcattttcatcactctcatttcacatggttatccaggatagtgtttcctcattctctgccacagtactaactttttgaatgtctcagtggattcctacctgctgaatgcatatcaatctgcattttatactattgtatactcaagataatggacagaacatatgtgcctagtagttttttcccttgcctgaagtgaagattacatgcttcaataatttccagagaagagacaaattcatttcagtttggaatcaccgttattgtggataatagatgatgaaaatcttctaatacgcaatcaccttatgaatatactgtaattacttctagcgaagaatgatttaattgctaacactataatcagggttgcatgccagatataatggctataaatcatcatatgagaatcagatcatgtattatataattatctctaaagaatgatatactgtttaacgcatttgtgaagcttgtataataaattaataggtcctaaattttggtgtttttccaaatatcaatttaaacaaattaacatggtcaactgcaataataacctcacacagtctcttgtttgtttgtgttcgcaagtttacatagtgtctgtttatgagctttttactctattttcttggctcattgttctaatgaaacactgcaggcccaaacgcctcacttgaagaattggtagattttataggtgttgctcaaatggcaaaggctgaagatgctcttctgcctcctcaagaaaaggtagcaatgtagccataatggtaatctttggatgaataaaatagaaatttaatgcatttaattttctgtaaatttttccttcaaattatctagcatcatccatttgttgctcccccttccccctttcatttatctgtcacatgtttaagttattttaatgttctttttacagttacaatacaatgactatgctaagtccaataaacgaagattatatgattatgaagtgctgggaaggaaaaagcctaggggatgtgagaagaaaatcctcaatgaagatgacgaggatgctgaagctcttcatcttccaaatccgatgattgggtttggtgtacctacagagtcaagcttcataacacacagaaggcttccagaagatgccattgggcctccttacttctattacgagaatgtagccttagcaccaaaaggtgtttggcaaacaatttcaagattcttgtatgatgttgaacctgagtttgtagattcgaagtttttctgtgctgcagccaggaaaaggggatatattcacaatctccccatccaaaataggttcccacttctaccacttccaccgcgcacaatacatgaggcttttcccctaacaaagaaatggtggccctcatgggatattaggaccaagcttaattgtttgcaaacatgtattggcagtgcaaaactaacagaaagaattaggaaagctgtagaaatctatgatgaagatccacctgaaagtgtacagaagtatgttcttcatcagtgtaggaaatggaatttggtttgggtgggaagaaataaggttgctccattagagcctgatgaagtagaaacgctgttgggcttcccaaggaaccacaccagaggaggtgggataagtaggactgacagatacaagtcacttggtaattcattccaggtatgataattccctctcttcctatataaataatgtagcctccatagagatccttccggatgtgtttactgtcataaagaaatgtgataccgcttggaactattcagtaatattttaatttttatgcatattcagatgaatcaagtagaggaagaccaagaataatagaaagaacctgttaaaaatgatttatatgtaaataacctcttacctccataaagaatattgatttttggcagaaccctatggcaacattcaatctatgttgtgagaccttagcaaaggctttggtttgttgtattaagaataatgctgtcaaagtgaaatcatatgcagtttcagcatgttttctcttctatgaaactagtggttaatgcattaatgttatcacgtaaatttctctttccttatttggttcagtttatttcaggttgacactgtggcataccacttgtcagttctgaaggagatgtatcctaatggtatcaatcttctttctctcttttctggaattggtggggcggaggtagctcttcatcggcttggcatccctctcaagaatgttgtgtctgttgaaaaatcggaagttaataggaatattgttagaagttggtgggagcaaacaaaccagaaaggtaatctatatgatatggatgatgtaagggagctagacggtgatcgcttggaacagctgatgagcacatttggtggttttgatctaattgttggtggcagtccatgtaataacctggctggtagcaacagggtcagccgggatggactggagggaaaagaatcttctctcttctttgattattttaggattctagacttggtaaaaaatatgtcggccaaatatcgatgatttttgtcccaagaagcctctttctccggttttgtatttaatccaaacaattaggatcttcgtatataaacctgaaacattagagacagatacttctcattccatttttgttgccaaagaaaggcaacgttttcaaataaaaaaattatcttaaaatttctgattccaggttactattttattaatacgt

SEQ ID NO: 188 - DNA, 7892 bp, Glycine max; identical to SEQ ID NO: 187

SEQ ID NO: 189 - DNA, 11232 bp, Glycine max
taaacaggtaaaaatatataacacgaatctatcacaaagtgatctaagatttcaatttagaatctcctattaaaaatattctccctcctaaaaagtcctctagtacaacattattctagtaaaattctattgtcatggctctatacaaacaagattttgagcaagcaaattgaatttctcaatatcagaagatattacttattgcctagtagtttatcacaaaaagatgcttgaggttcgctaaaaatgcaagcttcacattatttcaagtaatttgaacgactttctcaatgatggttgttgtcctgtcgaaagaaaacaatcactttcatacctataagatataaacatgttattaactatttttaattatgtaaattatattttgaatacatatataaatgattcaaattgcaatataaaactatttcaaactatcaacatttaaaaaaatgattaaaacttaatataaaataaaactaaaataaaaatattggattagataagcaaataaaaaaaatactcatataagaatataaaaaaaatagtttgtaatatttatgtaattatgtcataaaaagtttaacttattataaaaaagaccatataaaaagtacattttaaaatatttaattaaaaattaaattatgtattctaatttataatacaacaaataatttattttgtcctaatatattattttcttatttttaaatagtatttaaaataataaaattatacaaataatacttaaagtgttgaattttcatgactaaatatcatttttagtctattatgttttagtattattttattttaatacattaaattttaaaaaatttattttaatatttttttatttttcattaataatgtttaattctgtttgtttaacataataaaggttaaaaatcttcactatctttattttgttctttccccttgaacatcattacacgccgccctccgtgtcgctagccacacaccattgtcctttaaaatgtaagcataattaaaacaaaataaagagatgatgtttttttgttgtttaaccttttaaaacaaaataaagacagtgatgacacttagatttcactatgtttgattaatttttttaaaatttaaagtactggtgaagttaaatgttactaatgtaaaataaaataaaaattaaaataaaattttcaaaaacataaaaaaaaatacatttgactaatattaaaatttaaaagaccaatttaaacaaacttctaatgctaaagaattatttatttacttttttattttaaagccattaaaaaatatttaaagaataaaattaatgatttatttattatattttaaaagaatagaataaatggttattgtggagtaacatcaatgtcaaaaatccttatcactaaggcaacttttttcacctgactcactctatcgagtatgatttcttaatcatactcgcgcatcacaccgttccctcttattttctttccattccatttcctttggtgttgcaatcaaacggttcagatcaaaacacgtgctgattggtgagaaactctgtgtcccccaaccgtcggatttccctgattaacgtgtccccagcgagagtggaacagagaaattcccacggaaaaaagtgcgcgagtatggaaagttttttccatgctgcattgtacctgattcagggacttgattctgtctgagtctgtttctacaaatttcaaaaccctctctctctcgtgagttactcgcaccactagcgagttcttcttcttcttcttcttcgcgaaattcgtatgcgaagaagggtttgatctctctctctctctcttttacttctttatttatttttgtttaattttgtgtaattttacgaggttgaatttgagttgacgtgcatttttttgtgtgttttgtgcagaggtaggaattcacgctcctgcattctcagaccgttaggattccaattgtggtttgtgaatttcttctgtgttgtttgaatttgtaatcggtgatgaactcgtttgtttagggtttggcatgattttaggtttgtgtttgattagctcagtttttgtgtgatgctaattctcttacttatgtgcttgggcagcctaaatatatcttgtattctgcgaagaagaagctgagagaggttgaagatggtatgagcatattttgtttctttacgtgtcctcattgttagttttctttgggagaatatgtggttcaaaataacctttttattttgattggcagggaggagatgattttgattggaatactgatgatgagcttgaaattgagaactataactcttcatcttcgtgtttaacccttcctaatggggatgctggagaggtaagcttttagacactttattctttttctttatgttatgagtggttgaatattaagaattctgaggatatataacaagaaagtttaagataatgcaaatacattgtctttggcaactataagtttttcttttgggcttttggccttctctaattcctattgttgctggcgtacttgataaccaactaaccatgataaaccaaaatgataaactaaccttgcaggtcaatgcaaaaaaagaaaataaacctttcgaattgaaaccatacaaaactatttttcatttataatgtctattttactgtttagattttttgtaattcatacatgcattaatttttagctactaatgtcctattctctcccccttcaggcaagctcgtctgcagttttggctaattccaaggtacttgaccacttcgtcaacatgggattttctagagaaatggtttctaaagtaattcaggaatatggtaaagcatttctttactctatttaaatatagatttgattcataaagttcacaaataaatattgctctgatgaatatccaggtgaagaaaatgaagataaactacttgaagaacttctctcatacaaggtgagttgatgttttcataagtcttgagcattgttgtgaccttgtctctttgagctattattgaattataaccaattttctcttctgtagttgtcttgcctcattttttctaaattaataaacagttccatttccatatcgtggagtcattagcatcttacaatctacatgatgaattgtgaatcattgttggttttcatgggtagttaattttttttgggccatcctgtctaatctggagagggtgagccttgtagcatggttagggttgctatcttgtgacttggaggccacaagttcaaattttgaaaacagtctctctgcatgcaagcataaggttgcatacatctacccatagcagtcaataatgcactatagctgattggtggaactgagtggccatggactgcaatgggattcaaattgcagaatggtttttattagtggccaaaatagtgggttttcatgtgctatggctctatagcggcgctaccatgatatatccttcaataacctatttttacccctggaactctgttttttggggtattttcgggtaaaatattccacaaaaagttacctctgtttcgacttttgatccttcacactttatagggctgttttttcatgtgttctgttcttcttttagattgcccagatctcattttgctaatttttatctaatttattatattctttttctattaatttcgccatcatcattttttatatatttcatcacaatgttttaatgctcttagattgatggtgtgtgattgtgtacagtgtgactttttattcatcttgaatttctttaattttggttattctttctagtatttatatattttttttaatcagcgaaggtaatattgtattatatataaagcagtacaagttgtactgtgaaatttacacatggaggccaatttgagcagtaatatggtgccctaatacaaggtatataacatgaattaagaaaccataattctaacaatatagttggcccaaaactacccacaattagagttatcccaccctaatcacaaaatgcctccctcatattactggaccagtgatgaaaaggtatgttgaaacctttatccaaattttttaaccaagtccagcataggaaaatagcatcctccagcagcttactagcattaaagctttcatctgcaaaaacaatcctatttcgatgctgctagatgctccatgtcaaggagatccaccagcactgccatttctgaaaactgatgctagtatccctcccaaacacatgctggaggaagtgctgtctcggactttgcggaaatgctcttgaaatgtttgtccacgatattgatccccaccaaagtggtagaatttttctgcaactaaagaaaaggtgtgctgcatcctcttctttatttttgcagaatgggcatgtgggatcatttatttccacatttctcctgcgtagattcattttagttgacagtctgcccctgattagtctccacgtgaagaaaaaagctttactagggacctttaccttccacagcacagtaaaagcaccatcctgattttcatcattgtggtctgtcataagcatcttgtacgcgttccccactgtgtatacaccagatgcatcttccttccaaattcacttgtcttctcgatccgagtgaatgttgataccttctaattcttccaagaactttgcagccatatctatctcatcatcaaaaagttgccgtctccattgaaaatcccactcccagcctgtagctgtgaaacttcccatctactgtatgacatgttgttgctggtaggaaatagagtaaagtctagggtacttcaacttaagtgatactccatcctccttccatccatcctcccaaaatttgacctttgctctacaccccacttttcattttatccctttatctagccagttgccatcttcaccggaatgagttatgagattgatgtccttccaccatgctgattcactgctgccccttctttccccatccaaaatccgccatccaccatattttgaaatcagtatccttgagtccccttggttatggaaaagcttccatctccactttccgaggagtgcataattaaacttccttaaatccctgattcccattccccctttctcctttggtagacacactgactcccactttactcatgctatcttcttttgctccattcctccaccccacagaaaccgcctgtgtatccacaccagctagtccaaaactttattgggaaccctgaaaaaagagaagtagataggaacaaaatttagaactgacattatgagagtgacccttccaccaaatgaaagtatttcaccaactttctctcacatttcttgacaataggatcccaaacatcactatgccttgggtttgccccaatcgggatacccaggtaaaggaaaggtatggccaatagactgcaatttaaatacctagcagcatccaccttccatatctccgacatcccaattgccccaaaactactctttgagaaattaattttgaggcttgagacaagttcaaaacttctcaaaatcaccttgatcgcattgacatttttcatggatgctttcccagagaaaatcgtatcatctgcatactgtaagatactaatttccacttcatttcttcccattaggaaaccttgaaacatgtttttctctgttgcttctctcagcagtccattgagtccatccacaacaacattaaataaaaggggagctagtgggtccccttgtcttatacctctttggggaatgaactcagacgaagggctaccatttaccaatatggagatagaggcggattttaggcagccctcaatccatgatagccatctatcgcagattcccatcctccttaacatgtactacaagaaattccaggagactgaatcataggccttttcataatctactttaaacaccaagcacaacttgttgcttctctttgcttcatgaattacttcatttgctataagggtgctgtgtaacaaatgtctgccctcgacgaatgcagtttgtctctcatctattattaatggcagcacccccttcatcctcctcgctagcaccttggccacaattttatatatgctacctattaaagaaataggcctatattcatttaggttcaacggatcattcaccttaggaatgagagcaaggaatgaggtattgcaccccttcgggaacgttccatgaacaaagaattcatccatgaaccgaagcacatcagccttgataacttcccaaaactccttaataaatttgaaactaaggccatctggtccggggctcttgtcgctcctgcattctcacacaacagcctttatttctttttcattaaatggctccgacaatctgacattgtgttgctgtccaatggctctaaatctgaccccatctagtttgggcctcacccaatcttcctcctgaaatctgttcttgaagaacattctagtatttatatgtgtagcatatactatattctttttggtttgtattatactagcagtcattgcacttactgctatcctgcagtagcaatttaggaattggccactacatatattgctatttgagattgataactatgcatctacgcttcctaattttgcatatttttagcagacttgtcattgcagtcaatttgcaatgatattagttcatgaaatgaaataaaattgtgtatctttgtgtaaaaaaaatagcagttttaatttatattgtatgaaatataaggcaaaagactgatggctgtatatttattcttcaaacttagaggaaaatgctttctaaaaaaattatgcatttaaatttttaaactgatttcatttacatgttatgattctttcctcttatgaagaaaataacagtttcttattttaatctttcaatgattgcaattttgcttctactaattttgtctcaactctttagttgtgtaagatgtataggtggggttaattgagcagcttgatcaccctaaaaatggtaatatggaaatttgggtactgggatggtaaattctttctacaactataatagtgccttaatacatttgcaataatattttaccaaactcaacaagtgatctgtgtggttcttttgtgcatataattgctccttttttaaccatttacctatgtcattttgtttcttttgttctactgacatctttagacttatttctgacatctttaatataccatttgcatattataagattgactattgtgttacacttacacatgtcttggttttggtatttttgttttcatatttgcaggctctggaaagttctccccaaccacagcagcgaattgagccagatccttgttcttcagagaatgcagggagctcttgggatgatttctctgatactgatattttttctgatgatgaagtaatctcttctttttgcactttgattttttttagactgtatgatctgattcatcttattatcttgttattttcggcctttagtgtcatctactgcgatggtttctgctagtgctataggacatgaaatgtggcatgtaatcattttcaaacatgaaacagattaggatggtttatgtttctttgttgggcattgtagggacttgtacaatttcattttcctacttcaaagaacaatgaaatgtcatcatgcttccacttgcttttacaaacatttatgggaggtctggaattccttactaggaaacaatataggtgcaggttatgtattaagagaaacagcttgcttattttatttgatatttttttgtaggaaattgcaaaaactatgtctgagaatgatgataccttacggtctttggtgaaaatgggctacaaacaagaggaagctttagttgccatagaaagattaggtgtgttttgtatgatgcattcatatgtatggcttgagttgttagcttgttatttttgcaaaaaatgatagaaatttattttaatattgttgcttgttgtatgatactatgattcattatcttcaattgatattgagcaccttaatttgtgtcccttggacaattgagccattagaccaaaaaaatattgcggctcgattatttttgtttcctaggtttaaggattgacattctatttaatgtaagttgttggatattttatatgcactcttagcacaagttgttgtcacatttctaaagtgcgtccctgaaagctttttctggatgaacacttcatgctgtaattcccaatgtttgatttagtcatactaaacgcttttgattggaatttgaatactcgtagttccaaatgtgattatgagtgcttgaagaatgaagaacaagcatggtcatctaaacaccttgtattatataataagctttagctaggtgtccagctttatgaagattcaaccatagcctttttgaaaggtccaatacttttagttccatggagatcaggatcaactagtcccgcatgaccatggttttgaagttattcttggaatctttttaatgaatcaatgctatccatcattttcatcactctcatttcacatggttattcaggatagcgtctcctcattctctgccacagtactaactttttgaatgtctcagttgattcctacctgctgaatgcatatcaaatctgcattttatacgattgtatcctcaagatagtgaacagaacatatgtgcctagtagttttttcccttgcctgaagtgaagattacctgtttcaatgtctagagcagagacaaattcatcagtttggaccaccattattgtggataatagatgatgaaaatcttcttatatacaatcaccttatgaatatactgcaattacttctagccaagaatgatttaattgctaactctataatcagtttttacatgcagatgtaatggctatagatcattatacgagaatcagatcatgtcttttattattatctctaaagaatgacactgtttaacacatttgtcaagcttgtataataaattaacaggtcctaaattttggtgtttttccaaatatcattttaatcaaattaacgtggtcaactacaataataacctcacacggcctcttgtttgtttgtgttcacaagtttacatggtttctgtttatgaactttttactctattttcttggctcattgttctaatgaaatactgcaggcccaaatgcctcacttgaagaattggtagattttataggtgttgctcaaatggcaaaggctgaggatgctcttctgcctcctgaagaaaaggtagcaatgtagccatattggtatcttgggatgaataaaatagaaatttaatgcatttaattttcgataattttttccttcgaattatctagcatcatccatctgttgctcctcctccccccgttcatttatctgtcacatgtttatgttattttaatgttttttttacagttacaatacaatgactatgctaagtccaataaacgaagattttatgattatgaagtgctgggaaggaaaaagcctaggggatgtgagaagaaaatcctcaatgaagatgatgatgaggaagatgaagctcttcatcttccaaacccaatgattgggtttggtgtacctacagagtcgagcttcataacacacagaaggattccagaagatgccattgggcctccttacttctattatgagaatgtagccttagcaccgaaaggtgtttggcaaacaatttcaagattcttgtatgatgttcaacccgagtttgtagattcaaagtttttctgtgctgcagccaggaaaaggggatatattcacaatctccccatccaaaataggttcccacttctaccacttccaccgcgcacaatacacgaggcttttcccctaacaaagaagtggtggccttcatgggatactaggaccaagcttaattgtttgcaaacatgtattggcagtgcaaaactaacagaaagaattaggaaagctgtagaaatctatgatgaagatccacctgaaagtgtacagaagtttgttcttcatcagtgtaggaaatggaatttggtttgggtgggaaggaataaggttgctccattagagcctgatgaagtagaaacgctgctgggcttcccaaggaaccacaccagaggaggtggaataagtaggactgacagatacaagtcacttggtaattcattccaggtatgataattctacctcttcctatataataatgtagcctccataaagatccttctggatgtgtttactttcataaataaatgtaatatctcttggaactattcagtaatgttttaatatttaggcatattcagattaatcaggtagaggaagaccaagaaaaatagaaagaaccattttaaaatgatttatatgtaaataacctcttacctcgataaagaatatattgatttttggcagaacactatggcgacatttatgttgagacctcagcaatggctttgtttgttgtattaagaataatgttgtcaaagtgaaatcatatgcagtttcagcatgttttcttttctatgaaactagtggttaatgcattgatgtttccgtgtaaatttctctttccttacttgattcagtttatttcaggttgacactgtggcataccacttgtcagttctgaaggagatgtatcctaatggtatcaatcttctttctctcttttctggaattggtggggcagaggtagctcttcatcggctcggcatccctctcaagaatgttgtgtctgttgaaaaatcagaagtgaataggaatattgttagaagttggtgggagcaaacaaatcagaaaggtaatctatatgacattgacgatgtaagggagctagacggtgatcgcttggagcagctgatgagcacatttggtggttttgatctaattgttggtggcagtccatgtaataatctggctggtagcaacagggtcagccgggatggactggagggaaaagaatcttctctcttctttgattactttaggattctagacttagtaaaaaatatgtcagctaaatatcgataaatttttgtccaaagaaacccctttctgcggttttgtctttcgtccaaataattaggatcttcgtatataaacctgaaacattagagacagatacttctcattccatttttattgccaaagaagggcaacgttttcaaataaaaaaattatcttaaaatttctgatttcaggttactattttattaatacctatgcggg

SEQ ID NO: 190 - DNA, 6296 bp, Glycine max
ctacccgcctaatgtatttacatttgtcagtgcaattcacgattcatgtgaatatgatgtaagacctggattcgatcttcggattacagttgttaataaaaaaaaaaagaggaagggtaaataatttggaatattaaattaaaatgatttacaggacgagccctggagcggtaaagttgtatcttggtgacttgttggtcatggatccgaacccggaaacagcttctttgcatatgcaagggtaagtcttcggggaatgggatacgaagttttttattaaattaaaatgattttagttgttttcccattaaaaaaattgattaaagaaacaaaaggtgaaaaaaatttaaagccataattttttttattacataaagcaataatatttgatttcaaatgtggccgcggatgaagtcagcttattttcttgtatttctccccaaattgaaattgaagatcgtatctaatgttaaccgagttaaaaatgagagttcgttttctatacaattattttttgaagttcttttctatacaaaataaaaatatttttatcattacaaattgtaatcaaatatttgtgtgcgcattggcatagcagcaccttgtactgcaacaactttcaaccaaaacctctctagcttccaattcaaagtaggaactctaccattttcgtgctcgtagtcgagacaaaggtaacaacaacgtttcagcttctacagtgttgattcacgattgctgatttctggacttctactctcactaaaatatagttttagtgttgagaaagggtttaggtttttttcgtctatttctgcattccttttctaacatcatctcttgattttctcccctgctcttcaggttgatcgacgtccgaactcgtcatcatcatcgtgtcgccattcttccagcgcaaggtattacaatataggttttcttcttcggaaaattttcttaagctttgtgagtgagtgaaggcatatataaaactgtgacagtagcgtttttcacactctatgagtcagcttagctacatgtaaaatggagaatctgttgatgattgacaaactgtaaatatcattgcgcaggataatcatcttagttttttttttttttttacgttttttatacatatcgtcatgattttaattttaatattcctttgtttgtggacgtttgacgaccaatgtgtggatcaacttttatataaagcctgcaactgattgtatatatctttatgctgttaatgattttgtatacacaatgtaatattctgtgtgaagatgttgatgtgtttaagagtgtatgggaaacacgaattcctttgaatgtatctgcttttgtgccgagggttgtgcaggataggatacaaacataatggaatttgaggaggataaatgtctaattacagtcagcagactatgggtgtcccttttgcaatctagaggaggaatctatggagcatttgatgttcagctgtacattttcatcaacatctggaataagtattatgcttggttggggatacatactgcccaacaaaaatgcacccaaggcaacatttgtgtgggatcttatgaaagaagttggtggtgaaatggatggtggtatggtgcacagtggtgtggtctctatggtcacagaaaatttctgttttttaaggatggaaacattgatggtgaacaggtatgggagatgtttgaagtccatttgtggtcatggttgtcaaggaaaacaaaggactttaacttgtcgttctatgaatggtcaacaatccctttgaaaggtttgtaggtggctcaatgaaaattcaagtagcagttcatggttacagtgatatcaagactgaagcagcagcagagccttgcacaacaaggcttccttttgttctctgtgatggaaggaagttacatgtcaatactggcagcatagtccatggtaataggacaaattcaatattcatgtccagcaacatcataaagaattctgtttcggtattaagagggaatgactcaactgagatgatatattgctacctgggcgaaatattggggtggttggctttacaagataaatttcagaaagttgtcatttgttggttggttggaatttttgggagatgaagcaaaagggaatgaattcacgaggaacatgttggggtagtttcttgcattgtccaaatttaggaaacatataatattgtttatcttaacttcagttgtgctgggaaacaccatacaacattactatttctgtttttatatgtttccttcatgtattttggctcattaaactgtgtggaatattctgtagggaaccttttgtaacagggcaggggtacttcttgtactgtcatcaatatatatcttttattggccgattaaaaacagaagcttgcaactaatcttaaatctctcatttgcagatgtctggtagacgagaacgagtccgggagtctgactttgaatactatgaacgcgtgtattatgaagacttgaagagtggttactataagctcaaaatctccaagtcatcatataagtgtcccttttgccaggacaagcgggaatactcattgaatgagctttcgaagcatgcagtaagatttgaaagggactcacggagcatgaagataaaagatttagccaagcactctgctcttcaattgtacattaaaaagtatcttgatgtctatgataaagtaggaagtgttgtccatgataaagtagaaagtgttatccatgataaagcaggaagtgttgttcatgatagaccaggaaaagtggtcctagatagatccggaaaagttgtcaatgatggatccggaaatgtttacagtgatagatttggaaaagttgtgaatgatagaccaagaaatgttgtcattgccaatgatagatcagaaaaagttggcaaagatcaactatttgtctggccttgggtgggcattgttgcaaacattgccactgaatttaaaaacggaatgcgtattggagacagtggttccaaactaagggatgagtttactttgaaaggatttcatcctttgaaagttcaaccattatggaaccgttatggacattcaggctttgccattgtagaattctccaaagactgggatggtttcaccaatgcaatgaactttgaaagaagttttgaggcagaacattgtgctaagagggactacgacaatttaagagaccgaggaggtagactgtatggatgggtagctcgtgatgatgattaccactccaagagtataattggtgatcaccttcggaagacgggggatttgcaatctgtttctggaaaacaagcagaggaaaaaaggaaaacaacgctgcttgtctcagatttagctaaaaccttgatagtgagaaatgagaaattggagcaggtatgcagcaaatatgatgatattagtgtgtccctgaacagagttatggatgagaaagaagcaatgattgaatcatataataatggtatgctgaagtttgaagtggtttctatttcggcatagcttattgtgtgtttctgtgttgaaaggtgaaacaatctggttgtgattatatctttccattccagatagcctatggtttgttttactttctagtgaaagttttctaaccttttcttggtggcttacttcgtgtttcaccttgttcgattagaaataaaaaagatgcatcaaattacccggaaatattgggaggtgttttatagggatcgtgaaaaggccggattgaaactacatgcgcagaggaaaaaactagagagccgtgagaaggatctgcagagaaatcaagtgcagaatgagaatgagagaaaaaaactgtaccttgaaaggaaaaatgtaatcttttttggctgcttaaatttttggatatcccagtttctttgtgtcagattgggaataatgctccatttatttgaatttaaataatttgaatagtgatgaactttgttcttcatctttctgtttgcagaatgagatggcaataatggagcaaaacaaagccgatgagaaagtgatgcatttggccgaagaacacaaggcacaaattccatattcttctttccaattcctttgtgtgtaatcataaagttttttacttagtcattcttttttggtttgaaatgcagaaagaaaaggagaaaatgcacaaaaaaattcttgaactacaaaatgaacttgatgccaaacaaaaattggaattggagattcaacaattgaaaggaaatcttcaagtaaggaatcaaataggagaggatgacgaggaggagaaaaataaattggatgcaattaaaacggaactagaagataaggaggaggaattagaagatctggaagcacttcaacaagctctcgttgtcaaggaacgtaaaaccaatgatgagttgcaagatgcccgcaaggagttaatacgtgtatgtgtctattaccaaccgtaaatgtaaatctgtttgatattattacaactctaggttttcaactgaacggtcttctccaagtaatctttttattaactgggattgagggctttttatttgtataaattaactggtaaagtgctgcagaaatgtaaggtttgtcttgatttttttaattgacatactacttgttatatactaatcacagcagagtgtttcatgtttactagtatgcttgttaacattaactggaatcatattccgaatataacattgttgattagctgcaataacttgaactcatctgttttgcatatttttgcaatgcgcatgctacacatgctgtgttttaactcttgtctccatatttgagaattgcagtttttcaatggtatcatcttgtgaaataatgtggttgcttgcctttcctttgtcaaatggctatatatttgttggtgtctaaaggagatgatttaaatctacatggtttaaaatttttggtaaaaagtggtagaattaggtcaggtctattgtctataaaactggtataatgcttaagctagtagcaaatatgctctatagttcagcttgtatgttgtgttactgctgctccgatggttttgtatgtattttgtttaagtaatatgatttacttgttcacagtggctgaggaagacaaacagtagtcgggcttttattggtgtcaaaagaatgggggagcttgatgaaaaaccctttttgagtgcagcaaagagaaaatattctggtgatgaagtgaatctgaaagcagtggagttgtgctcacaatacgaggcttatcttagagacccaacctggtttccatttaaagttttaatagataaggaagggaaggccaaggtacaatcacttccagaattacttgttcaaatagaagtcatcttttttatccctaggatttgttcatatggtcattttaattgcggattgcctcattatccaagcttgtaataatagtataatactttaaaaagtcattgcatcatttcataatagttaaaaccatggtatgctgtagatattgttcaaagatttggcagggtaaggtgctactcatattttgagcactttgttggcaccatttcccctgatgtttggtgcatggatcatgatctaatatatgttggatatattatgcaggaagtgttagatgaagaagatgaaaaactgagaactttaaaggatgagtttggtgacgatgtctttcaagcagtggttacagctctgaaggagttgaatgagtacaaccctagtggtagatacccgttaccggagttatggcattctaaggaaggaaggaaagccttgttaaaggagggttgttcttttataatcaggcaatggaaagcattaaagcagcgaaagaagtaggactgatgcggaacttacattttcggttcttattccatcaaacctactgttgtcatcgtcaacatcatggtgaaattgatttagttcaactctagtgccaaaggttggttatagtatgttacatgcaatactgatatcatataatgtacttttttcccgtgtgatagaggtttcttctattgccttggaacatttttgtttagaatctatttgaagttatatcagaccttgcttgaaattgaagtggcatattatgttgtttagatttatatttttagttaacactgctatttataaatatactgtactattcaacaatgtcagaaaattgggggttgaattgaaactgactctgccgtcagttattctcttattacgggttcggtgcagtatacccatcattatgggtctgttatcaggtttataaaacagtttgttaatagagattgggaggt

SEQ ID NO: 191 - DNA, 7616 bp, Glycine max
gcggatgaagtcagcttattttcttgtatttccccccaaattgaagatcgtatctaatcttaaccgaattaaaaatgagagttcgttttctatacaaaataacatattatgtaattcttattcttatattataatatatatatatattattgtcattataatttgtattcaaattattgattgttttttttaataataataagtagatttttttgaagaataatactactaagtagataaaattagcttttggaaagaggaaaaaaaaagaaggcataacgggaaacgaaagggtatattaatcatttttgccctgaacgctagcatatgcgtttttaaatgatgaaaatataaaatttagtttttaaaagtgtaaaaattgtgacaaatctaaccgttaataaaatagcctacgtggtacaaagatacatttgtcactgaaattgttaatgtgtctatctcaaattgtcaatatagaaagatgtttgtcatttaatattataatatttttgtgactttttgtccgcccaccggtaaaaaatacaaaatttagtcccaaaaaatataaaaagtgcgacaaatctatccgaaagttaataatatattgtaactaattattataatttgaaaaaaatttacaatgattacaacaaaaagatcaaaataataatttaatattttttttaacttaactcatctcaaataacaaaggtgtatatttaaaattttgatttggttgttaactaaaattcagatcatggaattaaggggaaagaaaaaaattaaataagaaaaagtataataaataattatttttatatttgctttattaactttaaattaatgataaaaacttgtaatttaaattgagtctaaaataaaaaatatattttttttataaactcgtaaatgatttttttgtactcccatgcctgatgaaatgttcaagtaaaaaaaatgcttattgtaaattaaattagattcatgaataatttttagagaaaattacaattgtaatgacacttttaatttgtaaaaaacacttacttcctttgaaatgattttcttttaaggttataattttttaaatgactaatcaataagaaatatttgtgtatgatttaaaaaaaatcaatttaaaaatcaacaaacttttattataatttgtaatttgatgtcattgtatatactaatagacatttatattttattatgaaaaaattattataaaattaattaaatacatagtatttgatttaacagaaacaataatttttttatcattttataatgaaatttatttttctttttttgtgtattgatagcttaaaagtaatataaaagaaacaaacagtgtgatatatttctttcaagatatatttatcgtacttgttaactaaattttatatttttatttttaaatattatataataaatatagtcatatgctcgcaattagaaatgtgacaaatttatcttatgtgtcataggctatgttattaatcggacagcaaaagtgactatttgccccgtaatacaacccaatcgcccaaccggagtatgcgcgcaatcgcatagcagcacctgcaatgcaacaactttgaagcaaaacacctctctctcaacctctttagcttccaattcaaagtagaaaccctaccagttttgtgctcttagtcgagacaaaggtaacaacagcgtttcagcttctatagtgttgattcacgatttctgatttctggtgttctactctcagtaaaatatagttttagtgtcgagtaagggtttaggttttttcgtctattttttcattcgctttctaacatcatctcttgattttctcctctgctcttcaggttgatcgacgtccgaactcgtcatcgtcaaagctcagttgctattcttccagcgcaaggtactacattataggttctcttcttgttcggaaaattttcttaagctttgtgagtgagtgatggcatatatatataacaacgacaaaagcgtttttcgcactctgagtcagctacatgtaaaatggagaatctgttgatgatagacaaactgtaaatatcgttgcgcataataatcatccagttttttttgttttgttttttatacatatcgtcatggttttaattttaatattcgcttgtttgtgtacgtttgatgacctttgcggggatccacttattttgaaaaataagctactagtatttgttttttaatttaagtgttataaagcttgcaactgattgtatacatctttatgctgttaaatgattttgtttacacaatgtaatattctgtgtgaagatgctgatgtgttttaagagtatatgggaaacaccaattccttcgaagatggctgcttttgtaaggagggttgtgcaggataggatacaaacaaaaaggaactcgaggaggagaaatatctaattacagccagcagactatgtgtgtcccttttgcaatctagaggaggaacctatggagcatttgatgttaagctgtacattttcatcaagcatctggaataagtgctatgcttggttggggatacatactgcccaacagatatcctaaaatgcacctaaggcaacattcatgtgggatctttggaaagaagttggcggtgaaacggatggtggtatggtgtgcagtggtgtgatctctatggtcacagagaaatattctgctttttaaggatggaaacatggatggtgaacaggtatgggagatgattaaagtccattcttggtcatggttgtccaggaaaacgaaggactttaacttgtctttctatgaatggtcaacaatcttttttaaatgtttgtaggtggctcaatgaaaattcaagtagcagttcatggttacagtgatatcaagaccgaggcagcaatagagccttgcacaacgaggcttccttttgttctctgtaatggaagttacatgtcaatagtaatactggctgcatagttcatggtcataggacaaattctatattcatgtccagcaacttcataaagcattctgttttggtatttagagggaatgactaaactgagatgatatattgctacctgggtgaaataattacgtgattagctttacaagataaatttcagaaagttgttgtctgttggttggttgggatttttgggatatgaaggaaagggagtgaattcacaaggaacatgttgggtagattcttgcatagtcaaaatttaggaaacatataatgttatttatcttaacttcagttgtgcagggagacaccatacagcattactgtttctgtttctaaatgtttccttcatgtattttggctcattaaactgtgtggaatgttctgtagggaaccttttgtaacaggggtacttcttgtactctcattaatatatatcttttattggctgataaaaaaaaagaagcttgcaactaatcttaaatctctcatttgcagatgtccggtggacgagaacgagttcgggagtctgactttgaatattatgaacgtgaatattataaagacttgaagagtgattactataagctcaaaatctccaagtcatcgtataagtgtcccttttgccaggacaagcgggaatactcattgaatgagcttttgaagcatgcagtaagatttgaaagggactcacggagcatgaagacaaaggatttagctaagcactctgctcttcaattgtacattaaaaagtatcttgatgaaaatgataggccaggaagtgttgtccatgataaagcaggaagcgttgtccttgatagaccaggaaaagtggtccatgatagatccggaaaagtggtcattgatggatctggaaacgtttacaatgatagatttgggaaagttgtgaatgatagaccaggaaatgttgtcattgtcaatgatagatcagaaaaagttggcaaagatcaactatttgtctggccttggatgggcattgttgcaaacattgccactgaatttaaagacggaaggcgtactggagatagtggttccaaactaagggatgagtttactttgaaaggatttcatcctttgaaagttcaaccattatggaaccgttatggacattcaggctttgccattgtagaattctccaaagactgggagggtttcaccaatgcaatgaactttggaagaagttttgaggcagaacattgtggtaagagggattacaacaaattaagagaccgaggggatagactgtatggatgggtagctcgtgatgatgactaccactccaagagtataattggtgatcagcttcggaagacgggggatttgcaatctgtttctggaaaacaagcagaggaaaaaaggaaaacatcgctgcttgtcttagatttagctaaaaccttgaaagtgagaaatgagacattggagcaggtttgcagcaaatatgatgatattagtgtgtccctgaacagagttatggatgagaaagaagcgatgattgaatcatataataatggtacgctgaagtttgaagtggtttctttttcttttttttggcatagcttattgtgtgttgaaaggtgaaataatctggttgtgattatatctttccattccagatagcctattgtttgttttactttttagtgaaaattttctaaccttttcttggtggcttacgttgtgtctcaccttgttcaattagaaataaaaaagatgcatcaaactacccagaaatattgggaggtgttttataggggtcgtgaaaaggccagattggaactgcatgctcagaggaaagaactagagggccgtgagaaggatctacagagaagtcaagtgaagaatgagaatgagaggagaaaactgtaccttgaaaggaaaaatgtaatattttttggctgcttaaatttttggatatcccagtttctttgtgtcagattgcgactaatgctccatttatttaaatttaaataatttgaatagtgatgaactttgttcttcatctcttttgtttgcagaatgagatggcaataatggagcagaacaaagccgatgagagagtgatgcatttggcagaagaacacaaggcacaaattccatattcttctttttaccaataattaatttaattcctttgcgtgtagtcatataaggttttttactgagtcatttttttttggttttaaatgcaggaagaaaaggagaaaatgcacaaaaaaattcttgaactacaaaatgaacttgatgccaaacaaaaattggaattagggattcaacaattgaaaggaaatcttcaagtaaggaaacaaataggagaggatgacgaggaggagaaaaataaattggatgcaattaaaacagaactagaagataaggaggaggaattagaaggactggaagcacttcaacaagctcttgttgtcaaggagcgtaaaaccaatgacgagttgcaagatgctcgcaaggagttaatacgtgtatgtgtctattcccaagcataaatgtaaatctgtttgatattattataactctaggcttttaactgaaaggtcttctccaagtaatcattttactaactgggattgagggcttttatttgtataagttacctggtaaaattctgcagaaacgtaaggtttgtcttgatttttttaattgacatacaactttgttaggagtccttgttgattatggagataatagggatgtaggaagagaaagaagagatatgagagtaatgattcagagagaacagagaaaaaatggttgctatcatgaaagatcagtaactgttttctcctttccacaaggactagccttctcaacatcaaaaggtaaactctacataatccccagctattgctaaaaaggtctatttatcctcattacccctaactactctagctgctctagcataatgatactaactgtcataacagtatgataacaaactctttattactcaaactacaattaatgggccttattcctcctttggtacactcacaaggcctttggctcctgctgtgactgaatctgatcaaccttcctaacaaacttgttatatactaatcgcagcagagtgtttcgtgtttactagtctgcttgttaacattaattggaatcatattcagaatataacattgttgatttgctgcaataacttgaactcatttgttttgcatatatttgcaatgtgcatgctacacatgctgtgttttaactcttgtctccatatttgagaattgtagtttttcaatggtaccatcttctgtgaaataatgtggttgcttgcttgccctttgagaaatggctatatatttgttggtgtctaaagggagatgatttaaatctacatggtttaaaatttttggtaaaaactggtagaattaggtcaggtctattgtctataaaactggtataatgcttaagcttgtagcaaatatgctctatagttcaggtagtatgttgtgttactgttgctgcgatctttttgtatgtattttgtttaagtagtataatttccttattcacagtggctggggaagacaaatagtagtcgggcttttattggtgtcaaaagaatgggggagcttgatggaaagccctttttgagtgcagcaaagagaaaatattctggtgatgaagtgaatctgaaagcagtggagttgtgttcacagtacgaggcttatcttagagatccaaactggtttccatttaaagttttaatagatagggaagggaaagccaaggtacaatcacttccagaattacttgttcaaatagaagtcatcttttttatccctggggtttgttcatatggtcattttaattgcggaaattacctgattgcctcattatccaagctagtaataatagtataatactttaaaaagtcattgcatcatttcataatagttaaaaccatggtatgctgtagatattgttcaaagatttggcagggtaaggtgctactcatattttgagcactttgttggcactttttcccctgatgtttggtgcatggatcacgatataatatatgttggatatattatgcaggaagttttagatgaagaagatgaaaaactgagaactttaaaggatgagtttggtgacgatgtctttcaagctgtggttacagctctgaaggagttgaatgagttcaaccctagtggtagatacccattacgggagttatggcattctaaagaaggaaggaaagcttccttaaaggagggttgttcttatataatcaagcaatggaaaacgttaaagcgaaagaagtaggactgatgcggaacttaaattttcggttcttattccaatgaggctaatgtagttgtcatcgacatcatggtgaaattgatttagttcaactctatagtgccccaaaggttggttatagacttatagtatgttacatgcaatactgatatcatattgttttttcccttgtgatcgggttcttttattgccttagaacatttttgtttagaatctgtttcaaattaatatcagaccttgcttgaaattgaagtggcatattagatttatatttttagttaacattgttatttgtaaatatactatactattcaacaatgtcagtaaattgtgggttgaattg

SEQ ID NO: 192 - DNA, 9648 bp, Glycine max
ctagccaaacttgttactattttctggtaacatggacttaggtatacgtgtgttgttccaaagagtcgaggagcatgattttttttttccttcccaaatatgttgttatatacccttcattgtaatttatcatttgcattctttgacatttaaacatttcaatttttcatctttttttcttaaggatgggtaaacagactcaagttcatggatcgacttgtgggtctcgtggtctgtgcaagccatggaccatttttttaaatccatgactatgttggattttaggcttgcctcgcataacccgtgggctttgcaggtttggattgtgggttggtccgcaaacttggaaccgctaatgtaattttttctataaaaaaactagactcgtggaccagtctgtttggctcacgggattcgcaagacaggaggagaccaatgtattaaattcatgtaatagtgcgagatgggctgactcggtccactaccaacttatccacctctacatagtgtcgggcaaacctttacgtgggacggaccgactcgcttacccacccgtactttctctaccatttatttgaagattccaaaatgaataaaccatcaattttgtcatagaggtatgaccctttctcataagttgtctccaaagtaataaaagttctaaatattcatcacttcagttcttaagttgatgtatttgagtagagttaaggaaccaatttgaaggatttttaatgtttggagtattacttagcatgaattttaatatttaggaactacttgagagatttatttatttatttttacactagggatcattcaatagaaagggtaatagtttgaggacaaaattaatgatttactcattccaaaataggtccaaggggcatttagaaaaacttatttgaatttataatagtgatcttttgtaagcactttttatcttatttcaataagtatcatgaggaaacttattataataagctcttttcaataaacttcactatcaagcttatgaataaattctcatttaataagagtttattgggccgtgtccctaatattattacattagaacttgtttttgattcaccggatgcaaaatatgttgataatctctacatgtagagacatgcctttgtttcgattctaacacatcatgattttatcccaaagcatgttttggaactttactctgcataagatgtggctactgcatagttttgatgcgtgatttagcaattgcgtccatatacagattgttaatttttttcgtaaagttaacttgatatttcagatagacccctttgaaacaaagttccagtaattacatatttaaaagtactttgataagtattatccagcataaagtttcattttatcaaacatacttttgagcaaagaaatattcacgtaaatcacactatataaattcatttttttaacaaacttaagttttgaacatacttttaattcaaatttaacatcatgaactttaatatgcactaagtaatccaaaatcctatgaaggtggaagggaaattccaaaatgcaatgaccattttgatttccatgtaagttttgtaaccaaagcttttgcaattttccttttctaattttcaaatttgctaaaatttcagtttgagggttcatgagcggcaaacaaacaaaaaaccctccctccctccctcccaaaatttgggtccctcccgccaaagaaaatggtccaatcttaaataggtgtgtagaggtaaccctaaattcaaaatatgcccgtgcaacccatttcctctgaaaccctaaactgaggttctttgctcagtgctagccctaatttgttcaggcagatggagcagtagcaagagggtggtgacagaggtttttcccggagacgcagactgagtagtagccgcaaagcccggaacacgccgtgaaggtagcgcgacaactgcgactgcctctattttcatttctgtttctttcgactcgcaggggatcgccgatctcactatcgagcgagcgcggaagatcgtggaagacatgggttccgcttctcttctgaatccttctcaaccaggttataatgacatccattcccccctcccccttctcttctggattattttaggatgttagtattgcattgttgtttttttggatccacaaatgttgtttgtggggggattcaaactcgtgacctctcccctcttcctttctcccattcaccactagaccaaccttatatctcctgttagtaatgcattgtgatgaagggcaaatagattttaaatctccatgtgattttgtttttaacacgagaagaaaaggtagacccaaatgatggaaaatattttggaaatctatttgatgctaggtaagtataatcattatgtatctgctcttgtgtgatcatgtatgaaagttctatgtcctttttgtccttctatattttacaggcatagtgaatgattatgacgcttataagttacttaatagttatttctgtctcaaggctgttccaattgtcatttgttgtgtcctctatactgcttatcttatttttctcaacaatttttgtatttatgtctctgtctctccctctctctcttttatttttgttgctaaataggcgttaagaagaacagcaagagcaaacagaaatctgttgtttccaaaaccgaagagaaagttatggttaaagataaacaaaagaagcggagtttgttggagagcagtgagcagcctgctgctacacgcaaaatgccaaaacgtgctgcagcgtgtaaaaatttgaaggagaaatcctttttgatatctgagaagtcctgcctcattgaaatggagaaagatcagattgtagaagaagaaagtctagctgtccgcatgacagctggacaggatgatggtcgtccaaataggcgcatcacggagttcattcttcatgatgcaactggtaaagcccagccacttgaggtgctggaggttaatgaattatttatcactggacttatattgccgcttgaagtcagcacaggcaagaaaaaagagaaaggtgttaagtgtgaaggctttggtcgagtggaatcatgggatatatctggctatgaagatggctctccagtgatatggctttctactgatattgctgattatgattgccagaaacctgctgctagttacaaaaaagtttatgatcttttccttgaaaaggcccgtgcatgtatcgaagtatacctgaaacttgcgaagtcctctgggggtgaccctgatatcagtcttgatgagttacttgctggcatggtgcggtctatgagtggtagcaaatgcttttctggaactgcatctataaaggattttgttatttctcatggtgagttcatttataagcaactaattggtttggacatgacatccaaggccaatgacaggacgtttgcagatatccctgctcttattgctcttagagatgagagtaagaaacaagcaaactatgtacatgcacaagtaatgccctcaaatgggagtttaaggattgattcaggagttggagatgaagaaaacaagaatcagatggattcagtagcttctgtaaacgaggaagatgaggatgcaaagctggcacgactgttgcaggaagaagagtattggcaatctatgaagcagaagaaaaactctagaccaacctctgtatcgaacaaatactatataaaaattaatgaagatgagattgccaatgattatcctctacctgcttattataaaacctcccttcaagaaacagatgagtttatagtctttgataatgactatgacatatatgacactcaagatctccctcgaagcatgctgcataattggtctttatacaactcagatgcaagattggtttccttggaacttctgcctatgaaaccttgttcagatattgatgttgcaatctttggatcaggtataatgacttcagatgatgggagtgggtttcatcttgatactgaggctggccaatcttcttctgttggttctggagcccaggttgctgatggaatgccaatttatctgagtgccataaaggaatggatgattgaatttggatcagctatgattttcatatccatccgaactgatttggcctggtatgatgcctcttgtctaaaataaatgctatattttttttatatatatttcaaataaaatagaattagaaaatccatttgattacctgggcatcaaactgtcaaatgtcaataaaagctagttgtaaccaaattgttgcaagaaaattgggttaactgttatggatgaacttgtcatatcatgtgaatcaaacatctgtagataatgtttgtaaattcatcttagaataatttggttctaaatgtcacaaaatgaaaaccaggatcattcatacttcattcctttcaggtatagacttggcaaaccagcaaagcagtatgctccttggtatgacacagtattgaaaactgcaaggcttgctataagcattatcaccttgctgaaggagcagagccgagtatcacgcctttcctttggagatgtcatcaggaaagtatctgagtttaatcagaaagatggttcttacatttcttctgatccattgactgttgagagatatgttgttgtccatggacagataattctgcaactgtttgcagaatttcctgatgataatatcagaaagtcttcatttgtgactggtcttacaaataaaatggaagagcgccaccataccaaatggttagtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaagattcaaaagagggaattgctagtgagttaaaggatgaggatgaagtggaggaacaagaagaaaatgaagatgatgataatgaggaggaaacaatacttttggagggaactccaaaggcacattcagcttcaaagcaaaccaaaaaaatttctgctgacacagaaataagatgggaaggggaacctgaagggaagactagttctggatatcctgtttataaacaggcaattattcgtggtgaagttatttctgtaggaagatctgtgttggtggaagttgacgaaacagatgaatttccagatatatattatgttgaatatatgtttgaatcaaagattggaagaaaaatgttccatggtaggatgatgcaatgtggttgtcagactgttcttggcaatgctgctaatgagagagaggtgtttttgactaatgagtgcagggatttgggactgcatgatgtcaaacagacagttgttgtaaatatccaaaataggccttgggggcatcagcatcgaaaggataatatcattgcagatagagttgacaggactcaagcagaagaaaggaagaagaaaggactacctactgactattactgtaaaagcttgtactggcctgaaagaggtgctttcttcacccttccacatgatacattgggtctagggtctggtgtctgcccatcttgcaaaatacaggatgctgaaaaggagaaggatgttttcaaagtaaattcctccaagtctggtttcctatttaatggaactgagtattctcttgatgattatgtttatgtaagtccttttgaatttgaggaaaagatagagcaaggaactcataaaagtgggaggaatgtggggttgaaagcttatgttgtgtgccaagtgcttgagattgttgtcaaaaaggaaataaaacaagctgaaataaaatctacacaagtcaaaatcaggaggttcttccgaccagaagatttatcaaatgagaaggcatattgctctgatatacgagaggtataagctacttaaagttaatacttgaacttgaatcaacccatgcacacatggacataggagaggcatgacaaatgattttactgaaagagcaagtaaaacttaaatagcatgattgtgtggattttataatattatttttcctaagtcattggtgcttgatctgactgataagtgagctgctatttgtgcatattgctcttataatttgagtattggttctactttgtttatcttctgcgcaagtttttatactgattagtatttgataattcatattttaggtgtattacagtgatgaaacatatataatctctgtagaatccatagaagggaaatgtcaagtcagaaaaaagaatgatattcccgaatgcagtgctcttggtggaatcttccaaaatgtttttttctgcgagctcttgtatgatcctgccactgggtcactgaagaaggtactgtgtacttgtccctgttagacaagcgtgtaatgtgcttgttaatccagcagaaaaatctgcaaaattattggaattttatggtttattgaattttctgctttacattatggcctatttggactcttgttattgaactcattgtatggttaagttcaattactgtatgctgtgttctgttctgatttcattaattacaacctttctgtagtgctgattaacaatgattgctttgtggtgtgttgctgtgtgttataatctttctaaagcttgatcttgttgcctggtttcacattatacatactttcagtagaaaaatagttcaggagcttaaatttatgttattggaaagtgttacattgtagcaactgaggtttttcactggtactaaacatcaactcaaacagttgccataatgacattgtttactggtattatgaaaaactctcttgttagtagatcaatactcaatttaaaatcattgtaaatgttctatattaatagcctatctgccattatttttgtaataattaaacttaaattaagtattttagtttagcttaagataacagcatcatcattattattcttcatgacatcaattcaacaacaggtggaagtacaaggtatggtttttcaataattaactattttccttttcaattgcttgacagttgccggctcatataaaagtaaaatattcaagtggacaaacatctgatgctgcagctagaaagaggaaaggaaaatgtatagagggagatggtgtttcagagtccacaaaggaaggaaaaacattaaatgataaacgtttagcaaccttggacatttttgcaggctgtggtggcttatcagaggggttgcagcagtcaggtaattttaactatataattatagaaagaaacccaactgtatatgctactgatgcataatataacgtgttttattgctaaaatacttcaggagtttcatcaactaaatgggctattgagtatgaagaaccagccggggatgcatttaaagctaatcatcctgaggcattggtgttcattaacaattgcaatgttattcttaggtaaataatcccatttagataacatattccaggccctaaggttgacaagagtggaacttatttaagtgactgttaaattattcgttatgtagggctgtaatggagaagtgtggggacacagatgattgtatctcaacatctgaggctgcagaattggctgcaaagcttgatgagaaggaaataagtagtttaccaatgcctggacaagttgatttcattaatggtggtcctccatgccaggtctctagctgttggctttttgtttattgtgctgttgaatatattgtagggtaattgtttaacaccgttgttttgctttcagggtttctctgggatgaataggtttaaccagagcagttggagtaaagtccagtgtgagatgatattggcattcttatcctttgctgattatttccggccaaggtatttcttgttggagaatgtgaggaactttgtgtctttcaataaaggacagacattccgtttaactttggcttcacttcttgagatgggttatcaggtaagattatgttactgcatctttcttcctgagtaattgtactcagaatcgatgaatggaattgaacctcaaggaaggaactaatgaatgcattccttcttgtctaaaaggtgaggtttggtatccttgaggctggagcatttggggtttctcagtcaagaaaaagggcattcatatgggctgcttctcctgaggatgtgcttcctgaatggccagaaccagtgcacgtcttttcggcccctgagttgaagatcacattatcagaaaatgtccagtatgctgctgtccgcagtactgcaaatggtgctcctttacgtgcaataactgttcgagatactattggtgatctcccagctgttggcaatggagcctcaaaaggaaacatggaggtgtgtaaaataggaaagatacatgtcttatattcttcataatgcgagttttttctacactcactacttaactgggttttatgttgcatagtatcaaaatgatccagtctcatggtttcaaaagaagattcgaggtgatatggttgtcttgactgatcatatatcaaaggagatgaacgaattgaacttgattcgatgccagaaaattcccaagagaccaggtgctgattggcgtgaccttccagaagaaaaggtgatgttcaatatttgtgaattttagcacgacattttgtgatctaatctaatatgtgaaatctaatgaaatgcagataaaactgtctagtggacaagttgttgatttgataccatggtgcttgccaaacacggctaagcggcacaatcaatggaagggactgtttggcaggttggattggcaaggaaatttcccaacttccgttacagaccctcagccaatggggaaggttggaatgtgcttccaccctgaccaagataggattcttactgttcgtgaatgtgctcggtctcaagtaagtccattactctagttgtctccctaaatgctttgatacgaaatgaaatcctaacaaggtggaattactaatatttttgaactattattaataattagaaaactattgtccttatgatctctgcctaaaaaataggaatatatcatatagtttggtataattttttatacccacgcatattttcatctattgtgaatgcagggcttcccagatagctatgaatttgctggcaatatcatacacaagcaccggcagattggtaatgctgtgcctcctcctctagcatcagcattggggagaaagctcaaggaagcagtggacagtaagagctccacttagaagatgggccttctacattaggtcatgcttattgtattcataacagtcaccaagatattgcaaatcatcattccgggttccaaaaactagaaacccttgtatatagtgatatccattggtcatttgttgaggctaattccttgtttaactttcctcaaccaaggaattgaatggatgatgctcattttctatcaactaggattttcttgattagatggtattttggctgtttatgaaagaaatggttgggaattgattacctcccaatgtgtagttgaaaattgagaccaattttttttaacctgttatgaatatttgttgttgcaactatttggctaagaactaccaaaaaaaactatttacctaggaaacttgcataatatttaatcgagg

SEQ ID NO: 193 - DNA, 9406 bp, Glycine max
ttcatatctttctgtaccatttatttgaagattccaaaatgaataaaccatcaattttgtcattgaagtatggccctttctttctcataaattgtcccaaaagtaataaaagtatttagctaatccccgtagtattgaatatttatcaatttggtccttaagtttatgtatttgagaaaaatttagggatcaatttgaacaatttttttaatgtttggaggattacttagcatgatatacaatacttgtggcactactcgagtaattatattttattttttacattagccatcattcaaaagaaagggtaatagtttgaggacaaaattaatgacttactcattacaaaatagactcaaggggcatttagaaaaacttattttaaaattagctctttttagcttgtttcaataagcttgacatctttctgtaccatttaataagagtttattgaaatgcatccctaatagtattacattacaacttaatttgcttatgcaaaatatgttgataatccctacatattgcatagacatccagttgttgagattctaacaagtcatgattttatccagagcatgttttgggactttaccctgatatcaagcctcgcaaacgacaacgagggatctcagtgaaaaatattattttttcagtgttaaagtgctgcatcaattagttgatcaaaagtttaatgtacaatacaatgcagtaattattcacaaaacatttgaagcataaatgctgcataagatgtgactgctgcatagttttgatgcatgatttagcaactgtgtccatattaagattgttaatttatttagatagactcttttttttttaaatgtaaattatattaaacccaaaatgatataacaatgtccccgtataaaagaaacttaatcttgttaataacttctattacagaaaattgataatctttaaaaatcaatttattcctagacagccagatgcagtagactgtaattgctatggtcacacaacaaaattttccttgaacacctcatgtggatctgtcccctaattaaagagtaagtaatgtgttgtagagaaataaagcgtccgtggaaatgaacccaatcacgaatatgagtccaaacttagagaggtttttttgcacatttaactccgcctcatttaaacataagagacaaaagaaacccttgttaaaaaaaattctaataattacaaatttaaaaatactatatttagtattatctaaacaagattcattttatcaaacatatctttgagcaaaaaaatatccacataaaaacattgtataaactcattttttttaaaaaaaaacttaagtttttaagatacttttaattcaaacctaagatcatgaactttaatcgaaacatccactaggaattctaaaatcctgcgaaggtgaaagagaaattccaaaatgcaatgactttttcgatttcatgtaagcttgtaacaaaagcttttgatattttttcttttctaatttttaaattcctaaaatttcagtttgaggggcgggaaaaaaaaaaattctctcttccaaaatttgcgtccctcccgccaaagaaaatggtccaatcttatatagttgtgtggaggtaaccctaaattcaaaatatgcccctgcaacccaaatcttctgaaatcctaaactaagtttctgtgctaagtgctaaccctaattcgttatggcagatggagcggtagcaagagggaggtgacggacgcttttcggagacgcaaattgaggagtagccgcaaagcccagaaaacgccctgaaccctaattcgtggaagacatgggttcagcttctcttctaaatccttctcaaccaggttataataacattaacattattaaatcttttaggatgttagtatttggtaatgcacggattgtgatgaagggcaaatagattttaaatctctatgtaattcttttttttaacacgagaggcaaagatagactaaaaggatggaaaatattttggaaatctatttgatgctcgcatagataagtatcatcttttatgtacctgcttttgtatgatcatgtatgaaagttctatgccctttttgtccttctatattttacaggcatagtggatgattatgatgcttataagttacttagcagttccttctgcctcaagcatgtcccaattgtcatttgttgtgtcccctatacctgcattactgcttaccttatttttcttgacaaaatttttgaatttatgtcttttttttttttggctaaataggcgttaagaagaatgacaagagcaaacagaaatcggtcgtttccaaaactgaagaggaagttatgtttaaagataaacaaaagaaacggagtttgtcggagagcagtgagcagactgctgctatgcgcaaaatgccaaaacgtgctgcggcatgtaaaaatttgaaggagaaatcctttttgatatatgagaagtcctgcctcattgaaacagagaaggatcatattgtagaagaagaaagtctggctgtccgcatgacagctggacaggataatggttgtccaaataggcgcattacagagtttatccttcatgatgaaactggtaaatcccagccacttgaggtgctggaggttgatgatttgtttatcactggacttgtattgccacttgaagccagctctggcaagaaaaaagagaaaggtgttaagtgtgaaggctttggtcgaattgaatcatgggatatatctggttatgaagatggctctccagtgatatggctttctactgaagttgctgattatgattgccagaaacctgctgctagttacaaaaaagtttacgatcttttccttgaaaaggcccgtgcatgtgtagaagtatacaagaaacttgcaaagtcctctggtggtgaccctgatataagtcttgatgagttacttgctggcatggtgcggtctatgagtggtagcaaatgcttttctggagctgcatctataaaggattttgttatttcacagggtgagttcatttataagcaacttgttggtttggatatgacatccaaggcaaatgacaggatgtttgcagatattcctgctcttattgctcttagagatgagagtaagaaacaagtacatgcacaggtaatgccctcaaatgggagtttaaggattgattcaggagttggagatgaagaaaacaagaatcagatggattcagtagcttctgtaaacgaggaagatgaggatgcaaagctggcacggctgttgcaggaagaagagtattggcaatctatgaaccagaagaaaaactccagatcagcctctgcatcgaacaaatactatatcaaaattaatgaagatgagattgccaatgattatcctctacctgtttattataaaacctcccttcaagaaacagatgagtttatagtttttgataatgactatgacatatatgacactcaagatctccctcgaagcatgctgcataattggtctttatacaactcagatgcaagattggtttccttggaacttctgcctatgaaaccttgttcagatatcgatgttgcaatctttggatcaggtataatgacttcagatgatggaagtgggtttcatcttgatactgaggctggcaaatcttcttccgttggttctggagcacaggttgctgatggaatgccaatttatctgagtgccataaaggaatggatgattgaatttggatcatctatgattttcatatccatccgaactgatttggcctggtatgatgcctcttatctaaaataaatgctatttttttatatatatttcaaatttcaaatgcaatagaattagaaatatccatttgattatgtgggtagcaaactctcaattgtcaatataagctatttgtaaccaaattgttgcaagaaaaatgggttaactgcaatggatgaatgtcatatcatgtgaatgaaacatttgcacatattatttgtaaattcatcttagaatagtttggttctaaatgtcagaaaatgaaaactaggttcattcatacttcattcctttcaggtatagacttggcaaaccagcaaagcagtatgctccttggtatgacacagtattgaaaactgcaaggcttgctataagcattatcaccttgctgaaggagcagagccgagtatcacgactttcctttggagatgtcatcaggaaagtatctgagtttgataagaaagacggttcttacatttcttctgatccattgactgttgagagatatgttgttgtccatggacagataattctgcaactgtttgcagaatttcctgatgataagatcagaaagtctgcatttgtgacgggtcttacaaacaaaatggaagagcgccaccataccaaatggttggtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaggatgcaaaagagggaattgctagtgagttaaaggatgaggatgaagtggaggaacaagaagaaaatgaagatgatgacaatgaggagacaatacttttggagggaaccccaaaggcacattcagcttcaaagcaaaccaaaaaattttctgctgaaacagaaataaggtgggaaggggaacctgaagggaagactagttctggatatcctgtttataaacaggcaattattcgtggggaagttatttctgtaggaagatctgtgttggtggaggttgatgaaacagatgaatttccagacatatattatgttgaatatatgtttgaatcaaagatcggaagaaaaatgttccatggtaggatgatgcagcgtggttgtcagactgttcttggcaatgctgctaatgagagagaggtgtttttgactaatgagtgcagggatttgggactgcatgatgtcaatcagacagttgttgtaaatattcaaaataggccttggggacatcagcatcgaaaggataatatcattgcagatagagttgacagggctcaagcagaagaaaggaagaagaaaggactacctactgaatattactgtaaaagcctgtactggcctgaaagaggtgctttctttagccttccacttgatactttggggctagggtctggtgtttgcccatcttgcaaaatacaggatgctgaaaaggagaaggatgttttcaaagtaaattcctccaagtctggtttcctattgaaaggaactgagtattctcttaatgattatatttatgtaagtcccttcgaatttgaggaaatgatagagcaaggaactcataagagtgggaggaatgtggggttgaaagcttatgttgtgtgccaagtgcttgagattgttgtcaaaaaggaaattaaagaagctgaaataaagtctacacaagtcaaaatcaggaggttcttccgaccagaagatgtatcaaatgagaaggcatactgttctgatatacaagaggtataagcaacttaaaagttaatacttgaacttgaatgaacccatgcacacatgcacataggagaggtatcacaaatgattttactgaaagagcaagtaaaactggctacagcttttgtaccagtcttagatagcatgattgtgtggattttataatattatttttcctaagtcatcggtgcttgatctgactgtgataagtgagctgctatttgtgcatattgctcttataatttgaggattggttctactttgtttatcttgtctataagttttatactgatttgcatttcataatttatattttaggtgtattacagtgatgaaacacatataatctctgtagaatccatagaagggaaatgtcaagtcagaaaaaagaatgatattcccgaatgcagtgcccttggcagaatgttccaaaatgtttttttctgcgagctcttgtatgatcctgccactgggtcactgaagaaggtattgtgtatttggccctgttagacaagtgttaaggtgcttgttaatccagcagataaatctgcaaaagtattggaattttatggtttatagaattttctgtttttcattttaaatgagtatggcctatttggactcatgttattgaactcattgtatggataagttcaataactgtatgctgtgttctgttcccattttcatttaattactgtccacaacctttctgtagttctgagtaaaaatgattgctttgtggagtgttgctgtgtgattagaatctatctaaagcttgatcttgttgcctggtttcacacaatatatacttttggtaaaaaaaatattcagcagcttaaatttatgttattcgaaagtgtcacattgtagcaactgaggtttttcacctgtactaaagatcaactcaatcagttgccataatgacattgttcactggtattatgaaaaactctatcttgttattagatcaatactcaattcaatccaatttaaaatcattataaataatatcctatctgccattatttttgaaataattaaactcaaattaagtattttggtttagctcaagataacagaccatcatcaattcaacaacaggtggaagtattaggtatggtttttcagtaattaactattttctttttcaattgtttgacagttgccggctcatgtaaaagtaaaatattcaagtggacaaacatctgatgctgcagctagaaagaggaaaggaaaatgtatagagggagatgatgttttagagtccccaaatgaaggaaaaacattaaatgaaaaacgtttagcaaccttggacatttttgcaggttgtggtggcttatcagaggggttgcagcagtcaggtgatcttaactacataattatagcaagaaacccaactgtatctgctaccgatgcaaaataagacttttatttctaaaatgcttcaggagtttcatcaactaaatgggctattgagtatgaagaacctgctggggatgcatttaaagctaatcatcctgaggcattggtgtttattaacaattgcaatgttattcttaggtaaagaatctcatttagataacatattccagaccctaaggttgaaaggagtggaacctatttaagtgactgttaaattattcttgttatgtagggctgtaatggagaagtgtggggacacagatgattgtatctcaacatccgaagctgcagaattggctgcaaagcttgatgagaaggaaataagtagtttaccaatgcctggacaagttgatttcatcaatggtggtcctccatgtcaggtctctctagctgttggctttgtatttattgtgctgatgaatatattatagggtaattgtttaacacttgttttgctttcagggtttctctgggatgaataggtttaaccagagcagttggagtaaagtccagtgtgagatgatattggcattcttatcctttgccgattatttccggccaaggtatttcttgttggagaatgtgaggaactttgtgtctttcaataaagggcagacattccgtttaactttggcttcacttcttgagatgggctatcaggtaagattatgttactgtgtctttcttcctgagtaattgcacttagaattgatgaatagtatagaacctcaaggaaggaactaatgaatgctgatttgcttgtctaaaaggtgaggtttggtatccttgaggctggagcatatggggtttcccagtcaagaaaaagggcattcatatgggcagcctctcctgaggatgtgcttcctgaatggcctgaaccaatgcatgtcttttcggcccctgagttgaagattacattatcagaaaatgtccagtatgctgctgtccgcagtactgcaaatggtgctccattacgttcaataactgttcaagatactattggtgatctcccagctgttggcaatggagcctcaaaaggaaacatggaggtatataaaataggaaagatacatatcttatattcttccataatgagttttctctacactcactaattaactgggttttatgttgcatagtatcaaaatgatccagtctcatggtttcaaaagaagattcgaggtgatatggttgtcttgactgatcatatatcaaaggagatgaatgaattgaacttgattcgatgccagaaaattcccaagagaccaggcgctgattggcgtgaccttccagaagaaaaggtgaagttaaatatttgagttttagcataacattttttgtgatctatctaatatgtgaaatctaatgaaatgcagataaaattgtctactggacaagttgttgatttgataccatggtgcttgccaaacacggctaagcggcacaatcagtggaagggactgtttggcaggttggattggcaagggaatttcccaacttccattactgaccctcagccaatggggaaggttggaatgtgcttccaccctgaccaagataggattcttactgttcgtgaatgtgctcggtctcaagtatgtccataactctagttgtcaccctaaatgctttgataagaaatgaaatcctaacaagttggaatttctaatatttgtgaactattatggataattttgatcatgttaccttaatagagatgtcctagaaattagtttctatgattaagtagtgagcataataatgtttaataagtaaatagaaaactatagtccttatgatctcggcctaaaaaataggaatatattatataatttgatataattttttatacctgagcatattttacatctttatgaatgtagggcttcccagatagctatcaatttgctggcaatatcatacacaagcaccggcagattggtaatgctgtgcctcctcctctggcatctgcattggggagaaagctcaaggaagcagtggacagtaagagctccacttagaagatggggcttctacattttttgaaatatcatgcttattgtattcatatcagtcaccaagatattgcaaatcattattcagggttccagaaactagaaacccttgtatatagtgatatccattggtcatttgttttgaggctaattccttgtttaactttcctcaaccaaggaattgtatggatgatgttatgatgttcattttctatcaactagtattttcttgattagataatattttggctgtttatgacagaaatggctgggaatttagaattacctcccaatgtatatagttgacaattgagaccaattttgtcattttttttaacttgttatgaatatttgttgttgcaagtatttggctaagaactaaaaaaaaggtaataccttctttccata

SEQ ID NO: 194 - DNA, 15987 bp, Glycine max
accacatgtccatacatcaaatccctcttttacatagcaaatacaggccctcgtgttatacgatgttccaataatttcaaaaccataaatttttcaatccctcgattattgtctttcttatatttgaaaatcttgagaaaggttaggcgatacacgttcctcatgtccttcccattatagtccggttcaaaacctcgacaaaatttccataggaggcctcgatagtccatatgtctactttaatcggtctacccacagttgttgtgagtgccaataggacattctcatcattcccaaatttggaaaaatgatctataccattgtgttgtcaatattaacttacgagaggagacaaaatccgttaccgatggttgtatagcaagataatgatcaaagatcatatagacccccttacattttccctatcctctcataaataaaactttaccatatgaaatctatgctcgacatcggccccattcattcctccaacaggttttcatgttgtttttaatcgatcatgcattctacagaagctaagatgcttcctcaacaatttgataatgataacatccttgtaaggccgccaaagttattgaagaataccccagtcaaacatttgactccaaggattgaagaagatttagattaaagattttagaatttattctcgctttcaattgtccgatgtgtttaagtttttttttttttgttaattgcctaaataaaagattgtaatcaatctttaaattgattcaaaaaatcttttcctaattttaattaatttgattcaagacgataaatttttctcaagatttattttatttatcattaagaatttcaaattacaataatatgatatcttagttattattattagattctaataataattactaacatatatcattcgaatgactatgatactttacttttttatttatacctaaacatttgatgctaaaaattactaagtccaaaatcacactaacctagagattttaggttatgtttggtatgaaggggaaaaataatatattaaagacttaaatatatttttgattgttttcatttgtattttttttatttttgtttttgtaatttttgtagttattataaaatatgtttactttattttcaaaatattttaaataatattttaaacaataaaaaataatatataaaatattttatggacgaaaaataaaataatcatatttaaaacatactaaaataattttttagagataaaattaaaaaataaagaattacaaaaataaaaaatatatttaagtctatactaaaaaaaatatactttatcttatttcatgaaactcataatttttacactttattttaattaaaaaaatattttatttttgtcgtctaaaccaatcacatgatagctttttaggagaggagggcaaaggcgtaaaagcgaagcaaagggaagggttatatataacctagagacaagagcccaaaagcacagtgacttaccttttatcaaggcctgggtctacacaagtgccccttctcaactcggcgtttgtctcgtggtcgcgtggaaagtgaccggcggtgttccattttgctattcattcgtctttactttactgcgctttctctctcactcactcactccaattcgttcttgggtttcgattttggtcttcgcagagcattgccgcgtagctcgcacacacacacaccaccagtgtctgcgttcgtgctggttaagtcgatcattcgttcttttcactcaagtgagtaataacaacctctctatttctctctttcgtcatcgcttttcaacgctcaatattttccctgtttcctgatactcgtttaatcgctccatttgcgagtacggtgtgcttcgcggccaagtgtgcatgatctttttcttttgctgcatgttacatgatcatgcttttagagggttccagaatggattttccgacaatgtgcctacacttttcactcaatactattatttttttttgctaataagtctcctattaatcctaataaagtgcgtgtttgattgataacttcattatacgattcgattactatatcaggtttaatgttttaggccgaatggcgtgttcaatgttctcttctccatgatatttgatttcttgacatgtatctagtaggcattgggtgcacaagatatatgttttttcctcccctccaaaatccaaattcgctactgaagaaatttagacacttcttggtttagtatcccaatgagcttatatgccccaagtacaagccgactccaaaaatgaagttaacgtgtttagttttctactaaccaaagcaaattattacttcaccctttccaattttgcttcctctttttatgtattttttgcttacttgacttaatttaaggtattttgttgaaaactgagagtaggaatgctacgaaaaatgttattatcttctggttacttttatagatcatatcttcctttacctgttctttgtctttagaaatttttgttgtatcaatcgtatcagtaccagtactcagccatatttatatgcaacctagactaagctagcaaatatacaagttcaggattagatagtatgggtatggataattttactcacacagccagttgttttttttttttattatctcattttgtttacacactatcaatgctctgcaaatgaacagattacttgaaattttctgccgagtgcaaggttaccaagtttgatggatgatgaccttttccagaggaacaaaacaccatctggtgtcataaaagcgataaagtttgatgtcttaactgaagaagatatagttaagtatattcttgatcttatatctatttcagctttttaattattctgtgtgtattagttcactgttactttagttgtgggatttgatcaaatggtatgcacttactgtgtaacacattaacacagagtggagggtgggtcatcaattttgttgaccttttaaaagataaatctgttctgtagaatggattatctgccataattctcttctgattgccttgtaatttattagccacatattaaatgttaattaggttttcatctacaggagaatatcgctgttttggagataaatgcagccgggcaggtcactgggtcaagtttgggtttcccaaatgcatctgatgagtgtgccacatgtggctctaaagacaaaaggttctgtgaaggtgtgaaaagacattatatgaaaaatgtgtttaggggttttgctacattaaatgtaaatttattggaaaaggtgctgaaaacatcaatatttaatttcaggtcattttggagtaatcaaatttcctactcccatactccatccatattttatgtcagaaattgcgcacatcttgaacaagatttgccctgtttgtaaatctattcgtcacaaatccaaggtcatatatcttttacttgtaccaaatactgggattcttagtgtgatttttttattgtaatgcggatttggttttttagtccactgctactgtatttaaaaataagttaaaccaaatacacatttagatcatatggcaaaactttaggtgtcttaaaatcttttcccaatattccccacctttttaaagttacatagtttctactgtacaatcagacattatttgagaagttccatgtgctgcatcacaatatcatttattttctttgccgttttcattgttgtagttttatgagttggcttctatggattttattattacttgttttctgcctcctatttatagttccattgtcttcttacagggtgttcgattgatctatggaaccaagcggtctaatgattgcaattattgttctgtaagtttgtgtggcttcaccttcattgatttgcttcaaagtaaaattccttttttattgttctgttttgctttgtatgacaacttgtgcatcacatgtaggcgtatccatcaatgaaattcagagtttcttccaacgatctctttagaagaactgcaattattgttgaagtaaaggcttcaaagaaaactttggggacagaaatacctgctgattattggaattttattccttgtgatgctcaacaagaagaaaactatgtaaatagaagggttttatctcctgcacaggtagcactacccacatttacatgcttttgaagtctgtataattttcattcagatacgataaatttgcactatatcaaaattaaaatataatctgtcagaaggttactagtaatagtatgccttatgatcttgttatatcatgttaaatatgattaagatgagaacatgttctgctttcacttttcagcttgattgctttttatgctgtgttattctaacttttgagtcatttctattacatagccatgcttttttgctggtgctataacagtgtaaattttatatctttctgattttcaggttcttaatttgttgaatggtgttgatccagactttattgaaaaatatattccaagaaagaatttgctgtatcttaattgcttcccggtgactccaaattgtcatcgtgtgacagaagttccttatgcaatttctagtggaagccgattgagttttgtcagtatatttcttttctgccttgtagtttttaatataataatatttataaactgtcacatgtagtcacacaatgtctatatacatttttttaatatggtactttatctggttaaatatttataggatgacaggactcgatcttgtaagaaattggttgatttcaggggtacgcccaatgaattaagttctcgtgttttggattgcttgaggatctctaaggcaagatgctcagctgtttttttcctgttatttttgtcactttgtcaaggttcttgcctttcgcttatgtttttcttttgatgaaatgcagctaaatcccgataaaacaccaaatagtatttttgctgatatccagcaaagaaagattggagaaaatgcttgcaattcttctggtttaagatggataaaagatgtggttcttggaaaacgcaatgatagttcattacgtactgtggttgttggtgatccagaccttgagcttagtgaagttggtataccttgtcatattgctgaaagtttgcaggtttctgagtatgtgaataggcagaatagggagaagctgctttattgttgtgagctacgcttgttagagaaggggaaaatagatgtctgcagaaatggtagtaaagttcatctgtataaaaaggaagatctacaaataggtgacaaaatttataggcctcttgctgatggggataaagtgctgataaataggcccccttccatacatcaacattctatgattgctctcacagttagggtccttccaatatcttctgtagtgtgtattaacccactctgttgttccccattacgtggggattttgatggtgattgccttcacgggtatattccacaatcagttactgcaagaattgagcttaatgagctggttgctttagataggcaattgattaacgggcaaagtggtagaaatctgctttcactttcccaggatagtttgactgctgcttatttgctaatggaagatggggtccttttgaatgtttatcaaatgcagcagcttcaaatgctttctatttctgacaaaagattaatacctcctgcagttgttaaagctccttcaagtaatagctcactttggagtgggaagcaaatattcagcatgctcttgccttatgattttgactattcttttccttcagatggtgttgttgttagtgatggggagcttgtatcttcttctgaggcttctggttggttacgcgattctgactacaatgttttccagagtcttgtggaacattatcaagggaagactctaaactttttgtatacagcgcaaaaagttctgtgtgagtggctgtctatgacaggttttagtgtttcactctcagatttgtacctttcttctgattcctatgcacggaaaaacatgatagaggaaatcttttatggcttacaagatgcagagcaggcttgtaatttcaagcagctattgttggattgttattgtgattttctgtcaggaagtatccaagagagtgaaaatgctatcactgttgatgctgatcgtctgaattatgaaagacaaatatctgctgctctcagtcaagcgtcagttgatgcttttaggcaagtttttcgcaatattcaaagtttagctgacaaatatgcatgtaaggacaatgctttccttgcaatgtttaaggctggaagcaagggtaatttgttgaaattagttcaacattccatgtgccttggcatgcaaaattctctggtccgcttgtcatacagattaccccgtcatctttcatgtgctgcttggaatagtcaaaagtggcttgattcaatccagatgtcttctggtacccttgaatctgttcagtcttacattccatatgctgtggttgaaagctcatttttaactgggttgaatccacttgaatgttttgttcattcagtgacaaatcgtgatagctctttcagtgaccatgcagaccttcctggaacactgacacgtagacttatgttcttcatgcgtgatttgcatgatgcatatgatggaactgtgagaaatttatatggtaatcaacttattcagttttcttatgatattgaagaggactcttcatgtgataaaggtttccaagagtatgctataggtggtgaaccagttggggcaatttctgcttgtgcaatttctgaagctgcatacagtgctttgggtcaaccagttagtctactcgaaacatcacctttgctgaatttgaaaaatgttttggagtgtggttcaaggaaaagaaatggtgatcagactgtgtctttatttttgtctgaaaagcttggtaaacagagacatgggtttgaatatgcagctttagaagtcaagaattatttggaaagattgttgttctcaaacattgtttctacagtgatgataatattcaccccacatgacggcagcagccaagaaaaatacagtccttgggtctgccactttcatttagacaaggaaattgtaactagaagaaaattgaaagtgcattctatcattgactctctctaccagagatattactcacagagaaaagactcaaaagtctgttttaccaatttgaaaatttcaagcaagtaagcctcttctgctaatggtgcttcaaacaatatatgttgttacttgaggaaatattaactgttcatgaatgctataaaaagattgatgctaatgtctttgatgggaactgagagttaagggaagttatgacagttgcattacttctcctaactcttagttcccatcagtctctattcagagttcgatttttaatttgctgtgctagaagagtaaaggatatttaaggatacttaattattaaatattaatgtagataggcaatgaactatctctatacatgttgttcctgtatatttattatgtcatgattccagaaggtttttgttgcttcaattattgccaagtggataattggatatgcttcttgtacttgtttctttacttttaacaacagcatttatcacttagctaattttcatgcaattcctgactcttgtaataatttccccacaacccttaaatagaactgaaatcctcttgactttgatacaattaggatttgttacagaactacagagaacttttcgaataacagaaaaaagttgagaatggagattgaaaattagaaatgaagttagacaaatgagttttctataatttttttgaggcttataagaaatgaaaaaaatggttttgtacatttcaaaagaagtttgtgaactttctgatggcgtaaatatatataaccctaacacaatggcaggagctgttattttaattgtaactgattatgatgaaatctctattctttctgcattagttatttctgccacagtttgcaaatgttggagttggattactctcttctcaagaagaggaataatatgttacaactgtatataaggaatactatgtctctgtttcatgtctcaatacctactgaaatgtaaaggatgctagatagtagtgtgatagagagtttaaatcaaatatgttgaaggattgggtaacttggctaaattgatgttttttcagctctttttctttattgccgtgttttcttttcaagttgaagaggagcccttatcctcctaacccttcttcttcaccatttgcattttctttgtaactttttctgcattaattatcattcttgcttggagctttgatgatctctactaacttggacaatgaaatagcaggaagtgttctgctgattccatggctaaggaaggtgaagacacttctatagataaaaaagagggtgatgattgcatcacagtcacaattgttgaaaactctaagaatcctatacaactggattctgttcgggatttggtgataccttttcttctaggaacagcaataaaaggtaggtagtaatctaatatgaatatcaagttgttgtttcaagtggtgatttatatgtgagcctttttgaaattaccctgatgatcagatacatggctggggagtttctcaagctgttgttgaagttcaaattatgtttttgctgcatatatgacagtttaagttttctttgcagtcatgtcaacttttatgattccatgattgttacaaaaaagtttatacttgatttggctattataaatgtgaaaattaaaaatgctatttttaatccttttctttcttgggaaatggtgttaaaaagcagagttgtaagagcaagataggttttaacctgatcagatggctaggtcataacaattggtcataattcgttttttcaaatacaaatttggttttctatcaccagctttattgcatctggctcatgcacgaatatgtattgcttgttatggtaaagtattctcagattcagtcatcatcatgaattcttgtattgttcgttaggatttctggatgtcaagaaggttgatgttctctggaataatcagtcaaaagtaaaaaattcttgtaatggtttttctggtgaactgtacttgagggtaactttgtccagcgagggtagcagaggaagattttggggtgtactcctaaatctttgtcacaagataatgcatataattgactggacacgcagtcatccagataacatcaatcatttctcatcagcatatggaattgatgcagggtggcaatactttttcaatgtgtgtatgattaaaaacttcccctcctttgttttgggttctaaatgaaatatatggccgcataaacttaatttacttgcatgtggttttacgtgtagagtttggcatctgcaacatctgataccggcaagtccatccttcctaagcatttgtgtcttgttgccaatagtctgtcatgtagtggagagtttgtgggattaaatgctaaaggcatggcactacaaagaaaacatgcgtcagtttcatcaccattcgtgcaagcatgctttgcggtcagttgacatttatgattccagtctaatgctttatgatttatcatgtataagattttgatcacccatatataattcatgttgaaattatgtaatcttattgcagaatccaggtagttgctttataaaagctgctaagtctggagtcactgataatctccagggcagtctggatgcgttggcttggggaaactgtctatctatggggacaagtggaatgtttgatatcatatattcagagaaggtattggtttttaatattaattttcttgctttcattcagatttaatgtatcatgaatatgattccactagtattttagcccatgtaatgcacatgataaatgtttattttttatataactgaaatttataataaataaacatttttgaatgtataaattatattataattaaatttcgtaataaataaatattttgaatattatattataattaaatttcataataagtattttttaatatatagttaatattttggatctatgctaaataatttatattgtcaaacaaggttatacagggttatttttaactattgatactacctcctttccatatcttttgatgttttagctttctattttttttttcccaaaacaattgatgttttagaatttcaaagtctaattaatgtttttttctctcaaatatacccttatttaatacccattactagtgttgtaggtatcaaagattaaggtattaaataaggatattttagtctaaatacatcaatttttagtttcattaaatgtttcttaatctgtgtgcaataaccttaaacatcaaaagatataggaaggaggtagtaatttcttttaaaaaaattattgaaatttaatttagaagtagagatgaaaatgatagattgaaataggtaagtggttcagaaaattaagtattataggttccgtttgatttgctaaaatttacgctactaggcaggacaaatatttttgttttacatttgatttgaaaaaagaagtttacgagacaacacaaattaattagatgatgataggacaaaaactcaatttcttgttattcaaaaaaccatgagacaactttttgtcctaggtacaaagtattgaaaagacgcacataccccacctctctcttatttctcgctcattatctactagctgtaacaaccatattgtgtgatgtatttcgaatttacattatctattagctacaacaaacccttatcatgccatgtattttgaattcatattatctactagttacaacaatcttatcatgtcatgtattttgaattcacattatctactagttgcaacaatcttatcatgtcatgtatttcaaaattacattattgtttagttagcttgcttgtatgtattctgtattttcaatcctcataaaatataataataatgtaaaatatattaagataattaatattaaaaatgatattttagtaaattttatattattatgcttggcttgtctattattaatcaaacaatgcacatgataaaaaaattgtcctgcaatccaagtatttgtcctgttgttctctttgtcctgtaccacacaaacacaaccatataaagacaaaaggagagtggtttgagataattgagaaataatttttttgagttgttaaatgaaattaaaataaagtataattgaaaataataaaaagctaagaaataaaattaaatgctcaatatatgctagctcgtaacaagataagacatgtgatttaatgagagtcataacaactcctaacaacacttcctaagaacactttgaaaaatagctcgtaaaaacgctctccttcaggataaggattcagatttataatataggagtagatttttaaagaacccaagaatgtacaagtgcatttcagtcctccaaaagtgtcactttttaaatttttaatagaaaactgatatggttgtgcatgtacaagatatgaaaaatttcactgaagtatcaaaacttttgaccaacttctcacaagaatgcgacatcctccttgtaattattgtaggctttattttttacttttttcctgttcaactctagacctttgtaatacattctataaacactttaaactgatttataagtcgtgagattgttaaaatgtatgatttttgtttcttcagttgtcatttttcattttcaattcatacatgttagtttgctgtttcctagtaaatttactatggttaccatttctctgacaacaaagtaagtgcataaaagccgagattctttcagtttgtgctgagtaaggataggctaagaagagttcgagggttgttaattgttatggagcaaaactatcttgtatcttgcaagttgtacatgtaatactatcagttataatgtaacatttgcttttatcggggactgtaggtagctaagtctgggaatgtgtatgagctgctagaagccagttttgacaagccgaacaataaagctggtactcatttgcacaaatattcatctgacaaatgcggttctgagtttaggcataaaaatggttatgccttgaaagagggaaaacagtggaaaaccattttaagaaattttgtgacggtaaatgatatccagaagctgacttttgcttcgaggtgcatattgaacaagtaagataatccacttttttggccttttctaacctcagtcgtggtttgtgtttttaatggtatttagcactgtatattctatctatgacacttacattaccaatttaccatatatagcatgagctaatattatatagtactgctggaaggttgtatttgttattatgccatggtaatttcttgcagttaggtgcttccacgaaactactttctgctttgtaatcattatacagctggaaggttgtatgcattatttgccttggtagtttcttattagttgcttccacgaaactactttctgctttgtaatcgttatacagctggaaggttgtatgtattatttgccttggtagtttcttatttagttgcttccacaaaagtactttctgcttcgtaatcattaaattatgttttcattaagtaatgagttcatgctgctttgccttctagggaaatgtgcctgttgtttggatggaaatatttcattagacttattagagatataaaagtaaaactagactcaacctagcttgaacttttagaaaattggttcttaactcgttttgtatggagctatttctctctgttttgtatttagtatgaccaactacaaaattcccttttatttaaaactatccttgaggctcaacctagcttgaacttttagaaattggttcttaactcattttgtatgtagctatttcactctgttttgtattaaatatgaccgactacaaaattttctgacatattgctatcaatttatctcagttatttttagaagaaaataactaataaaaaattaagaacatgaataatttaatgagggagtgccgagtaagatgattgggagatgaagagaaaaactttaacaaacaacaacaaagccttaaccactaagggaattcaaatggttataatttgtttgtagtacagtagattcaaacatataattgaacttgatttaatttgctgaggtttattttattttattttctacataacaagcattcattgataaagtatcgtcatcattattattcctgcctttggggagactgccaaggcagttccatttttttgtctatttattctgttcctcaaggctgtctgatttagattattctcaacttgggagcagggtagtcaattttgttttacgtatggatttttcaaggaagtttagggcttgtttactttgagaaagcatttttttcccattcagttttcaattttaataacacaaatgacaccttattttcatttgttttttgttttcaaatatttgtgtagaaaacaatagaaatttattttcactgttttccatacaaagatttgaaaacagaaaacaaaatgaaaacaaactgacaattttgtattgtatttaaaagggaaaataaaaaaaagaaaacattttctaaaacttaaaggatccttgctttgacctgtttcctgttaagttacttttttaggtccctattgttttattgagtattcatacaagtccctgtatttaatttttttaattgggtctcctaaaaatatttagattgttctctattgttgaagttgttgcaaaactctatatttttttggacacagttttgtttagttgtctaagatcacttgctgtcattgagaatctatgatttgcagaataattgtgaattttggatgttgtctatgtaggtattcaattgatgagctgctaagtgagagtgacaggtcaacaatgctaagggttttgaattttcatcctcgtaaaagtgagaagtttggcattggaccacaggacattaaggtatgtgtgcttgcatgaggtggttttgatgtgtggtcaaaatttattttgttcttagtaccaatgtgcattaaggtatgcgtgcttgtgtgaagaaggtttggatatgcagtcaaagtttattttgtttcttcttggttcttgctaatgtacttaaaggtaatgtatattaaattggagtgcactttaaatttcacggttgggaaatttttctatattctctctgaagaaaattatatatattctccacttaaaatgctcctttgagaaaggtactttttttttctatgctacttcattatgaacatttatacgttattgaacttgatgaattcagtggagccatgaaaacaagtataagttggtcaaacatccctcctttgcctcccaaagtctttttgacaattttattcttatccattttctaatatacctatgtggatatatacagcaagaaacttttcaaacttttttacatgaaagttcattaaaaaaaagattatatgaccttcttttgaacactatcacttgatagctttgtatataagcataaaagattatccaatatttttgccctactttcattctaaaacttcagttatgcatatctgtatgattttatactaggaaaacactgcctattgcctaatacccccaaagaataagacaaaataaaagatgcagtcataagaattgagagcattgtttgattgttatgaacttgcttgatcagaatgaaacttttctttacgtcttgtttgtgtaaatgaaaaggctggagctaattatttcacttttctacgtgggaaatttcattccatagttacaacctaaatttataggtgtagtataaatttagtttgtattataatgtttagaatagcagccattcgcctcccactatagcattttgccgctatttggaattgataattatgattccatagtagcatttaagggataaattcccatcaatgataatgatatagcagttatgagaagaaagagatacttgtgtcaattttgcttcttttgccgtggtcaaatcacttgctagtaaaaatgtatcgtgtaatgaagttttcttcttgctcccggtcctggttgcccatgccttttttccttttctattcgcaggttggatggcatccaaaatacaaggatagccggtgcttccatatagtaagaattgatgggacggttgaagatttttcataccgcaaatgcattcttggtgctcttgatatcgttgatccaaaaaagtcaaagatccaggagaaaaaatggtcaggacatggtaacacgtaatatctatgcatgtccaagcataataagtgactatcatttgatctggtgacagtcacagactataaaaatagagtcggaagggtaatagtagtgccacaactctacaatcacaaaaagcaacgttgtttttctacctttgatttagaaggatgtccggaatcagtggtagagagcactgttctcttttgcgagtttagagttatgttattggcattactccagctaattggtggaaatagtttgcagccttcttttgttgtattttactatcttcaaggctagactgggtgatagcttactcaaatgttgctcgatggatttagaggcagagcagcgaatccagcgtaaagtcataacattttgaaagaagaaaggagaagatgcatagaagggaggatacaagatggaacaatgatagtatatattttttcaatatgaacaaattaaattttattttatatgttaaaagatggcgtgggttcttaccctgagcttctttttgcttcttccactaatactttatttgccaacgattacgtaaggcaaagaaagatctagtggaagcagcaacgagaagcttgtaaagacttatacccccagaccatttgtattgatgcggcagttaaatataagatatgtttaggttatgccgggttcaaatgtcatgcgtatctctgc

SEQ ID NO: 195 - DNA, 15987 bp, Glycine max; identical to SEQ ID NO: 194

SEQ ID NO: 196 - DNA, 15579 bp, Glycine max
tcttatctttaaaatcttgagaaataagattaggcaatacacgttcctcttgttcccattatagtctggttcaaattaattttaacacttacctcgacaaaatttccataggaggcctcgatagtccatatatatactttaattggtctgcccacctttgttttgagtgccaataggacattctcttcatacaacttcattctcaaattaggaaaaacgaatctatatataccattgtgttgtcaatactaacttaggaggagacgaaatttagcacccatggttggattgcaagataatgatcaaagatcacatagccccccttgcgataaccttttctttatcctcacataaatcaaactttaccatataaaatccatgcccgacatccactacattcattcctccaataggttttcacgttgtttttaatcgatcatgcattgttcaaagctaagatgcttcctcaacaatttgataatgataacatctttgtaaggccgccaaagttattgaagaataccctaatgtcaaacattttttactccaagttgtctctattctcaaaaacctatttaagatctataaaaagctaggaaggcaaccaaagaaaaaaacataaatatgatgggtgatataatctataaaaactaaaaagctaggaaggcaaccaaagaaaaaaacataaatatgatgggtgatataatgtgataagaagaaaaaaaaaatgagtattattgagatgtttaaaaaagtgagatgtaaaaaaatcattattctttgccttaaaataagtgtagggattgaagaagatttagagtaatgattttagaatttactctcggcttcaattgtccaatctttttaagtttttatttttgttgattggctaaataaaagatagtaatcaatctttaaatttatgcaaaaagaatgcttctcctaattttaataaattatctttgagaggatagattttttctcaagacttattttatttatcattaaaaaattaacgaattacaatgatatgatattatgatatcttaaatgaccatgacagtttacttttttttataccttaacgtttgctgctagaaattactaagtccaaaagcacactgactaacctagaatgattaagatacttttttttacacctaataataataatagatttaaatatatttttcatataacatatttctttttagcttattacctaaagaatattcatttttattttattatatgatattttcaaaaaatttcttttgttatttgagttagtcttgatttattagtgatggtgtgataaaattatcacttaacatacttaaactaactaaaagtttaaaaatattaagtagtaaaataaataaaaaattatatccgaacaacatagttaaaccattggagaggagggcaaaggcgtaaaagcaaagggaagggttatatataacctagagacaagagcccaaaagcacagtgactaaccttttatcgcgtcctcggtctacacaaagtgccccttctcaactcggcgtttgtctcgtggtcgcgtggaaagtgatcagcggtgttccatttcgctattcattcgtctttactttactgcgctctctctctctccaattctctcttcggtttcgattttggtcttcgcagagcattgccgcgtagctcacacgcaccaccaccattgtctgcgtgctggtttagtcgatcattcgttcctttcactcaagtgagtaataacatctctctctctctctctcgtcgtcgcttttcaacgctgaatattttccctgtttcctgatactcgtttaatcgctccattcgcgagtacggtgtgcttcgcggccaagtgtgcatgatcttttttttgctgcatgttacatgatcgtgcttttagagggttcccgaatggatttttggacaatgtgcctacacttttcactcgatactattaatttctctggttttgtttttttgctaataaatctcctacacttaataatcattgttagtcctaatcagttgtgcgtttggttgatgacttcatcatacgattcgattactatatcaggtttaatgttttaggctgaatggcgtgttcaatcttctttccatagtattgatatattttattcttcttttttttttcaggttaccttgaaattctgagtgcgcgaatttcttcgcacacgtgtggtgctattggcggcacaaaccggggagcgcagcttatcactgtgcccaaccctttttggtattggtttatatactttcgctacggtcttttttgcactgtatttgtttccttcgaacaattatcgcctcccaaagttactgcttaaaattcaatcaatttgtttttttttttcctgtctttaactctgcttatggatatcttaatacactccagagatttcctctattaaggaaatttggtgtgtccgacggcgcagatttcttaacattgtgttgttaaatggcggccatgccatggccacaatggcggaaaggcttgcctactgccataggcaacttatgaagggaggcctgcaatggcagcaacataggccgcaatggcacgtttatattgtggaatttctgcctcccgccatcaaccaatgataacactctatttcttaacatgaatatttgttttttgaaacctttctatcaataagtttgttcatctttgatttcttgatatgtatctggtaggcattgggtgcacaagatatgtgttttttcctcacctccaaattcactactgaagaaatttagatacttctcggtttagcatcccaatgagcttatattccccaagtacaagccaaccccaaaaatgaagttaacatgtttagttttctactaaccaaagcaaattattacttcaccctttccaatttttttcctctttttatgtattttttgcttacttgacttaatttaaggtattttgttgaaaactgagagtaggaatgctatgaaaaatgtttttatcttttttcttttatagaacatatcttcctgtacctgtgtcttttgtctttagatttttttttattgtattaatagtatcaataccagtactcagccatattttcatgcaacctagaataagctagcaaatatacaagttcatgtttagatagtatggctatgcataattttactcacacagccagttgtttgtttttttaatctcattttgtttacactctaccaatgctctgtaaatgaacagattacttgaaattttctgccgagtgcaaggttaccaagtttcatggatgatgaccttttacagaggaacaaaacaccatctgttgtcataaaagcgataaagttcgatgtcttaactgaagaagatatagttaagtatattcttgatcttatatctatttcagctttttaattattctgtgtgtattagttctctgttactttagttgtgggattggatcaaatggaatgcacttactgtgtaacacattaacacagagtggagggtggttcatcaattttgtttaccttttgaaagataaatctattttgtagaatggattgtctctcataattctcttctgattgccttgtaatttattagccacatattaaatgtctattatttttacatctacaggagaatatctctgttttggagataaatgcagccgggcaggtcactgggtcaaatttgggattgccaaatgcatctgatgagtgtgccacatgtggcactaaagacaaaaagttctgtgaaggtgtgaattgacatattatatgaataatgtgtttaggggttttgttacattaattgtaaatttattggaaaaggtgctgaaaacatcaatatttaatttcaggtcattttggagtaatcaaatttcctactcccatactccatccatattttatgttagaaattgcgcacatcttgaacaagatttgccctgtttgtaaatctattcgtcacaaatccaaggtcatatatctgttacttctaccaaatactggaatacttagtgtaatttttgttataataatgcgcatttggttttttagtccattgctactgtattttaaaataagttaaaccaaatacatatttaaatcatgtggcaaatttttaggtgttttaaaatctttcccaaatattccccaccttttttaagttacatagattctacagtacaatcagacattatttgagaggttccatgtgctgtagtacaatatcatttattttctttgccagtttcattgttgtagttttatgagttggcttctatggattttattattacttgttatctgcttcttatttatagtcccattgtcttcttacagggtgctcgattaatctatggaaccaagcggtctaatgattgcaattattgttctgtaagtttgtgtggcttcaccttcattgatttgcttcaaagtaaatttcctttttttattactgttttgctttgtatgacaacttgtgcatcatatgtaggtgtatccatcaatgcaatttagagtttcctccaacgatctctttagaagaactgcaattattgttgaagtaaaggcttcaaagaaaactttgggaacagaaatacctgctgatttttggaattttattccttgtgatgctcaacaagaagaaaattatgtaaatagaagggttttatcacctgtgcaggtagcactacccacatttacatgcttttgcagtctgtataattttccttcagatacaataaagttgcactgtatcaaaattaaaatatagtctgctagaaggttactagtaatagactaatagtatgcctcatgatcttgttatatcatgttatatatgattaagacgaaaacatgttctgtttttcacttttcagttgactgctttttatgctgtggtattctaacttttgagtcatttctattatgtggccatgcttttttgctggtgctataatggtgtaaattttatatctttttgattttcaggttaattatttgttgaatgatgttgatccagactttattgaaaaatatattccaagaaagaatttgctgtgtcttaattgcttcccggtgactccaaattgtcatcgtgtgacagaagtcccttatgcaatttctagtggaagccggttgagttttgttagtatatttcttttctgccttgtagttttaaatacaataatatttataaactgtcacatgatgtcaatatacatttttttaatatggtactttatctggttaaatatttataggatgacaggactcgatcttgtaagaaattggttgatttcaggggtacagctaatgaattaagttctcgtgttttggattgcctgaggatctctaaggcaagattctcagctgttgttttcctgttagttttgtcactttgtcaaggttcttgccttttgcttatgttttttcttttgatgtaatgcagctaaatcctgataaaaccccaaatagtatttttgctgatatccagcaaagaaagattggagaaaatgctttcaattcttctggtttaagatggataaaagatgtggttcttggaaaacgcaatgacagttcattccgtactgtggttgttggtgatccagaccttgagcttagtgaaattggtataccttgtcatattgctgaaagtttgcaggtttctgagtatgtgaataggcagaatagggagaagctgctttattgttgtgagctacacttgttagagaaggggaaaataaatgtctgcagaaagggtagtatagttcatctgtataaaaaggaagatctacaaataggtgacaaattttataggcctcttgctgatggggataaagtgctgataaataggcccccttctatacatcaacattctatgatttctctcacagttagggtccttccaatatcttctgtagtgtgtattaacccactctgttgttccccactacgtggggattttgatggtgattgccttcacgggtatattccacaatcggttactgcaagaattgagcttaatgagctggttgctttagataggcaattgattaatgggcaaagtggtagaaatcttctttcactttcccaagatagtttgactgctgcatatttgctaatggaagatggggtccttttgaatgtttatcaaatgcagcagcttcaaatgctttctatttctaacaaaagattaatacctcctgcagttgttaaagctccctctagtaatagctcactttggaatgggaagcaattattcagcatgcttttgccgtatgattttgactattcttttccttcagatggtgttgttgttagtgatggagagcttgtatcttcttctgaggcttctggttggttacgcgattctgactacaatgtttttcagagtcttgtggaacattatcaagggaagactctaaactttttgtatgcagcacaaaaagttctgtgtgagtggctgtctatgacaggttttagtgtttcactctctgatttgtacctttcttctgattcgtatgcacgggaaaacatgatagaggaaatcttttatggcttacaagatgcagagcgggcttgtaatttcaagcagctattgttggattattattgtgattttctgtcaggaagtcttcaagagagtgaaaatgctatcactgttaatgcagatcgtctgaattatgaaagacaaatatctgcttctctcagtcaagcgtcagttgatgcttttaggcaagtttttcgcaatattcaaagtttagctgataaatatgcatgcaagggaaattctttccttgcaatgtttaaggctggaagcaagggtaatttgctgaaattagttcaacattccatgtgccttggcatgcaaaattctctggtccgcttgtcatacagactaccccgtcatctttcatgtgctgactggaatagtcaaaagtgggttgattcaatccagatgtcttctggtacccttgaatctgttcagtcatacattccatatgctgtagttgaaagttcttttttaactgggttgaatccacttgaatgttttgttcattcagtgacaaatcgtgatagctctttcagtgaccatgcggaccttcctggtacactgacacgtagacttatgttcttcatgcgtgatttgtatgatgcatatgatggaacggtgagaaatttatatggtaatcaacttattcagttttcttatgatattgaagaggactcttcatgcaataaaggtttccagcagtatgctttaggtggtgaatcagttggggctatttctgcctgtgcaatttctgaagctgcatacagtgctttgggtcaaccagttagtctactcgaaacatcacctttgctgaatttgaaaaatgttctggagtgtggttcaaggaaaagaaatggtgatcagactgtgtctttatttttgtctgaaaagcttggtaaacagagacatgggtttgaatatgcagctttagaagtcaagaattatttggaaagattgttgttctcaaacattgtttctaaagtgatgataatattcaccccacatgacagcaggagccaagaaaaatacagtccttgggtctgccactttcatttagacaaggaaattgtaacaagaagaaaattgaaagtgcattctatcattgactctctctatcagagatattactctcagagaaaagactcaaaagtctgttttaccaatttgaaaatttcaagcaggtaagtttcttctgcaaatggtgcttcaaacaatatatgttgttacttgaggaaatattaattgtccatgaatgctttaaaaagattgatgctaatgtctctgttgggaactgggagtttagggaagttatgactgttacataactttccttaactcttagttcccatcagtctctattcagagttctatttttaatttgctgtgctaaaagagtaaaggatatttaattattaaatattaatgcagataggcaataaactacctctatgcatgctgtttctgtatatttattatgtcatgattccagaaggtttttgttgcttcaattattgccaagtggataattggatatgctttttgtacttgtttctttacttttgacaacagcatttatcacttagctaattttcatgcagtccctgattcttgcaataatttacccacaatccttaaacaattaggatttgttacagagacaagtacaaaaagagtaaaggataacagaaaaaagttgagaatagagattgaaaattagaaagaagttagacaaatgagataatctaaaactatgattcagtacaatgcgagtttgtactccaaatttcaataacaagaccattacagcagagtttgcatgtcatagactatttttttattactggcagttttgatcaagaaagaacagcctgatggtgattgattagactattggggaaaaaccagttatgactataatttttttgaggcttgtaagtaatgaaaaataatggttttctacatttcaaaaaaagtttgtgaactttctgaaagcgtaaatatatatagccttaacacaatggccggagctgttatttttatagtagctgattatgatgaaatctctattccttccacattagttgtttctgccagtttgcaaatgttgcagttggattactctcttctcaagaagaggaatagtatgttacaactgtatataaggaatactatgtctccgtttcacgttgcaatacctactgaaatgtaaaggatgctagatagtagtgtgatagagagtttaaatcttttacaaatatgttaaaggattgggtaactttgctaaactgatttttttttttcacctctttttctttattgccgtgttttcttttcaagttgaagaggagcccttatcctactaacccttcttcttcaccacttgcattttctttgtaactttttctgcatcagttatcattcttgcttggagctttgatgatccctactaacttggacaatgaaatagcaggaagtgttctgctgattccatggttaaggaaggtgaagacacttctatagataaagaagagggtgatgattgcatcatggtcacaattgttgaaaactctaagaatcctatacaactggattctgttcgggacttggtgataccttttcttctaggaacagcaatacaaggttggtagtaatctaatatgaatatccagttgttgtttcaagtggtgattaatatgtgagccttttagaaattaccttgatgatcagatacatggccggggcatttcttaagctgttgttgaagttcagattatgtttttgctgcatatatgaaagtttaagttttctttgctgtcatgtcaacttgtatgattccatcattgttacaaaaaagtttacacttgatttggctattataaatgtgaaaattaaaagtgttatttttaatcattttctttcttgggaaacggtgttaaaaagcagagttgtaagagcaagatatgttttagcctgatcagatggccaagtaataatttgttttttcaaatacaaatattgcttgttatggtcaaatattctcatattcagtcatcatcatgaattcttgtattgttctttaggatttctggatgtcaagaaggttgatattctctggaataatcagtcaaaagtaacaaattctcgtaatggtttttctggtgaactgtacttgagggtaactttgtccagcgagggtagcagaggaagattttggggtgtcctcctaaagctttgtcacaagataatgcatataattgactggacacgaagtcatacagataacatcaatcatttctcatcagcatatggaattgatgcagggtggcaatactttttcaatgtgtgtatgattaaaaactttccctcctttgttttaggttctaaatgaaatatatggccacataaacttaatttacttgcatatggttttatgtgtagagtttggcatgtgcaacatctgataccggcaagtccatccttcctaagcatttgtgtcttgttgccaatagtctgtcatgtagtggagagtttgtaggattaaatgctaaaggcatggcactacaaagaaaacatgcgtccgtttcatcaccatttgtgcaagcatgctttgcggtcagttcacattatgattccagtcaaattttttatgatttatcatgtataagattttgatcacccatatataattcatgttgaaattatgtaatcttattgcagaatccaggtagttgctttataaaagctgctaagtctggagccacggataatctccagggcagcctggatgggttggcttggggaaactgtctatctatggggacaagtggaatgtttgatgtcatatattcagagaaggtattggttttcttatatattaatattagttttcttacttcgattcagattttatgtatcatgaatatgattccactagtattttagcctatgtaatgcacatgataaatatttattttttatataaatgaaatttataataaataatatttttgaatgtataaattatattataattaaatttcataataagtattttttaatatatagttatattttggatttatgataattagtttatattgtaatgcaaggttatacatggttatttttaacaattgatactacctccttcccatatcttttgatgtttttagctttcaatttttttcccaaaacaaattgatgttttagaatttcaaagtctaattaatgttttttttcctcaaatatacccttatttaatacccattactagtggtgtaggtatcaaagattaaggtattaaataaggatattttagtctaaatacaccaatttttagtttcattaaatgtttcttaatttatgtgcaataacattaaacatcaaaagatatggaaaggaggtagtaattacttttgaaaaattattgaaatttttagtagagatgaaaatgatagattgaaagaggtatatggttaagaaaattaagtattatttaaagacaaaaggagattggtttgagatagttgagaaagaatttttttgagttaaatgaaattaaatttgaaattaaaattaagaagtatatttgaaaataataaacagttaaaaaataaaattaaatgctcaatatatgatattaggataagacacgtggtttaatgagagtcataacagctcctaacaacgcttcctaagaacactcgttgaaaaatagctcgtaaaaaccctctccttcaagataaggattcagatttataatatcggagtagatttttaaagaacccaagaatgtacaagtgcattgcagtcccccaaaagtgtcacttttttaatagagaactgatatggttgtgcatgtgtaagatatgaaaaatttcactgaggtatcaaaacttttgaccaacttctcacaagaatgcagcatcctccttgtaattattataggctttcttttttgacttttttcctgttcaactgtagacctttgtaatacattctataaacactttaagctgatttttaagtcatgagattgttaaaatgtatgacttttgtttcttcagttatcattttccattttcaattcatacatgctagtttgctgtttcccagtaaatttaccatggttgccatttctctgataacaaaataagtgcataaaagctgagattctcagtttgtgcctagtaaggatagactaagaagagttctatggttgttaatcgttattgagaaaaactagtatggtacatgtaatactgtcatttgcaaattgtctaacatttgcttttatcagggacatcaggtagctaagtctgtagatgtgtatgagctgctagaagccagttttgacaagccgaacaataaaattggtactcatttgcacaaatattcatctgacaaatgcggttctgagtttaggcataaaaatggttatgccttgaaagagggaaaacagtggaaaaccattttaagaaattttgtgacagtaaatgatattcagaagctgacttttgcatcgaggtgcatattgaacaagtaagataatccacttttagccttttctaacctctgtcgtggtttgtgtttttaatggtatttagcaatgtatattctatgtatgacacctacattaccatatatagcatgagctaatattatatagtacagttggaaggttgtatttattattatgccatggtagtttcttgcagttaggtgcttccacgaaactactttctgctttgtaatcattatacagttggaaggttgtatgttatttgccttggtagtttcttgcatttagttgcttccacaaaagtaccttctgctttgtaatcattattatcttttcttctgtctttttattttatttttatagaaaagtttttcattgagtaatgagttcatgctgctttgccttctagggcaatgcgcctgttgtttggatggaaatatttcattagacttattagagatataaaagtaaaactatccttgagactcagcctagcttgaacttttagaaaattggttcttaactcattttatatgtagctatttctctctgttttgtattaagtatgaccaactacaaaattccctgttgaataaaacaatccttgaggctcaacctagcttgaacttttagaaaattggttcttaactcattttgtatgtagccatttcactctgttgtgtattaagtatagaccaactacaaaattttctgacatattgctatcaatttatctcagttattttcagaagtaaataacataaacaaattagtaacatgaataatttaatgagggagtgccgagtaatagatgattgggagatgaagagaaaaactttaacaaacaacaacaaagccttaacccacttaagataattcaaatggttataatttgtttgtagtacagtagattcaaacatataattgaacgtgatctaatttgttgaggtttattttattttattttctacataacaagtattcattgatagattatcatcatcattattgttcctgcctttggggaaactgccaaggcagttccatgtttgtttatttattctgttcctcaaggctgtcttgtttaggttcttctcaactttggggcagggtaggcattttttttttacataatggatttttcaaggaagtttagagcttgtttactttgagaaagtgttttttttttttcattcagttttcaattttaattacacaaatgacacctttttttcatttgttttttgttttcaaatatttgtgtagaaaacaatgaaaaccatagaaagttattttcactgttttccatacaaacatttgaaaacagaaaacaaaatgaaaacaaagtgacaattttgtatatttaaaagggaaaataaaaacaaaaaacattttctcaaacttaaaagagccttgctttgacctgtttcccgttaagttacttttttaggtccctattgttttattgagttttcatacaagtccttgtatttaatttttttattgggtctcctaaaaatatttagatttgttctctattatgtatgttgttgcaaaactcagggtatatttttttggatatggttttgttttgttgtctaggatcacttgctttcattgaggatctattatttgcagaataattgtgaattttggctgttgtcaatataggtattcaattgatgagctgctaagtgagagtgacaggtcaacaatgctaagggttttgaattttcatcctcataaaagtgagaagtttggcattggaccacaggacattaaggtatgtgtgcttgcatgaggtggttttgatgtgtgatcaaaatttattttgtttcttcgtacaaatgtgcattaaggtatgtgtgcttgtgtgaagaaggtttggatctgcagtcaaaatttattttgtttcttcttggttctttctaatgtgcttaaaggtaatgtatattaaattggagtgcactttaaatttcacagttgggaaatttttctatattctctgaagaaaattatctatatcctccacttaaaatgctcctttgagaaaggtacttgtttttttctgtctatgttcattatgaacatttataccttattgagcttgatgaattcagtggagccatgaagacaagtataaattggtcaaacatccctccttcacctcccaatgaaaaatacaataaaagatgcagtcataagaattgagagcattgtttgattgttatgaacttagcttgctttatcagaatgaaatctttctttacgtcttgtttttgtaaatgaaaaggatggagctaattatttcacttttctatatgggaaatttcattccatggttacaaactaaatttataggtgcagtataaatttagtttgtattataatgtttaaaatagcagccatttggctcccactatagcattatgccgctatttggaattgataattatgattccatagtagcatttaagggataaattcctatcaatgataacgatatagcagctgagaagaaagagatgcttgtgtcaattttgcttcttttgccatggtcaaatcttttgctagtaaaaatgtatcgtgtaatgaagttttcttcttgctcccggtcccggttgcccatgcctttttcccttttctattcgcaggttggatggcatccaaaatacaaggatagccggtgcttccatataataagaactgatgggacggttgaagatttttcataccgcaaatgcattcttggtgctcttgatatcgttgatccaaaaaaatcaaagatccaggagaaaaaatggtcaggacatggtgacacgtaatatctatgcatatccaagcataataagtgactgtcatttgatctggtgacagtcacagactctataaaatatgaagtgatgttttcgccgaagaaatcgttgtaaaaatacagtgggaagggtaatagtagtgccacaactctacaatcacaaaaagcaacgttgtttttctgcctttgttgtattatactatctcaaggctagactgggtgatagcttattcaaatgtcgctcgatggatttagctcgtctgatagaggtagtgcagcaaatcaagagtaaagtcataacttttgtgcagcagcacattttgaaagaaaggagataattcatagatgggagtatacaagatggaacaatggtagtattttttttttcttttcaatctgaacaatttaaattttattttgtataataaagatggagtgggttcttacccttagcttctttttgcttcttccactaatactttatttgccaacgattacgtaaggcaaagaaagatctagtggaagcagcaacgagaagcttgtaaaaacttgtacccccagaccatttgtattgatgaatatgtggcagttaaatataagatatgcctgattcaaatgtcatgcttatctctgcatatctctaacgcgcatattgaatgcgag

SEQ ID NO: 197 - DNA, 15579 bp, Glycine max; identical to SEQ ID NO: 196

SEQ ID NO: 198 - DNA, 18274 bp, Glycine max
ataattaataaaggttaaatatatctttatattattcatatttttaatcctattccttaaatataaaaaatataatgcatatatataatcatatatatttttaaattaattagtataaaattatataaaattaattttgtatgttattattataattgtgattaagattaattagtgtaaaatcatgtaaaattaattatatttgttatttttttaatatttaaagtaataactaatataaaattgtgtgtgaaattaattgtgtgtttattgttattattatttagtaaaaaaaaccagctttaattttatgcgtaaaaattgtattttttaaaaattattatttattaaaagttagacatttaaataattataaaggaaaaaaaaattgcagcctccaatttctggattcgtcactgctttaatctgatttagttgtaataccatatctgaaacacccattttctttgaacagtgttagtgttgcatcaacattgcatttacaaccaccataaataggtttctcccactgagtaagatgttggctgcatgcatcaacattgcacctagaaaaacaaacttgctgctagttagaaactgattctttaaccagttgaatagatgacatgggtggtttggtaacattatcccacattttttcattctgcctacgccaaatacacacaaaagttgtagaaatatcagagacaactgagaattagataaattttttagtatattgaacatcacattataaaatttccttctgttgtttgaacgaagggacaagtaatatgccatagtcccagcttcatgccaaacttgaacaacaatctcaaccaataaaaacatgttaatcatttctcgagaagtttgtttaaagaaagaaaacatggttcttaacatactataaaaatagaacttaacttttgtattttgtagtgattttaccaaatttgagcaaaatcatctcctataatttcttaaaaagagttcaatatacatttcattaaatttatattttactaattttataatatatatttaaaatatctacttatttctttctttccaaacaaacacttactcatatacatcaatattggtcgaatattttttcaaaaagaaaattggtctttatatacaatcccacccctaaacccattaattatgtgaatacaaaatctactaactaaccaccctatttaggtgattttttttaactaagttaatttcatttatgaagaaagtgattgactaggttgagctggcccaaacacaaattttgtgtgtgcctctttttcacttttacctatccaaggcctaattcccaatcaaaaccccaactccaccagtaacaaaagctgagtcaacgagggtaaactcgtcatttcatccccaaaacccaggctccaacaacactctttgcatggagcgcaaaaggcaaattagaaaaataaaaaataaaaccaaattccccagtttttgttaaaagagaaaaaaaaaatttaatttttcatttcatttcacactcactcgcttactcacttcattccatttctctccgaaaaccctctttctctcacgctcgttgttgtttcgatcggtttcgtgtaatgatgtacttagattttgcgtttgtgttattctgcatttccgttttcatgcaaacgcattttcagtactgattctgtggcttgctcctttttttttttttttttttaacgtaggttctttgcattttctagggttttgcggtgagctaagtgagacgctcgaattgaacagcttttgtttcgctcctgaggtaagaatcaggtcgaagaagaagagtcatgttttttttttttccttttcattctcgcttttttgttttttgagtttgtttttgctgtgatcgtagttgggttttagtttgacttgctctgtttcttagaatgtactcgtttttagggaaaatgttcatgccattgttcgttttatttctctctgtctctctccttttattattttatttttttattggttttggttttgttgaacatgtcaccaaccactttttcttaaaaaaagttttgaattcagtttttttttttttttgtggtgaaacaggatttgaaaatgtagctttggatgaagtagtgagagcattttattttttacccgttttaagagcttgcatgattttggttggggcattgttagagtttgtgtgtaaagccatttaatgccatagtttgaaaaggtagctttggatgaagtagtgagcgtttttttttttttttgcccgcttaaggagttggtttgggtgattataagcttgcataactttggatggggtattggtagagtttatgcgtgtaaagccatttaatgccataactaaggagtaaattttttagagtataataatgattacaattactaatgtagttgtggttgcaacttgtgagtaattaaccatttcagcgtgatttctctgtttttcaaatgccttgatcgggaattggttgaggattgactttgacataattggttgtttgtgtggggagtgcttttaaggcaatagtactttctagcaagaatggaagcatcacctctttgattgggtgcttgataagttttttttttttgatcagccaaaataagtatatatatattagcaaagtaccagaggtgcttgataagttgatttttgaaagttctaattgtgctaaacatttgtgatatctagtaatcccttcagacattcatggtggtcagttggtattggacatatcagatgtattcattctacggacttgttttatttgcttgattttgtgaaagtgtctgtaaagggaaaaggtgctataatgtttccctaaagttacactgcgttacctttgtagtatttttctgtttcattgattgtttaattacttttcctctgtaattctgttgaagttttgttaggtttacaagtaatgactgtaactttgagttatcattcagcaggcactataattgatcacgaaagtaatggaggataatcccccttcaagtgttttagatgggaccgttgttgggatcaaatttggtatggctacacgtcaggaaattgtaagcacaaaatacattcatttttttagttaaattgtatgactaaaggctgatccaccaagcagttgaagtctttgcaatattcagttagcatctgttttattaattaactcaaatgagataaccttgtatcaagtttggacgatgctgttatgatcagtcattagtggcagtgccaaggatgaaggatggcctgcttggatcttaggaaatacatgctagaattttttttgtagcgttttctgatgaccttatttggactattatttttgtttgtgacttttctcaaaaagttgaaatttatgcatgttgtttcagacgtatggtctgtttttattttatttttattgattgaatatttgaaattaacttatacacacacacatatgtatatatcatgactgtttactggtcatagttttattttatttttctcaattctgatcttgttgcgtgtgcatgtctggttttgattaaatttagtggaccatcacttttttctaatcaaaagttctctttgttagaattaattacattttttgaatataaattgatgttatggcctattcaatatttgaatagttttgatcaatttggtaattttctgctttcatcttgatagtgtacagcatccattagtgagtcttcaattagtcatgctagtcagctgtcaaatccattccttgggctgccccttgaatttggcagatgtgaatcttgtggtacctctgaagttggaaaatgcgaaggtttgttatttgctccttttctgtactttcttttaaatggtaaaaagagatatatttcaaatgaagtaatttgatattacttttcaggtcattttggatatgtggaactaccggttcctatataccatccgagccatatcagtgaattgaaacggatgctgagcgtggtctgcttaaattgcttaaaaatgaggaaaaccaaggtattgacaaatggaatattgtcatgtcatacacagaagagattatcaatttagaaaaacagttcaaactaatatagagtattggcagacaagtgatatgcagaatgtgtgaaacaaaaaagaagtttgacttctttaaagaaggccgcacaagggtgattggggaaacaaaaatgttataattgagtttatatgtacaaggagtgcttgtagatgcacctttaaaataaatatgggtaaagatgcctgctattgtgtagaatagagatctcttaattaattaagatccactaggaaacatttaaattaattaaattataacaattttgttgttcatgaccttttttttaagaaaaagaattcttgacctcatattttgaagataagggctcctgaatgagagttgttaattgtcttaatatttttttagtaatcctggcatcatacattttagttagatttaattcaaggataaaagcttcatctaatgccattatatgtgcttgatcttactggctcacaacctttcagtttccagcttcaagcagtggcttagcacaaagattaatatctccatgttgccaggttagtatgattaaattgcataatatcctttctcaatatgcatacagacttacattcttgaaatagttcctgcctcctagtattgtttataatttattctaccatttatacatgctatgttaagaatataagacattctaatttatatgcatgtgtatgtatgcattttattctaggtagaatcttatgatctatgttatggtctcacattttgcttgtataaccccccgtcctgatcctactgtttaagatcttatcttcactatctttattttttaccacaatacaccttttggctcaagattgtccatctactttatttccgcccctccccctcttccccggtttatttcatggtttacttagctgtgcattatcctctgtttaggtttgtatgattttgtcttggttcataattaatgcttcagtttctttatcagagttggctaaattttgtttgctattgatgctaatttgttatatatgggaatctgctatttttttttttgtaaaattccatttccaaggttcatggtatttatttcttccttttaggatgttaatgctgctctagtttctattcgggaagttaaaacaagtgacggggcttgttatttggcgctgaaagtatccaaatccaagattcatgatggtttttggagtttcttagaaaaatatggctatcgctatgagggtgatgaaactcgagccttgcttccttgtgaggtttagtttctactaacccatcttcttactttacttctcaactggctgttgcttttacttgtttgcatacaggttgcccgatttattaaattttttcaattctccttttttatgtacttccttcattttattaggcctctttatgtttctctctctctctttctctcttaaatatatatatatccctattattcttttgtccttgacattacctttctttgattttaaaggatattccatatggaatgatctgtatcagttatatatatacaacgaatgatctctctcgtggtttaattacccattccatgttgtttatatttttatcttgacaattctatttatttgcttcgttacaccacaagaattggcatttgcattttctaaatgattgaaatcttgactcctgaaatgtttttgattggctgttacgatggtccgtaattgagagtttcaggcaaattgttgtgtgctatttatttttaattcactatctttctattgaaacctgttgtttgccttttgattaatattttgctcaacaaatctatcaggcaatggaaattattaagagaattccgatagagacaaaaaaaaagcttgctggaaaaggattttttcctcaagatggatatgttttgaagtatcttccggtgccaccaaattgcttgtctgtgccagaagtttcagacggtgccagtgtcatgtcgtcggtgagaaaatgaacatattattgtatcagaaaacgtcttacttatcatttttgctctctattatgctaattctattctgttatagtttattttgttatcataatatgctacaacagtgtaactgcccaagtttaaaccagacttgataatggctctgctgtaaaattctgaaccatgagtacatgtataaatatatgaaaactccattcagaattcattatgtaaaataaattgcacagactattgaaactctcttctctttgattttctcatccgagtattcatattttggttttatgagcttgattttgttttggccatagtgcacattggtaagtggtgtatttatgttgctttgcaggatccttccatgacaattctcagaaaattgctcaggaaggttgaaatcataaaaagctctagatctggtgaaccaaatttcgagtctcatcacgtggaagcaaatgatttgcagtctgtggttgatcaatattttcaaattaggggcacttctaagccagcacgtgatatagagacacattttggggtcaataaagagcttactgcatcctcaacaaaagcatggcttgagaaaatgaggacattatttataagaaagggttcaggtttttcgtcccggaatgtaattactggagattgttataagaggataaatgaagtaggaattccggttgaagttgcccagcggataacatttgaggagagagttaacatccacaacatcagatatttacagaagttggttgatgaacatttgtgcctgacctacaaggaaggtgtgtcaacttattcactcagggagggctctaaggggcacatatatctcaagcctggtcagatagtgcatcggaggattatggatggggatattgtcttcatcaacagaccacctacaacacacaaacattccttacaagccctttatgtttacatccatgaagaccacactgtgaagattaatcctttaatttgtggaccgcttggggctgattttgatggtgactgtgtccatctgttttatccgcagtcacttgctgctaaagctgaagttgtggagctatttgctgtggagaatcagctgctcagctctcacagtggtaatttgaacctacagttatccacagactcattgttggcactgaagatgttggtcaagagatgttttttgggtagagcggcagctaatcaattggcgatgtttcttttgcttcctttgcctcggcctgctttgctcaaggccagttctgatgatgcttgttggacttccatccaaattttacagggtgcattacctatgggttttgattgcactgggggacgatatttgattaggcagagtgaaatcttagaatttgatttcagcagggatgctctgcctgcaaccataaatgaaatagcagcttcaattttctttggcaagggtcccatggaggcacttaaattcttcgatgtattgcaaccctttttgatggaaagcttatttgcggaagggtttagtgttagcctggaagagttttcaatatccagggcaatcaaaaggataataagaagaagcattggaaaggcttcttctctgctgtatcagctgaggtccttatacaatgagctggtggcgcagcaactggagaagcacattcaagatgttgaacttcctatcattaattttgctctaaagtcgactaaattaggagatttaattgattcgaagagtaaatctactattgataaggttgttcagcaggttgggttcttagggcagcaactttttgataggggaagattctactcaaagggattggtagatgatgtggcatcacattttcatgcaaagtgttgttatgatggggatggttatccctctgctgagtatggactgctcaaagggtgtttttttaatggtttggatccatatgaagagatggtgcattcaatttcaactagggaaataatggtgcgttcttcaagaggattatctgaaccaggaactctctttaagaatttgatggccatccttcgggatgttgttatctgttatgatggaactgtcagaaacatttgtagtaattccatcatccagtttgaatatgggatacaagctggagacaaaactgagcacttattccctgctggtgagcctgtaggtgtcttggcagcaactgctatgtcgaatcctgcttacaaggctgttcttgatgctagtcctaatagcaactcttcatgggagttgatgaaggtagacatttctttgtagtgaatgaatgttatttgtttttaatatctcagtaaatgatttttttcctgaattttttatttatgcattatatcttcaggaaatattactctgcaaggttaattttaggaatgaacctgttgatcggcgtgtcattttgtacttgaatgactgtgattgtggagggagttgttgccgagaaaatgcagcatattcagttaaaaatcaattgagaaaagtcagtctcaagaatgcagctgtggagttcattattgagtaagtttcttcttttaatgttatacttattaactttattctacacatcttttagttattaagaaaaataaaattcaagtatgttgtctattgttcatctactagtgattttgtttggggttggttaaccatagtcttttgcattatttgagtaagtcgtgatattttatattattgaagaatgagtttattttaattttttggggtcctgtttcttatccacagataccaacaacagcgaactcaaaaggaaaattctgaaactgatgctggacttgttggtcatatttatctggatgaggttattggatttccttttcattcaatttgagaacatttacatgtcgctgcctactttcattggcaactatgctaaaaaaaattccttcattatatgcaacttgttagaatataatatttatgaaaatatccattaaaatcttgatcatatctttagagtatctaagaactatttagaatatctaataatatcaagattgtatattagaatattttagtgtatcatagagattatcttttagaactttcttcccatttttctttctttccatatttactaatatctcatgttttgttttccttggttaggattatatgattagtacatgaggtttactgctttatttttatgaacacattatcattattttgttgtgaatcacatcatgtcagatctatatcaattccattctactttgtctctgttctctctatcctctctctctaccaaaaccctgtaatgttaacaaaatttaataaactaacatgattgaacatttttgcatgcctctggacttttccccctgggagaagatttgttgattttgaattattcttattatttgtaattgtaattactatttatgttttaataacttagaatatccttttgaacagatgatgttagaggagctgaagatcagcatggccaatgtttttgaaaaatgcctagaaagactcaagtcttttagtcggaaaaagaaagttaatcaatatttgaagaacattgaattatcatttaggttaatctttagttctttccttttgcatttgataatcggtcatccatttttaattattcatccatccctgaagtaagttttgtttgcagtatgtttggtagttggctagaagtgttttttttttcattttttttttaaaaaaaaaccacaccgttccttttaaaaatagtgttgcataaatggtaatctggaaatattttgatgttaaaagcaaagtaaaaggcagacaagaaaatgaaaacatacaggaagctttcactagctaggtggggaggggtggtctataatcatgtaatagctacaggggtaatagcttgggtctgtgtattcacaggaaccagctacatacttatttcaatagctgtatctctagtacctctggtactatttcactttaatatatatctatttttgctgagcaaaaaaaaaaaaaagaaaatgaaaacataacaaagctgcccattgtctatacaagtttgaaatgacaactcttaagaggccagacagtcctttctgatcataagaggaactgtgaagtgcttaatctttgttgtttctaggatacaagatctatattttattgatcatgaggtaagtgattttacactcgagtctgggactgggagttagacttggtgttaaaactggggagtttgggtgtagtcttatgattgtcatcatgtttaatgtgtatttatatcatcaggtacccccaactatcagttttatgtaattgtgtctgaaacagatcacacgtgtatttataataacaatatgctgatatgaaagaatctcgattaaatgctcatacgatcaaatccctaatgtctactagtgacatgtggtatactgatatttacaccaagaaactcagttaccatatctgttgagtttctgaatcttatattgctgagatgtaacccttgtatgttgtgtcccacattctcagtattgtccttggaaaaactatggtttttctttctgtttcggagactattaaaaatgaaattttctctggtttctttatgacaatttcttatcttcttttcttcactattcctacgtattaaatttgttgatccaaataaggaaagaaaaaagaagtcaaagcttttgtacattgcctttatatgtattatgtcactgttataacatgctattttttctgattattgcagtttatttgttagtctatatcactttctgatctatgttccatcttggcagtgagtcttgctcatcttcacatcctgctgcaccatgtttaacattttggctaaagaatcatgatagtgatttagataatgctgtaaaggtcctgtctgaaaatatctgccctgttctgttcgaaacaataatcaaaggtattttctttgctatcatttctttaatggaagtactctatttcttttttcattaaatctatatttacggttttgtaggtgaggtggaaaagagattaatgtggggtttaattgatgtgccacaattcactaacttaatggtcatatagtcttatttattctaataattaggtcaagtattagtacaatactacaatctagtacaattcaaattcactacttcaacaagactccaaggtctaatactctaatattctctctcgtaaagattactaaggttatggctgttacaagtagcaaaccagaaacaaaatatcagacaccataatttaaaacaaactggcccattttaaataaataacttatgtaactagtactctccttaataataaaatcatgatggtgtgctcggaagatagctcccataagtctttgaccattctcttcaagcactggaacatttaccactggccaacataggcactatcagaaatcccattgtctttcaaagaaagaacaaagtagttgatagaggacctgtcctgcattcaaatgctaatgcttcacaatctagattgtaattgacttttacttatttttttcagatgtgatttgctctgcaattatttgtggcctgtcatgttttgttgcatttataatcatgattcatgaatactcatgtcacgtattttcttgttagtaatgcttctgatttaccctcataaataaataggagacccgcgcattagctctgcaagtataatctgggttagtccagatacaaacacatgggtccgaaacccttataaatcatctaatggtgaattggcacttgacatcgttcttgaggaggaagctgtcaagcagagtggcgatgcttggagaattgtacttgattcctgccttcctgttcttcacttgattgataccaggcgttccatcccttacgctattaagcagattcaggaattactggggatatcatgtacttttgatcaagcgattcaggtgagtttctaaagaatatattgaacataatgttagctgtttgctctttatgcttatgatctttagcatatttcctctctttagtgtctatgctgtgtatttcctcgttcattaatttttaaaagtgaatttattttattttaatgtacattccaactgtcataatcagcagtaatttatagttggatgcttttagcatcatcacttagtgtttttcatttattgaaagagcatttgatctgattctgttggcattttttgctttcatgcatgtaacagtatagtttcaactttaaacttcatgcttgaaatttgatagagagaaagaacaagttttttattctgaatattatgtctatatattgggtacaagcagaaccaatatataggccgagctttagctgcacgctttatgactgcctagtgataactgtaaacaatctaataactgacagaaggctaacggaaagctaggtacaattcagtgtaatattgctccttcaatcccaagggtggtatttgactaagatgatctaacagaaagctaggtatagttcagtctaacattcccagtgtaatccctagggtgagatttgactgcgaggaattacgttgtcataatctactactccaagtttgttgcaaaggttagcaaagcgagtggttccaagggcatttgtcagaatgtaatcatattggttctgtgatggagcatgacaaacaactaaatcttttttagcaactttttcacaaacaaagatatccaatttcatgggatttgttctggtatgaagcatagggttgggagctagggaacctgtacttaggttatcccaacatcttttaagtgtaaatgtgaagatttagatctaaagatcatttatagttttgtattgtaactgagtttttgatatattttcttagtgagtaattcaattattttaaaatgtccttttcagaagtcctagtcttagggtgcatttagaagttcctttaagttgattacccaagcatacccttagtaattctaacaagaactaacaacttacattggcttataaaaaacaaaacttaagtagtaagaatagaataataaccttgttgcctagtagcaataggaaataactgaataaattaaaaacaaatatgctactcttttgaaacatttgggttttgagctaactgaatttgttattaatgatcaatttattacaatgaaatgaatcatctatatacagatgacagtatgacactatgacagaactgagggcagcaaagagactgcacctgaaatgaaacaaaccgaagggctcaaggcccaaacagaaacatacagaacaaaactggaaaatgtatttctatcataatattataactaactctaatataaggaaaataatcaactgaaaataaacctttgtgtttatggtgctattcaacttttgctgttctcgtgtgttttggagtgtgatgttcataacattgaggaggtttgttttacagtttacacttgtctctaagtttgatttggaatatatttttaattatgtcatctctgagctgtgcttttatgtcttcaggaatatttttatttttaacatgtatcttttatgattggaaaggctcgctgcatgcttagtattgctccctatttcataatctttggtttacaagttttgttatcctcccattatgacttctctatcttatatttcctctttagtctttagtgaattttcttctttttaagagaaaatgtgagatatgaattattgtgtctagtttgatgaaatcttgatcattatgacatgatccaattgttatcatcaattattgaatatatttttcttctgtatgcttctattttctcttcatggaattttctcctaagagaaaatgtgcaaatgatatatcattaattattgtttcttgtttgatgaaagatttgatcatgatccaatctttagtagccacccattatgactccaccttttattcatatctcatccttttgtggctgcctgcagcgtgttgcagcatctgtgaaaatggtggcgaaaggtgtacttagggagcatctaattctgttagctagtagtatgacatgtggtgggaacttggttggctttaatacaggtggatataaagctctctctcgtcaattaaatatacaagtaccgttcacagatgcaacactctttgtaagttgctgcttgctacttgttgtaatcatgagatgtatcaggttattattattcttactttgtaaacgtgactatgcagacacctaaaaagtgttttgagagagctgctgagaaatgccatactgattctctgtcaagcatagttgcctcctgttcctggggtaaacatgtggcagttggtacaggatcaaaatttgacattgtttgggattcaagtgaggtatttgataatactgatttaatattggacttgattagaattggagttttgtaaacaatatttgaatattgacattttcttttgcagataaaatcaaatgaaattgaagggatggatgtttacagttttcttcacatggtgaaaagtgtaaccaatggggaagaagaaactgatgcttgtttgggtgaagatattgatgatttgctggaagaagaatatatggacttgggcatgtccccacaacacaactctggttttgaagctgtatttgaagagaatcctgaagtactgaatggttcaacatccaatggttgggatgtaagttcaaatcagactcaatcaaaaaccaatgagtggtcaggttgggcaagtagtaacaaagatggtagatctgaaactgcccaagagaattcttgggggaaaactgtcaaccaagaagactcttccaagtctaacgcttggaatacaagcaccacagcagatcagacaaaaactaaatctaatgaatggtctgactggggtagtaacaagtctgaaataccagctggtggatctaaagcagttcaagaagactcttccaagtctaacgcttggaatacaagcaccacatcaaatcagacaaaaactaaatctaaggaatggtctgcctggggaagtaacaagtctgaaataccagcttgtggatctaaagcagttcaagaagactcttccaagtctaacacttggaatacaagcaccacagcagatcagacaaaaactaaatctaatgaatggtctgcctggggaagtaacaagtctgaaataccagctggtggatctaaagcagttcaagaggactcttccaagtctaacgcttggaatagaagcaccacagcagatcagacaaaaactaaatctaatgaatggtctgcctggggaagtaacaagtctgaaataccagctggtggatctaaagcagttcaagaggactcttccaagtctaatgcttggaatacaagcaccacagcagatcagacaaaaactaaatctaatgaatggtctgcctggggaagtaacaagtctgaaataccagctggtggatctaaagcagttcaagaagattcttccaaagcttggaatacaagcaccacagcagatcagacaaaaactaaatctaatgaatggtctgcccgggtaagtaacaagtctgaaataccagctggtggatctaaagcagttcaagaagattcttggggctccagtaagtggaaggctgatgttgcccaagaagacaattccaggcttggtgcttgggatgcaaatgcagcagatcagacaaaatctaatgaatggtcgggctggggaaagaagaaagatgttacccaagaagacaatgtgcaacattcttggggctctggtaagaggaaagacaaagttacccaagaagacaattctggctctggtgattggggtgccaacagaacagatctggcaattaccaaatctagtgaatggtccagctggggaaagaacaagactgaaataccagctggtggatctgcaaatgtgcagaatgactcatggggcttgggtaaattgaatgatacccaaaaagataattctggttgtggtgcttggggtgaaaattctgggtctgcatgggtgagaaataaagctgaaacaatagatggtggatcagaaaagccccaagaggatgcttggaactctggcaattggaaagctgaatcaaaagttggcaataccacttggggaaaacccaagtcttcagaaagtcatgcatgggattcccataatcagtcaaatcaaaattcaagttcacaggggtgggaatcacatattgcttcagctaattcagaaaatgagaaaggttttcagtggggaaaaggtagagactcgtttaagaaaaatcgatttgaaggttcgcaaggtcggggttcaaatgctggtgactggaaaaataggaatcgcccgcctagagcacctggacagagattggacatttactcatctgaggagcaggatgttctgaaggatattgaacccattatgcagtctatcagacgaatcatgcaacaacaggggtaagttactcgtggcagtaaatactatctaatataatgacttggctagaagaaatcatgatgtctattttcctttcctgttataatacaatatctatgctcaagttaagcctggacattttattgtcacctttgttttacctacactaaattgcaagtagcataatttgaaagcacaaggtgtcattccttccattttaggaacatttgtttctgctcaacagtttttttctccttccaccacaatttttctataagttatttttttggttttaagaagataccattagcaatatagctattattactttgatttttgctcctgataaaagcttgtgttattaatcaaatccactgttccctttggctgtactttctgtcctagccttgggtgctttctgtatgttttccctctgcttctatgaattttgtatcataacctggagcatttttattaaattcctgttgaaggtacagtgatggggatccactggctgctgaagatcaactttttgtacttgagaatgtctttgagcaccacccagataaagaaaccaaaatgggtgctggaattgattatgtcatggtatcgtccaactctgtttacatcttttgcatttatttatgattgatatgatcatagttgccctagataaacacgtttctttcttaaacttccaatgtttgtgtactgaatgatggtttattttggtttctctatttccttgcacatctgtcagtttttgtatatgcaatacatcatctatttatccattcttggataatgggttgcattgaaacttgaaataattgtctgtctttatgttatgctggatttaatgttgggagtacttgcacaggttaacaaacacagtagcttccaggaaagtagatgcttttatgtggtttgtaaagatggtcaaagcaaagacttttcctaccggaagtgtttggccaactatataagcaagaagtatcctgaccttgctgaatcattccttggcaaatattttcggaaacctcgtgctaggggggaccagactgcaacactagggggagaccagactgcaacaccagcgcaggatgaagcagccacttcgggtgagtagattagggttgtgtccataatattgtacagaaacggtgtagttgaggccactgaatagttcgtcatagctgaccaattttcctgtaggaaagtgttcctctttttggtgacagttagatggtaattttttttcacatgcgaatgatgatagcaaacacccttttgccgatgttaatattgttctaatgattacagcacttatgatgtgcctagcaaactttgctcatcattttatttaaaccatcaattgcacctgggtttcagacattgattggaccactgatacaaaaatggcatccttctgattagagtttcatgaatcagttgtggcttatatttttgtttaataggtttctaggcatttccgagttatatttaaaccggtagaatttctttgatttagttttttcttgtctcatctttgtaatacagactgcgatggtttagtatctcgatttttaaaggtcctggtcaaaggcaggaatgactttaactgcccattttgttaaccacactgttctttataattcctggtaaatttttttttcaaaatatcatttagcgtaacgaaaccttttgggtgtaatttctatgatgacaagtattgctcaaatttatgtgaaagaacgagttggcttcgg

SEQ ID NO: 199 - DNA, 7206 bp, Glycine max
aaattaacttcgacccgttctctaactcacggagtccaattaatcataaagaaaattagcatgagacgtgtagtgagactatacttatggactctccgtgttatgttacgtttttcaagatatataacaggcttactcgaacaatgattgaggcgacaaaattaacaagctttcgataaagaacctagaaatgtggaagaagagaaaagaaatttaaaaattaaaaataatttgttttaaatatttcatcaatattttttttattttttcttatttttttatacattataaattctattatattttttgttctttctctgtgtaggtggaggatagcatgagtctatcaaacatttttctaatttttatagaaagaataaaatagaaaagaaataaagtaataagtatatttacctatagacgtattaaaccaaagttaacaaaactaaataccttaaaatgaattttaataagagcaattatattttgacaactcatcaataagttattggtttaagtggtccttaattggtcctttaaaataagattttgagtttgaattttgtggatgaaaaaaaaaaacaagataaggagaaaaaaagaacttcactagaggtgaccaattaaattttttaacggggattaattattagtaaaacaggtggatactccacaataatgctatggtgatcaaaaatattttgatggctcaaaattttaagcattccaccaataattcttttttttatcttttcttttctatcacattatatcatcaatcaaattaattacttatttttttcttcattttttcatcaaggtaacagacaactcaagattgtccaaaaaatatttatctttggataccaatccatgcaccctcctctggtaaatccttgataattggtttagttaaatgggtaaatacccattttgatttatgaaaatgaaaagtgtgagattggttcttaaaagatgaaagatttaaatttgatatttaaatatgaaaaaaatgtgacaaattaatcatgtcattaacttttattcattgtgactcttgcctatatagcaccttcaaactcaaatgttatgagagtgaatgttatgtttgttgcataatcatcaagactaatttatcaacggtattatctatcaactaatttgttagtcttcaaatggatgattttttcatttggatactaaatttaattttttaatcaatcatcatctctcacttttaaataccaaaataaaatatatcaacaagttattgatccaaataatcttagactcaattcacttgactaaagcttcacgttcaagccttatggacagtaagtgagagggaagactcattaaggatgattaatgaggttcaccaagtggagattaatttccaacatcattatcatggtataaaaaaatatcaaaataaatatttatccaatttataagtcacaatataataataaaaaaatgggtacgggtccaattgtccttgggcgaggacacatgcgtctttccgttacgagaaagtatttcacttcacttgggagttgggacaagtgaggaagtcaagagttggttctttaccccatatacccctccctatcacgccagaaacatttcatttctcttccagcaaatcgaaacggctcgcgttgttcacagtcacactctcactctcacactctctcactcacactcacactcacaccattgtatagaagattagagagagagaaccctaaactaaaaccctaaaattccattgcagcaagcaaaggcattgatcgatctgcatgggtcacgtaggttccagcaaggacggcaccgaggctgggccttccgccgccgcgatgggcatcgacgacgacgaagacatcgacctcggcgacgtcgatctcgacccgaccaacgccgaaatcctcgaagagctcggtgaagacattgtgaaatactggtgcaagaaagcgtcgatgctcttcttcaacgagtacggtctgatcagccaccagatcaactcctttaaccacttcatccacacaggcctccaaaaaaccttcgaatccttcggagacctagtcgtaacgcccgggttcgacccttccaagaagggagaaaacgaacacttccgttacgcctccgttaagttcggcaatgtgaagctcgataaacctatgttctggggcggtgaagggaacgcgcaggagtttaagatgcttcccagacacgcgagaatccagaggatgacctacgcttccaaagtcaaaatccaagttaaagttcaggtatcgggcaaaatggagtgagtaatgctgtgtaatgttggtttttgtttctttgttggagtaattgaatttgtgatgtgtgtggattttgtaggtgtatgttccgaagaaggtacggagtgataagttcaagactgggaaagcggaattccttgacagggaggttatgaaggaagacgagagggaaatcatcattgggagattgccagtcatggtcaagtctgatttatgctggatgaaagaggcggagaaggaggatgatgaatttgaccatggaggttattttatcgttaagggtgcagagaaggttcgtcttatctgttttttgtatttcaatttgtattcttgtgtttaatttgtataggtttgtaaagggtttttacagtgttaactgttaacccatcagaaataaccatgtatgatggattttacaataactacttttaaggtcatgtttagcatagtttttctgattgattgacattgtaaaaactgacggtgcatggaaattattctcttaatctttcttgtgtcttcatgatatatttatttaatgtatatgtttatagtatgttaatgatacgagtttgttttgtgtggaaaattgttgcagacttttattgcacaggagcaactgtatttaaagaggctatgggttatgaatagtccaggttggatgattgcctacaagtcacagatgaagagaaacaggatggttattaaactggtaggaaattccaggggtgaagaagtggagaatggggacatgtctcttgctgtatattttttgtctgttgaggttcctgtgtgggtactgtttttcgctctcggtgtctcatctgacaaagagattgtagatctcattggttgtggcaatgatgatgtcagaattcagaatattctctttgcatctgttcgggatgctgatgagaaatgtggagcatttcgaagaggtaggcatgcagttcaatatttagaaaaatgtgtaaaaagtgttcaatttccaccttcggagtctatgcaggagtgccttgaaatgtatgtcttccctggaattagtggtttgaatagaaaggcgcgcttccttgcatatatggtgaaaggtctcttgctggcttatactggccgccgaaaatgcgacaacagggatgattttcgaaataagaggcttgaattggccagtgagcttcttgaccgtgagttgaaagtgcacattgcacatgcccggaagcgaatggcaaaagctttgcagagagacctttatggagatagggatgtacgcccaattgagcattatctcgacgcgtccataattacaaatggcttgcaaagggcattttcaacaggagcgtggtctcatccatacaagaggatggaaaggatctcaggtgtggttgcaaatgttgggcgcactaatcccttacaaaccatggctgagttaagaagagcgaggcagcaggtccagtacacaggaaaagttggggatgctagatatccgtgagtcactataagatttgtctattttagttatttttttattattattgttgttttctttctgctgttgtgcagtgagaagtgtgttagacaactaaaatagttgttagttctatacagctattttttccttttctttttgcttttatttgttacaacaaaagtttgtggttacaggcatccttctcactggggcaaggtttgtttcctctctaccccagatggtgaaaattgtggactagtaaaaaatttggctgtcacaggattagtaagtactgatgtatcggcagtatctgaatatatactgcctaaattgctggattgtggaatggaagaacttgttgatgatacttccactcatcttgggaacaaggacaaagttctcctaaatggcgattgggttggagtgtgtcctgattccagttcatttgtggcagagctacgaagcagaagacgtagaaatgaactgcctcatcaggtttacttttaatatcccattttaaagtggttttgttggctctactagtcatattttaatattgtaaaacattcttttaatttgacccatgtagtggatctcaccttgtgggaaaaggcttttgttattgttgtatgtttttaatttgagccataaactgtcaaatctagttagtagcatttggaaacttttgtctatattagctaataattttatagcttagtttatgtctttttgaggactgtgattgccaatgactgacattttgtaaatgcttaacctgcttcacatgattggattaactgtttggacttccttttttctgtgaatgatgttattgtttcctgacaccctgcctctgaatcaatttgtcgtttttgtgtccctttgcagggtagatgatatattaacaaatgatatagttactgtttaagcatttggaaacttaagtctaaattagctaataattttatggcttaatttatgtctttgtgaggactggtgatcctgtttcttttgaacctggtgataactattttccattgtaggtggaaatcaagagagaccaatctcaacatgaagtgcgcatatactcggatgcaggaaggattctacgtcctcttttggtggttggtaatctactcaagattaaaggatttaaatcagactgtaactctttccagtctctattggataaaggtgtgattgagctgattggaccggaagaagaggaagactgttgtacagcctggggtgttgagtatttatttggaaaagaaggaaaacgatctgtaaagtacactcattgtgaacttgatatgtcattcttattgggtttaagctgttcacttgtaccatttgctaatcatgaccatgcgaggagggtactctaccagtctcagaagcactcctcacaggcaattggcttttctacaacaaacccgaacattagagttgatactttgtctcaccagttacactatccccaaaagcccctttttcgaacaatggcttcagattgtcttggaaaaccagacaattcacttggtcaaaataaaataagtaaaatacctccaaaggcagaattctataatgggcagaatgcaattgtggctgttaatgtacatctgggatacaatcaagaggattcccttgtgatgaaccgtgcttcactgcagcgtggtatgttcaggtctgagcacataaggagttacaaatctgaaatcgataataaggaatcttcagataagaagcgaaaacctgaagacattgtaaattttgcaaagctacaaagtaaaattggccgagttgatagccttgatgatgatggctttccatatgttggtgctaatttgcagagcggtgatattattattgggaagggtgctgaatctggtgcagacaatagtgtaaagttaaagcacactgaaaggggttatgtgcaaaaggttgtgctgtcttcaaatgacgaagggaaaaattttgctgtggtttcattaagacaggtaactggtgaatccctaaattttgcttgtgcatgaacttttaggaattactgtaacgtacataacttactgtcacaaattagtacattttaatgcccatctacattcacaactgaaagctacctttaatttgatcactggataaatctgttatttaataatgttgcaggttcgaagtcccgttcttggagacaagttctccagtatgcatggacaaaagggagttttgggatttctggagtctcaggaaaattttcctttcacaagacaaggcattgttcctgatattgtcataaatccacatgcatttccctcacgacaaactcctgggcaactcctagaggctgctttaggaaaggggattgcttgtggtggcatactgagacaagctacgcctttctccacaccttctgttgatgccattactgaacagcttcacaggtacagtttgatcacaccattcagtttactgtgtcttgcattatgtgagccattctttcaaagaggaacttgcatttcagcttctacccttgcttactgtattactaatgttttttatttgcctgtgtcttcaaagttgtagacggtttcttgtcttttctctagtctcgctttaaaattaagaattactttgcctaacttcacttttaaagttatcgtgtaacttgttcttgttttactgaaccctcacccacgttccttttgagaatatggcagagctgggttttcaagatggggaaatgagagggtatacaatggaaggactggtgagatggttcgatcactcatttttatgggaccaacattttaccaacgtctgcaccatatgtctgaagacaaagtgaaattccggaacactggtccagttcacccgttgacccgacagcctgtagctgacagaaaacgatttggaggtatcaagttcggtgagatggagcgtgattgcctaatagctcatggtgcatcagccaacctgtatgaacgcctgtttacactcagtgactcctctcagattcatatctgcagcaaatgcaaaaatgttgcaaatgtgatcttgcggcctgtctctggtggccggaaaatacgaggaccttattgccgccactgtgaatctgcggatgacattgtggtggctcatgtcccgtatggagcaaagttattatgccaggagctctttagcatgggcataaatcttaaatttgaaacccaactttgctagacaaacactaatggtctcttttgttcatttctcccttaaatgaatttcagtgtagatattactttcgttcgccgatgtttctttgaatgcctggcaattagaagtactggatctcttttatcttgttactgatgcatgtttctctattatttacgggctagttagtgtatccttgtgaaaagttgaagacaagaaatttaaaaatgattattaaca

SEQ ID NO: 200 - DNA, 6835 bp, Glycine max
aagctcagtgtttggatcaatagcctgccaaaacaaaaataaaacataaaagagtatataataattatacaaggatatgtgggtgttaaagggatcaacaactcaataataaactgatgttgtcacgtggattacaattaaattaatatcttacttgaatttctagattttgaacaacacattatattgagagtgtgaaaataaggttcattgaaaagcctaattgttcctttgagctactttggcttcctatttatttccattttttaggaggatttcctctcttgtcccatatgtacattttgtcagacttacaccactcacacacatttaagttagggatttgagattctattcttattttgactcacaattcccaacttaactccaactccatagtcttgttagggtcccaaatgacaatgacaagacctattcaatggggtggctccaacttgatgacttatctaacttatgttgtgaacttaaacaattcatctatcataaaaatggttaacagcggggtaagatttacttccataatgccattgatggtggaaccacatattggcccaaatactccactataattgtctcatctttcctatattttatggttagtcactcactacacaccctttcacatctatgtatttagaaaagtatctctcttgctaatgaaattctatgtacatattagttatagaacaaagattagatgcaattatgtaagtgctttaggtatattgatctttaattagaattggagttttacttccataatttacataataaaattttacattaaagagcaccataagtcactgaagtaaaattctatgttgataagtgagcaatatcagaagtatttaaggatatgcatagttgcatataagttttgtccttagttatacattggagcttcaccatacctcttaatcgtcttttgcctcttaactttattggccacttcggaattgaaatatgacacatgtatgtggctgctaatttagctgacctactttgtgtataacatgttattaggatatccatttaagtttgttaattggagtctgagtcataaccactcttatttgcggatgtatgagactaatgacttatagagttttgtggaccaattggagagtcccagcagccagagaaaagttaaagtttttcatgtttaaaatgggtacgagtccaattgtcctggcccgaggacacatgcgtctttccgttttcctttcagcgaacgagaaacggagaaagtattgacttcacttgggacaagtgagaagtcaagagttggtgctttaccacatatacccctccctatcaccccagattgccacaagcgtttcataactttcatttccaggaaatcgaaactgctcgcgttgttcacagtcactcacactcactcacattggtgcagagagagagagacctaaactaaaaccctaaattccattgctgcagcaaaggcattgatcgttcggcatgggtcacgtaggttccagcaaggacggcaccaaggtggggctgtccgctgctgcgatggacatcgacgacgacgacgacgacgacgacgacgacctcggcgacgtcgacctagaccctacgaactccgaaatccttgaagaactcggcgaagacatggtgaaatactggtgcaagaaagcgtcgatgctgttcttcgacgagtacggtctgatcagccaccagatcaactcctttaaccacttcgtcgccatcggcctccaaaacaccttcgactccttcggagacctagtcgtaactcccggttttgacccctccaagaagggagaaaacgaacacttccgttacgcctccgttaagttcggcaaggtgaagctcgacaagcccatgttctggggcggtgaagggaatgcgcaggagttcaagatgcttccgagacacgcgagaatccagaggatgacctacgcttccaaagtcaaaatccaagttaaagttcaggttgggcaaaatggagtgatgccgtgtaatgtaggtttgttgctttgttggagcaatttaatttgtgatgttgtgtgtggattttgtaggtgtatgttccgaagaaggttcggagtgataagttcaagactgggaaagaggagttccttgatagagagattatgaaggaagacgagagggaaatcatcattgggagattgccagtcatggtcaagtctgatttgtgctggatgaaagacgcggaaaaagatgatgatgaatttgaccatggaggttattttatcgttaagggtgcagagaaggttcgtctcttcagcttgttgtatttcaatttgtagtattcttgggttttgatttttgtaggtcttcagaaaatagtatatatactgatactgttaagtctgtaaaggtttttcagtgttaatccgtcagaaataaccatgtatgataaatttgttgagttttacaataactacttttaaggttatatttaacatagtttctgatttattgtgtgctaatgatatgaatttgttttgtgcgaaaaattgttgcagacttttattgcacaggagcaactgtatttaaagaggctatgggttatgaacagtccagggtggatgattgcctacaagtcacagatgaagagaaacaggatggttattaaactggtaggcaattccaggagtgaagaagtggagaatggggacatgtgtcttactgtatattttttgtctgttgaggttcctgtgtgggtactgttttttgctctcggtgtctcatctgacaaagagattgtagatctcattggttgtggcaatgatgatgtcagaattcagaatatcctctttgcatctgttcgtgatgctgatgagaaatgtggagcatttcgaagagttaggaatgctgttcaatatttagaaaaatgtgtaaaaagtgttcaatttccaccttcggaatctatgcaggagtgccttgaaatgtatgtctttcctggaattagtggtttaaatagaaaggcgcgcttccttgcatatatggtgaaaggtctcttgctggcttatactggccgcagaaaatgcgacaacagggatgattttcgaaataagaggcttgaattggccagtgagcttcttgaccgtgagttgaaagtgcatgttgcacatgctcggaagcgaatggcaaaggctttgcagagagacctttatggagatagggacgtacgcccaattgaacattatcttgacgcgtccataattacaaatggcttgcaaagggcattttcaacaggagcgtggtcacatccgtataagaggatggaaaggatctcaggtgtggttgcaaatgttgggcgcactaatcccttgcaaaccatggctgagttaagaagagcaaggcagcaggtccagtacacaggaaaagttggggatgctagatatccgtgagtcactataagctttgtctattttagttcttttctttattattgttgttttctttctgcagttgtgcagtgcaaagtgtgttagacaactaaaatattctttacagctattttttcctttactttttgctttcatttattataacagaagtttgtggttgcaggcatccttctcactggggcaaggtttgtttcctcactaccccagatggtgaaaattgtggactagtaaaaaatttgtctgtcacaggattagtaagtactgatgtaactgacgtaactgaatctatactgctaaaattggtggattgtggaatgcaagaacttgttgatgatacttccactcatcttggcagcatggacaaagtcctcctaaatggtgattgggttggagtgtgtcccgattccagttcgtttgtggcagagctacgaagtagaagacgcagaaatgagctgcctcatcaggtttacttttaatatcccattttaagtggttttgtaggctctactagtcatttttttaatattttaaaacattcttttagtttgacccatgtagtggatctcaccttgtgagaaatggcttttgttattgttgtatgtttttaatttgagcattaaactgtaaaatctagttagtagcatttggaaacttaagtcaatattagctaataattttattgcttagtttatgtctttgtgagggctgtgattgccaatgactgacattgtatatggtttacctgctccacatgattggattaactgtttggacttcctttttttcatttttttttctgtgaatgatgctattgtttcctggcaccctgcctctgaatcaatttgtcgtttttgtgtccctttgcagggcagatgatatatgaattatgaacaaattttatagttactgtttaagtttggaaacttaagactaattcagctaataaatttatagcttaatttatgtctgtgaggactggtgatagctaatttccattgcaggtggaaatcaagagagaccaatctcagcatgaagtgcgcatatactctgatgcaggaaggattctacgtcctcttttggttgttggtaatctactgaagattaaaggatttaaatcagaccgttactctttccagtctctattggacaaaggtgttattgagctgattggacctgaagaagaggaagactgttgtactgcctggggtgttgagtatttatttggaaaagaaggaaaacgatctgtaaagtacactcactgtgaacttgatatgtcattcttattgggtttaagctgttcacttgtaccatttgctaatcatgaccatgcaaggagggtgctctaccagtctcagaagcactcctcacaggcaattggcttttctacaacaaacccgaacattagagttgatactttgtctcaccagttacactatccccaaaagcccctttttcgaacaatgacttcagattgtcttggaaaaccagaccattcactgggtcaaagtaaaatacctccaaaggcagaattctataatgggcagaatgcaattgtggctgtcaatgtacatctgggatacaatcaagaggattccctggtgatgaaccgtgcttcactgcagcgtggtatgttcaggtctgagcacataaggagttacaaatctgaaattgacaataaggaatcttcagataagaagcgaaaacctgaagacattgtaaattttgcaaagctacaaagtaaaattggccgagttgatagccttgatgatgatggctttccatatgttggcgctaatctccaaagcggtgatattattattgggaagtgtgctgaatccggtgcagacaatagtgtaaagttaaagcacactgaaaggggttatgtgcaaaaggttgtgctgtcttcaaatgacgagggtaaaaattttgctgtggtttcattaagacaggtaactggtgaatcccaaaactactttaatgaagatgcttgtgcatgaacttttaggaattactgcaacgtacataacttactgtatgcatgtagatgggcattaaaacgtactaatttgtgcatcatccgaacatggatgttttgttacacaactgaaagctaccgtaaatttgatcaccggataaatctgttatttaataatgttgcaggttcgtagtccagttcttggagacaagttctccagtatgcatggtcaaaagggagttttgggatttctggagtctcaggaaaattttcctttcacaagacaaggcattgttcctgatattgtcataaatccgcatgcatttccctcacgacaaactcctgggcaactcctagaggctgctttaggaaaggggattgcttgtggtggtatactgaaacaagctacgcctttctccactccttctgttgatgccattactgaacagcttcacaggtacagtttgatcacaccattcagtttacttaaaatgcagtttggattaccgtgttttgtattatgtgaaccattctttagaagaggaacttgcatttcagcttctgcccttgcttgctgtatgactgatgttttttatttgcctatgtcttcaaagttgtagatggtttcttgtcttttctctagtctcgctttaaaattaagaattattttgcctaatttcacttttaagttgtcatgtaacttgttcttgttttactgagccctcacccacgttccttttgagaatatgacagagctgggttttcaagatggggaaatgagagggtatacaatggaaggactggtgagatggttcgatcactcatttttatgggaccaacattttaccaacgtctgcaccatatgtctgaagacaaagtgaaattccggaacactggtccagttcacccgttgacccgacagcctgtagctgacagaaaacgatttggaggtatcaagttcggtgagatggagcgtgattgcctaatagctcatggtgcatcagccaacctgtatgaacgcctgtttacactcagtgactcctctcagattcacatctgcagcaaatgcaaaaaagttgcaaatgtgatcttgcggccagtgtctggtggacggaaaatacgaggaccttattgccgtcactgtgaatctgcggatgacattgtggtggcccatgtcccgtatggggcaaagttattatgccaggagctctttagcatgggcataaatcttaaatttgaaacccaactttgttagacaacactattagtgtctcttttgtacatttcctttaacttaatgaattcagtgtagatatcactctcgttcgtggatgtttctttgaatgccagcgagttaggagtactgcatgatatcctgagcttaacttgaatgtcattgcatctcttttatcttgtt

SEQ ID NO: 201 - DNA, 6990 bp, Glycine max
tcagaaatggagaggtgggaggggacggtggttgtagtttgagtgagaggagatgctactctatgggttcgtatcggtatgtggttcgtgatttgaatttgcaagtcgtgttatctcattctcaatctcaagatgatgatgatgatgttttggaaaatgggaatgtggaggggaagaggataggggactcaaccaaaggtgagagcttctctgtttccaagatatggctttggtccaagaagaccagatttcatggttctaatgcacctttcccttgattaattcaattcttgctgtaagaattgcttaacaatcaagtgtgtgtttggttaagcggtgcgattgtttctcattgttcaattattcaccgtgaatttgagagctaaaattcactgtgattggtatccaaacatactgagaaggtggaaacatgtgaggaagctagattttccatcaagaattgcatggcaataatagtgtgctttttttaaaaaaattcatatgccattaatatatacaggtttatgttagatgtctagatgatatactagggctcctttttgtctctcaccacttagcactcgaattacattgatctaggttgaaaagaatggttccagcgttttaaactggatcattgatatgagaaagaagtattgttacaaattccatgagtaaaattgtccaatattacattttgccaataaaaaaagtcctataatgatgttctaaaatttgcatgctggaggtgtagtgttactcttcaacaagttgtggccaaatgctaaaacattaaggctgtgtttgtataaccgttgagttgcgttgaatggagaagtaacagttttttacgctctgacgtttactttctagaaaagtaagaaatttcattggaatcacacaatggaatttttaacgagtttccgaacatacagtaactgttaaatttagaactagtcttaaagtaaacttgaatcaagatcacatgctacaattatattattttcaacatatagagatattaacactaataatgttccagtacgcaaaatgaacaaataagaagagagagaatcttcttgacgaaactctatctaagacttaaattctcattcaccaaaacaaaaaatgtgttcgtagttgcacgtttcattatcaagaactgaagtgaatttaatattattgagttttcttttggttgaataatattattgagtttgtaatactaaaattgaaccgaattaaggattccaactaatccaaatattttctacttaaaaaaattaatcccaatatttttttatgcttatcccaatattttattttagtagtgtgtttggtttaaagaagaaaaaatatgagataaaaatggaagagaaataatttaaagaggataaaataaaatgatatattatgttatttaatttaagagaaataagtgagaaatagtattttgtgtgtgaaagaaaataaatttttacttaaaagtcaattttttttttttttgtaaatccaaagaaaatcaattttttccctaaaaaatcaattttactgcaattgagagaaaaaattgtaagtttacagtttactccttccaaaattcaacaaaattgaacacgagagtcttttctaccaacggagacacagtcactccagtagagagtagcatcatggggacgacaacgacacccctttcccacacggttcgcgtgtccaacatcccccaatccgcgaccgcgaaggacctcctcgacttcctcgaatcgacgttgggttcctccacggtgttcgccctcgaaatcttctccgacaaccccaactggaagtcccgcggcttcgggcgcgtccagttcgagaccctcgacgccaggtcccgcgccctctcgctctcccaactcaaccagctcctcttcaaccgccacttcctccgcctctccgaaaccgactccgacatcatcttccgcccccaacaccgcctccaaaacggcgtcctctacgccggcttcatgctatccgaccaccgcatgagcgtcctcgaatcgtgggagggcattgcggggtgggtcctgccccaaaggaagagacttgacttctgggtgtggcataatggtgactgttacagactcgagtttttgtttgaggatattttggagtctcatggctattgtttgggagaagatgccagactcaatgcccttctcttgaaggtactatctattattgttatggacaaatacttattctctatcagtattggagttttacctaaataatctgcttaatagtagaagttttacctaggtaatcactaattaaagaacaatataaaagaaattctgtgtataaatcatcttgtttaatgtcaagaagtaagaacgtggggaagggaggggcaagaggcttttttttttatatatatatatgtcggtaaatgttggtttgttagttttgttagaaatctgagtggagattgcaacccacaaactttctcctctcccttcttccttcaccttttctctaccactcagtcaaccttatatctctagggacaaagaggcttttaagtttgactaagctctaaattaaggatttgttccgtagtgtaaaaaaaatcgaagcttgtgggggatatctagggtcccgttagtctatcaacagccttaaatacggtggttaaaaaaaaaacaagtacgaatgtgaattaggactttagtttatatgattgatgggttttttttttgtcagatgaaatttgggccaaggatttataagaaaaagacagggacagatgtggcagccaattttaggggtgatagataccgttttctgaaggaggattttgaatttctttgggtgcggactactgacttctcgcctctcaagtcaattgggcactctacttcgttttgttgggaaattgtggaggaacatttagcttcggatgtttttacaagtttcccactctacaaggaaaatttgagagatctggctctggaagacagagaagaactctgttctttgacagaagcagttccgcttgtaaaacatgctacgcaatccaagttaccttatgaggctgttttccagctgaattctcttgttcatacccagaaaataagtcttgcttcggtggatgatgaattgattgacttgttagcagacttagatgaagaaactagagctgtggtttttcagaaattgcacaagatgagcttcacttgttatgagcctctcaaatttgtcaagactcaattgcatgtgctgagtaacaagaaaaaaggtctgctgcaatcgccgcagaataggctgacagatagtaatattatgagctgtcatagagccttgattaccccgacaaagatttattgccttggtcccgagcttgaaacctcaaatcatgtggtaaagcactttgcttcacttgcatcagacttcatgaggattacctttgttgaagagaattggaataagcttccaactaatgcagtatcaactggtgtgcaaaagggaatcttttcaaagcctttgaaaactgaaatatataagcggatattgactattcttcgagatgggatcgtaattggctcaaagagatttgagttcctggccttctctgctagtcagctgcgatcaaattctgtttggttatttgcttctaatgacaatctgaaagcagcagatatcagagaatggatgggatgcttcaacaatattcgcagtgtttctaaatgtgcagcgaggatgggtcagttgttcagttcttccatgcaaacttttgaagtggcctctgaagatgtggagatgattccagatattgaagttacttctgatggtgtaagctactgtttctcagatggtattggaaaaatttcccaatgttttgctaggcaagttgctcaaaagctaaacttggatcatactccatcagcatttcaaattcggtatggaggatttaaaggtgtcattgccattgatcgccattcctttaggaagttatcattgcgtagcagcatgcttaagtttgaatccaataataggatgctttgtgtcactaaatggagtgagtcaatgccttgctttctcaatcgagagattatatccctgttgactacgttaggagtaaaagatgaggtacttttggcaatgcaacaggaccaattggatttgttaggaaggatgttgactgatagtaaagcagctttggatgttttggaaagtttaaacggagctgattcaaagagcattctagtgaagatgttgcatgaatttaatgagccaaacagtgagccttacctatcgatgatgcttaaggcttattatgcataccaattatctgacttgaaaagtagatgccgaatatttgttcccaagggtcgggtcttggtaggttgcttggatgaaactggtcttttgaattatggccaagtatttgtccgcataaccgtggcaaaaactagggaaaattttggagatgaaaacctaaggaaagtggatggggatgatagcacacgtataatagtgggaaaggtggtggtcacaaaaaatccttgtcttcacccaggagacatcagagtccttgatgctatctacagtaaagaattagaggaaaacggtttgagggattgccttgtatttccacaaaaaggacataggtatgtatataatgaactacatttacaatcccatttcattgcaagttgcaaccatttttcttttcaacgtagaattattacatcttttacatttatctttggtcctgtgtggtatcattgactaccatgagtcatttaatcacatgctaacaaaagaaggagatgcaaactgcaggatgagagatgttgttgttaggtaggctatcgcagtatcatttgtcatgtagattccagaacttgcagcatctacttgtgtgatgtttttcatttacttttcttactgtttcaactatttggtgtccttaatcatcatcagtttattattgtctaacggggcctatgggttctagttcaataggtctattaggttactttaagcttccttaaatgtttggaaaaaaaattacactgagattcgtttatttatacacatatctgaagatttagatgcacatagtttctagtagtaccttttgcaattagcttggttgttattaattttattatgaagcctgcagtcctagtgtagttgggttatctttgacctgactaaggaggcccggatactcatcatctaactccaatatcatggaaagataaaaaagtttatatgattatgcatattatattttatgtaatttaagaatatccttaatgtttagcctcttttttattctaaaaagttcaagtccaagccctacccagattttaaaccagctctgaatttgtccttactggcctgtgggcttaactttgaagttctatattttctaagactggttaagctcaggcccacctgggttctgcatcaagaagccgcattattatcattgatgtatattgttgctaatacttgttggttgaccaacttggcctgcaggcctcatccaaatgaatgctctggaggtgatcttgatggagatttgtttttcttaagttgggacaaagatctaatcccatgtcaaactgaggctccaatggactatacaggaaggaggcctcgtataatggaccataaggtgaccctagaggtaattttaaacaaagttacgattttttttttaaggaaacattgataaatgaaaaacttcttcctcatttgttctttcttgagtgtgcaggaaatccaacaattctttgttgattacatgatcaatgatactttgggtgctatctctactgcacatctcgttcatgctgaccgtgaacaagataaggccaagagtagaaaatgtctggaattggcagagcttcattccatggctgttgactttgcaaagactggagcacctgctgcaatgcctagagttctgaaaccaagagagtttccagatttcatggagagagttgacaagcctatgtacatctccaagggggtactgggaaaactttatcatgccataattgagtcacaaatgcaaataagatatagctttgtgtggtcagagaagcatgctgaagaagcatatgatcgtagccttgaagtgaatggttttgaggccttccttgagacagcatcaactcacaaagaaatgtatgcagagaagatgagcagtttaatggacttttatggtgcagagaccgaggatgaaatgctacttggtaacgtgcaaaaccgtgcttcatatttgcagcgtgataacaggagatatggtgatatgaaggatcggattctgctctcagtgaagaatcttcagcgtgaagctaaagaatggtttgaaactagttgccaaccgcgtgaatataagcctatggcatctgcatggtatcatgtgacctatcaccgcagccattattgccaggaaagcccatgttttctaagctttccatggatagttggtgacattttgctgcaaataaggtctgtgaactcctttgttaacagatgaattctttctctaatgatgtgcatttatttttgaaaaataaaataaaatctgaagccgtttgtggtggataaatgtcaatgcagacgttgattgaaggtaccaccatgtctaccagattttccttttgcaaaatattattgttattattattggcattataaatatttactagctgtacatgcgatgttgatactagtgggttgagttactccaaaaccaactcaccaaaattccgggtttgtgggacctggcttacaccctgtcaattactagtattagttcgagtttagtaaagtcaaatgaaaacaagtattgaaagagtgtctcactttcgtatctcaagtcatcatataaatttcaaatcctacacattataccacctatgaggagacaaagtttcttgggaagtaaattcagattattctgagattgtacaaatagaacatatt

SEQ ID NO: 202 - DNA, 6748 bp, Glycine max
  misc_feature (718)..(817): n is a, c, g, or t
aaaaaatttaaacaatgtatttatataaaattaataaagtatcatatatttcaataaaaactataaataagtaaactaaatgatattcacattctaactaaacctaaaataccatatatataatacaaataatatcatacaaacctaataaatctaaaccaactaataataacataacaactaaaattaacgtacaaataattttatcacaaataataacatacaaatttaaaaaatcttaacaaaatcatattaataaatcaactacaactaacgtacaaataataatataccaattcaaatttgtaacatatacatataacacaaataatattaatatttcaacgtactatttaaaatttaaaagtaccacctaacatcaacaaacgtagcatatgtatatataaaacaattaataccatactaatttacaaaatttaaagaaaataatattatcaaattaactaaaactaacctaacatatatatatatatatatatatatatatatatatatatatatataacaactaataacatacaatttaaaaaacctaacttaaataatattaatatatcaactaaagttaccaagttaagaaatacgtaccaaaaacacagaaaccaggagagaaatcacgtaatagggagaacaaagcatttgtcctacaagataaacaaacttaacgtaaataatttttcatatatcaactaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacacggaaccaggtagagaaatcacgtaatagggagagcagagcattgtcatacaaaagataaacaaacttacccgtaaataattttcatatctcaagtagaagtaaagttaacatatatatatatataacacagcaaatatttaaagttgccattaaaaaatacttccaataaaaaaagctggaacaaaataagaagaacgcaatgtagtggaggaatttatgaagaagaagaaaacaatgcaaggaacacaactatggagtcaggaaacttcttttataatgcaggaattttgaattaaaacaactagccagtgcaattggcgagtcctttctgcccacaaaccgctagccaggctggcgattccctcactgaaagcaaaccgccaatacggatggcgattccctcctgcatggcctgaccctgaagaacctgcttgcactctcctacacctagcccggctgagcctacttgttggaacttgttagtttgactggcaatttcctatatatggcgatatcgccattgccactggcgactccttcgcaaacaataaactcgccatttccacttacgatttgcgtggtgcatgcatgcaaatagcataaaaaacaatctctcacgaaaaaactttgaaaatgacccatctaaaaaaatagtttataaaagcaccccaaatgcgaaaatttgccaggttttgtttgtgtttggaagaaaactgaacacatcacgagacccttttccaccaacagtcgctgtgcctgtgttacttacgctctcagtcactctagtagggagcatcatcatggggacgacaacgacgacaaccctttccaacacggttcgcgtgtccaacatcccccaatccgcgaccgcgaaggacctcctcgacttcctcgaatcgacggtgggtccctcgacggtgttcgccctcgaaatcttctccgacaaccccaactggaagtcccgcggcttcggccgcgtccagttcgagaccctcgacgccaggtcccgcgccctctcgctctcccaactcaaccacctcctcttccaccgccacttcctccgcctctccgaaaccgacgccgacatcatcttccgcccccaacaccgccttcataacggcgtcctctacgccggcttcgtgctctccgaccaccgcatgagcgtcctcgaatcctgggagggcgtcgcgggctgggtcctgcccctaaggaagaggctggacttctgggtgtggcataatggcgactgttacagactcgagtttttgtttgaggatattttggagtctcatggctattgtttgggagaagatgccaaactcaatgccctcctcttgaaggtattacctatcattattattacggactagcattattctctatcagaattgaagttttacctagataatctgcttaatagtagaagttttacctaggtcatcacttattgaagaaagaaaatacttaagagtctgtatttaaattttgtcttgtttaatatcaacaggtacgaatgtggggatgggagggacaagaaactttaagtgtgactaacaaagctctaaatcaaggatttgtcctatagtcggtcaaaaagactgaagcttgtgagggatatcttaggatcctgttagggtgtcaaaagccttacatacggtggttttttttttttttttttttttaaaataaaacaagtatgaatgtcaattaggactttgatttatatgattaatgggtttttatttatttgattttttttttttttatgtcagatgaaatttgggccaaggatttataagaaaaagacgggggcagatgtggcagccaagtttaggggagatagataccgtttttgtaaggaggattttgaatttctttgggtgcggactaccgacttctcacctctcaagtcaattgggcactctacttcgttttgttgggaaattgtggaagaacatttagctttggatgtttttaaaagtttcccactctacaaggaaaatttgagagatctggctctggaagacggagaagaattctgttcttcgacagaagcagttccgcttgtaaagcgtgcttcacaatccaagttaccttatgaggctcttttccagctgaattctcttgttcatacccagaaaattagtcttgcttcggtggatgatgaattgattgacttgttagcaggcttagatgaagaaactagagctgtgatttttctgaaattgcacaagatgagcttcacctgttatgagcctctcaaatttgtcaagactcaattgcatgtgctgagtaacaagaaaaaaggtctgccacaatcgtcgcagaaaaggttgacagatagtaacattatgagctgtcatagagccttgattacccccacaaagatttattgccttggtcctgagcttgaaacctcaaatcatgtggtaaagcactttgcttcgcatgcatcggacttcatgaggattacctttgtcgaagagaattggaataagcttccaactaatgcagtatcaactggtgtgcaaaagggactcttttcaaagcctttgaaaactgaaatatataagcggatattgactattctccgagatgggattgtaattggctcaaagagatttgagttcctggccttctctgctagtcagctgcgatcaaattctgtttggttgtttgcttctaatgacaatctgaaagcagcagatatcagagaatggatgggatgcttcaacaatattcgcagtgtttctaaatgtgcagcgaggatgggtcagttgttcagttcttccatgcaaacttttgaagtggtctctcaagatgtggagataattccggatgttgaagttatttctgatggtgtaagctattgtttctcagatggtattggaaaaatttcccaatcttttgctaggcaagttgctcaaaagctaaaattggatcatactccatcagcatttcaaattcggtatggaggatttaaaggtgtcattgctgttgatcgccgttcctttaggaagttatcattgcgtagcagcatgcttaagtttgaatccaaaaacagcatgctttgtgtcactaaatggagtgagtcaatgccttgctttctcaatcgagagattatatccctgttgtctacattaggagtaaaagatgaggtgcttttggcaatgcaacatgaccaattggatttgttaggaaggatgctgactgatagtaaagcagctttggaagttttggaaagtttaaatggagctgattcaaagagcattctagtgaagatgttgcatgaatttaatgagccaaacagtgagccttacctatcaatgatgctcaaggcttattatgcataccaattatctgacttgaaaagtagatgccgaatatttgttcccaagggtcgggtcttggtaggttgcttggatgaaactggtcttttgaattatggccaagtatttgtccgcataaccgtgacaaaaactagggaaaaatttggagatgaaaacctaaggaaagtggatggggatgataacacatgtataatagtgggaaaggtggtggtcaccaaaaatccttgccttcacccaggagacatcagagtccttgatgctatctacagtgaagaattagaggagaagggtttgagggattgccttgtatttccacaaaaaggacataggtatgtgtataatgaactgcatttacaatcccatttgattgcaattgcaaccatttttttattcaacatagaattattacatcttttacatttatctttggtcctgtgtggtgtcattgactaccatgagtcatttttaatcacgtgccaacaaaagaaggagatgcaaactgtaggatgagagatacaaggggaaaggaggatgttgttgttggctagactatcacagtatcatttgtcatgtagattccagaacttgcagcatctactcgcattgcgttttcatttacttttgcaaaaacaaaaatgttatttttactgtctcaacaatttggtgtccttagtcatcatcagttttttattgtctaacgatgccaactggttctagttcaatgggtctattaggttactttaagcttccttaaatgtttgaaaaaaaaaatttacagtgagatttgtttatttatacacatctctgaagattcagatgcagagtttctagtagtaccttttattatttagctcgtgattaattttattatgaagcctgtagtcctagtgtagttggcttatctttgacctgtctaaggatgccagatacttatcacctaaccccaatgtcatgaaaagagaaaaaagtttatatgattatgcatattatattgtatgtaatttaagaatatctttaattttttagcctcttttttattctaaaagtccaaaagcccaacccagattttaaaccagctctgaatttgtccttactggcctatgggcttaacttcgaagtcctatattttttaagactggttgagctcaggcccacctgtgttctgcatcaagaagccgctatattatcattgatgtttattgctgctaatacttgttggttggcctgcaggcctcatccaaatgaatgctctggaggtgatctcgatggagatttgtttttcataagttgggacaaagatctaatcccatgtcaaactgaggctccaatggactacacaggaaggaggccccgtataatggaccataaagtgaccctagaggtaattttctacgaagttacaatttttttttaaagaaacattgataaatgaaaaactgcttcctcatttgttctttcctgggtgagcaggaaatccaacaattctttgttgattacatgatcaatgatactttgggtgctatctctactgctcatctagttcacgctgaccgtgaacaagataaggccaagagtagaaaatgtctggaattggcagagcttcattccatggctgtcgactttgcaaagactggagcacctgctgcaatgcctagagttctgaaaccaagagagtttccagatttcatggagagggttgacaagcctatgtacatctccaagggggtactgggaaaactttatcgcgccataattgagtcacaaatgcaaataagatatagctttgtgtggtcagagaagcatgctgaagaagcatatgaccgtagccttgaagtgaatggttttgaggccttccttgagacagcatcaactcacaaagaaatgtatgcagagaagatgagcagtttaatggacttctatggtgcagagaccgaggatgaaatgctacttggtaacttgcaaaaccgtgcttcatatttgcagcgtgataacaggagatatggtgatatgaaggatcggattctgctctcagtgaagaaccttcagcgtgaagctaaagaatggtttgaaactagttgcgaaccgcatgaatataagcctatggcatctgcatggtatcatgtgacctatcaccccagctattattgccgggaaagcccatgctttctaagctttccatggatagttggtgagattttgctgcaaataaggtctgtgagcaaaggagttcacaaatgaaggcttcctctaatgctgtgtgcatttttattttgaaaaaagaagaaaaaatctgaagccgtttgtggtggataacatgtatatgcagatgttgattgaaggtaccaccttgtctgcgagagtttccttttgcaaaatattattgttatcaatatttggcattataaaaatttactagccgtatatgtgatgttgatgccagtggcttcatctataaccaggttcagcgaatcaagtgggttgggttactccaaaaccgtttcaccaaaattccgggtttgtaggatctggttacaccctgttcgagtttattaaagtcaatttaaaacgagtat

SEQ ID NO: 203 - DNA, 5917 bp, Glycine max
ggtagagaaatcacgtaatagggagagcagagcattgtcatacaaaagataaacaaacttacccgtaaataattttcatatctcaagtagaagtaaagttaacatatatatatatataacacagcaaatatttaaagttgccattaaaaaatacttccaataaaaaaagctggaacaaaataagaagaacgcaatgtagtggaggaatttatgaagaagaagaaaacaatgcaaggaacacaactatggagtcaggaaacttcttttataatgcaggaattttgaattaaaacaactagccagtgcaattggcgagtcctttctgcccacaaaccgctagccaggctggcgattccctcactgaaagcaaaccgccaatacggatggcgattccctcctgcatggcctgaccctgaagaacctgcttgcactctcctacacctagcccggctgagcctacttgttggaacttgttagtttgactggcaatttcctatatatggcgatatcgccattgccactggcgactccttcgcaaacaataaactcgccatttccacttacgatttgcgtggtgcatgcatgcaaatagcataaaaaacaatctctcacgaaaaaactttgaaaatgacccatctaaaaaaatagtttataaaagcaccccaaatgcgaaaatttgccaggttttgtttgtgtttggaagaaaactgaacacatcacgagacccttttccaccaacagtcgctgtgcctgtgttacttacgctctcagtcactctagtagggagcatcatcatggggacgacaacgacgacaaccctttccaacacggttcgcgtgtccaacatcccccaatccgcgaccgcgaaggacctcctcgacttcctcgaatcgacggtgggtccctcgacggtgttcgccctcgaaatcttctccgacaaccccaactggaagtcccgcggcttcggccgcgtccagttcgagaccctcgacgccaggtcccgcgccctctcgctctcccaactcaaccacctcctcttccaccgccacttcctccgcctctccgaaaccgacgccgacatcatcttccgcccccaacaccgccttcataacggcgtcctctacgccggcttcgtgctctccgaccaccgcatgagcgtcctcgaatcctgggagggcgtcgcgggctgggtcctgcccctaaggaagaggctggacttctgggtgtggcataatggcgactgttacagactcgagtttttgtttgaggatattttggagtctcatggctattgtttgggagaagatgccaaactcaatgccctcctcttgaaggtattacctatcattattattacggactagcattattctctatcagaattgaagttttacctagataatctgcttaatagtagaagttttacctaggtcatcacttattgaagaaagaaaatacttaagagtctgtatttaaattttgtcttgtttaatatcaacaggtacgaatgtggggatgggagggacaagaaactttaagtgtgactaacaaagctctaaatcaaggatttgtcctatagtcggtcaaaaagactgaagcttgtgagggatatcttaggatcctgttagggtgtcaaaagccttacatacggtggttttttttttttttttttttttaaaataaaacaagtatgaatgtcaattaggactttgatttatatgattaatgggtttttatttatttgattttttttttttttatgtcagatgaaatttgggccaaggatttataagaaaaagacgggggcagatgtggcagccaagtttaggggagatagataccgtttttgtaaggaggattttgaatttctttgggtgcggactaccgacttctcacctctcaagtcaattgggcactctacttcgttttgttgggaaattgtggaagaacatttagctttggatgtttttaaaagtttcccactctacaaggaaaatttgagagatctggctctggaagacggagaagaattctgttcttcgacagaagcagttccgcttgtaaagcgtgcttcacaatccaagttaccttatgaggctcttttccagctgaattctcttgttcatacccagaaaattagtcttgcttcggtggatgatgaattgattgacttgttagcaggcttagatgaagaaactagagctgtgatttttctgaaattgcacaagatgagcttcacctgttatgagcctctcaaatttgtcaagactcaattgcatgtgctgagtaacaagaaaaaaggtctgccacaatcgtcgcagaaaaggttgacagatagtaacattatgagctgtcatagagccttgattacccccacaaagatttattgccttggtcctgagcttgaaacctcaaatcatgtggtaaagcactttgcttcgcatgcatcggacttcatgaggattacctttgtcgaagagaattggaataagcttccaactaatgcagtatcaactggtgtgcaaaagggactcttttcaaagcctttgaaaactgaaatatataagcggatattgactattctccgagatgggattgtaattggctcaaagagatttgagttcctggccttctctgctagtcagctgcgatcaaattctgtttggttgtttgcttctaatgacaatctgaaagcagcagatatcagagaatggatgggatgcttcaacaatattcgcagtgtttctaaatgtgcagcgaggatgggtcagttgttcagttcttccatgcaaacttttgaagtggtctctcaagatgtggagataattccggatgttgaagttatttctgatggtgtaagctattgtttctcagatggtattggaaaaatttcccaatcttttgctaggcaagttgctcaaaagctaaaattggatcatactccatcagcatttcaaattcggtatggaggatttaaaggtgtcattgctgttgatcgccgttcctttaggaagttatcattgcgtagcagcatgcttaagtttgaatccaaaaacagcatgctttgtgtcactaaatggagtgagtcaatgccttgctttctcaatcgagagattatatccctgttgtctacattaggagtaaaagatgaggtgcttttggcaatgcaacatgaccaattggatttgttaggaaggatgctgactgatagtaaagcagctttggaagttttggaaagtttaaatggagctgattcaaagagcattctagtgaagatgttgcatgaatttaatgagccaaacagtgagccttacctatcaatgatgctcaaggcttattatgcataccaattatctgacttgaaaagtagatgccgaatatttgttcccaagggtcgggtcttggtaggttgcttggatgaaactggtcttttgaattatggccaagtatttgtccgcataaccgtgacaaaaactagggaaaaatttggagatgaaaacctaaggaaagtggatggggatgataacacatgtataatagtgggaaaggtggtggtcaccaaaaatccttgccttcacccaggagacatcagagtccttgatgctatctacagtgaagaattagaggagaagggtttgagggattgccttgtatttccacaaaaaggacataggtatgtgtataatgaactgcatttacaatcccatttgattgcaattgcaaccatttttttattcaacatagaattattacatcttttacatttatctttggtcctgtgtggtgtcattgactaccatgagtcatttttaatcacgtgccaacaaaagaaggagatgcaaactgtaggatgagagatacaaggggaaaggaggatgttgttgttggctagactatcacagtatcatttgtcatgtagattccagaacttgcagcatctactcgcattgcgttttcatttacttttgcaaaaacaaaaatgttatttttactgtctcaacaatttggtgtccttagtcatcatcagttttttattgtctaacgatgccaactggttctagttcaatgggtctattaggttactttaagcttccttaaatgtttgaaaaaaaaaatttacagtgagatttgtttatttatacacatctctgaagattcagatgcagagtttctagtagtaccttttattatttagctcgtgattaattttattatgaagcctgtagtcctagtgtagttggcttatctttgacctgtctaaggatgccagatacttatcacctaaccccaatgtcatgaaaagagaaaaaagtttatatgattatgcatattatattgtatgtaatttaagaatatctttaattttttagcctcttttttattctaaaagtccaaaagcccaacccagattttaaaccagctctgaatttgtccttactggcctatgggcttaacttcgaagtcctatattttttaagactggttgagctcaggcccacctgtgttctgcatcaagaagccgctatattatcattgatgtttattgctgctaatacttgttggttggcctgcaggcctcatccaaatgaatgctctggaggtgatctcgatggagatttgtttttcataagttgggacaaagatctaatcccatgtcaaactgaggctccaatggactacacaggaaggaggccccgtataatggaccataaagtgaccctagaggtaattttctacgaagttacaatttttttttaaagaaacattgataaatgaaaaactgcttcctcatttgttctttcctgggtgagcaggaaatccaacaattctttgttgattacatgatcaatgatactttgggtgctatctctactgctcatctagttcacgctgaccgtgaacaagataaggccaagagtagaaaatgtctggaattggcagagcttcattccatggctgtcgactttgcaaagactggagcacctgctgcaatgcctagagttctgaaaccaagagagtttccagatttcatggagagggttgacaagcctatgtacatctccaagggggtactgggaaaactttatcgcgccataattgagtcacaaatgcaaataagatatagctttgtgtggtcagagaagcatgctgaagaagcatatgaccgtagccttgaagtgaatggttttgaggccttccttgagacagcatcaactcacaaagaaatgtatgcagagaagatgagcagtttaatggacttctatggtgcagagaccgaggatgaaatgctacttggtaacttgcaaaaccgtgcttcatatttgcagcgtgataacaggagatatggtgatatgaaggatcggattctgctctcagtgaagaaccttcagcgtgaagctaaagaatggtttgaaactagttgcgaaccgcatgaatataagcctatggcatctgcatggtatcatgtgacctatcaccccagctattattgccgggaaagcccatgctttctaagctttccatggatagttggtgagattttgctgcaaataaggtctgtgagcaaaggagttcacaaatgaaggcttcctctaatgctgtgtgcatttttattttgaaaaaagaagaaaaaatctgaagccgtttgtggtggataacatgtatatgcagatgttgattgaaggtaccaccttgtctgcgagagtttccttttgcaaaatattattgttatcaatatttggcattataaaaatttactagccgtatatgtgatgttgatgccagtggcttcatctataaccaggttcagcgaatcaagtgggttgggttactccaaaaccgtttcaccaaaattccgggtttgtaggatctggttacaccctgttcgagtttattaaagtcaatttaaaacgagtat

SEQ ID NO: 204 - DNA, 7773 bp, Glycine max
aaaggcattctaaatataattgaaaaatttctggcacaaatttgcagccttctagtgactgaggattttcatttatagagctctctgtgtttacatttcaaagatgacagacaagaaattgaagtgttgacttgaagtgaatgaaaaacacacacaattgggcgcatgaatttgagccaaattattgcaaaattctgaagcacagtaaaatgaaccttgatttgcacccataaattggatcgtgtttaactttgatttggaaaagcacagcttggagcaggtggtatgggtacaatggaataagtgttgtttatcaagtcttaagcagtgggtggtaataggcggtgtgcggatttatcttatagttccacatcgaaggatactacaacagagaactaaattagcttctataacagaaaaaagctttggctctacaaagtattcttttttagtaaatttacagttaattatgttcatttatggttttaagttttttacagcttggctgattaaagctcttgaacaaaattaaaccctttattttaaaacgaacaaagcaaattatggtgtgaaataaacaattgcccttagactaactgaagaccttgtctaatctacacagttttcacccattatctccttatacatctctctattaactgctaaggagataatggggatgctaaggtaataaaattaactaatagtaccctttagtaactgctgaggtaataaaatttcaaaaccaaaacaaagtaaaagttaatggattaatattttattattaattctcaagttgtgcaatttttgtttaatgattaaatttaaagatttatattattattagcatcaattacttacatattttcatgagtgaaacacaaatgcattatggtttcaataatttacatttatttgtttctgtaataaaattaaccatattttaatatgttttcatacttaatataaatatctggacttcctctagtctttactataagtaattttttttacagtaataaaaaattagttattatcaattaattttataatcctatttaaaaaataactttccttcccaaattattttttattacaattatttatcaaaaataaaattaagtccaaatagaatttggattaaacaaaagatattttagaattttaagaaaacaattcaaatcaaactaaatcacgaattgtcttaaacttacatgataatgaagtttaatttagttggttaagaaaagatgcggaaattattataattttttgacactatcattgattttcatgaaaaaaaaatgaaattaagtcaattaaaatacattatgtgtggaactctattttattttaagagaaaaaatggttataataaaaagttttatagactcatgaaatcataattcatcgtgcatcataaataaatttatgttttaaataattattataaaataatttaaataataatttataaaaatattatctttgtttttttttttttagccctaacaatggtagcgaatagcgacactctcagtctcactgagtcacattatctttgtgtgtgtatcgtaaaatgtaaacttcgtggagaaggtatcgcaaactgaatcaatcagactagacttgacccgtcaacttgcaactctctcttcaatcgcaattccttcacttcccactctcatacaaagacccaggtacatcactttctattacccttttctaatgtatcaatcctttctcatcaaagggtattgcgagcgagactacgtgggagcatgattgctttcatgatttgatcacaacgctatcctgcgtttggtttcgttactgggtaagcttttcgcatttaatgccttctgcttcttctttgccccaagatttttttttcgacattggatttcgtacttggttgtgttttgaatcgtgggtattctaaaatgcttcgaagccattgttgtcaaatttctttcttaactcatatgctcttaggactttatgattctagttgtaaaaacgaatcaactcgctgttaactctttttttggataaactcaggtatactcgatgaattcgtgtaaattcgcatgaactctttagtcaagaaagtgagtcaatgagtttgaaatcaaatgattaatttctgttttgttatgagtttttttagtttccgttttgaaattatttcccgtaattaccttgatgttggactgttttttaaaaccttgcattcaaaattaattgtgtagacactcacccaaacacatacttaaagcctctgatttgtatttgttttgcagcgatcttaatctgaataatatttctgatttattatcatattcttcttgatttgtgtgtcaaattgtttcattcttccgctgcaccatgaactgatatgtgggaaatttgtctcatattttagtgaagccttggtggcctgttcttggtgcaatttgtttctgtatcattagttttcttagtgcatatattttgggagtaaggaaagagtggaaaaggggcagggtaggatatgttgtgtctgtctctgaagaagaaggttcttattgataggattctttgaaaaaaaaatcagtttgtgaaaatgctctcataatttcctaaatatacaaaaccatgctcagagttcaaatccatttctctatgtgcatctgtctctccctgtatcttgttctttctatactcattgaatttgctatttttgatgactgatttattgagttatgtttaaatatatttttgtaaccaaagttaatctagagctgatgatactttgagctagtcttctcttcatgctcataaaccccccactttgaatctccattagatgagtattttttttcctcaattctcaaatattgatttatgttggcaattccaaaaaggttaatctaacttgcaaatttgtgtggtttagaatttacatactactgagaacatggacttagaaggaagtgaaaaggattcagtggttactcagattagcattggcggatttggcagtgaggtcaaagcaagtgatctcgtgaattacttggaggataaaattggacttgtgtacaggtgtaggttgaagacttcttggacccctccagagtcatatccagaatttaatatcattgatactgcaaatattagaagaacggataactataagaaggtggagccccatgcctttgtgcattttgcatctccggaatctgtgactgcagccctgaatgcttcaggttgttgtgatctatttttgaagaatcaacccttaaaggtcagctgtgggcctgaaaatccatacttcctgaaccaaaggaggagaactacaactccttttaagatgtctgatgtacttgttgaaattgggactttggttagcccaggggagttttttgtttcttggagaggacctgataaaggtgtaaaatttcttgtggatccctttgatggcatgtgcaggttttgtttcagtagggatactgcattctcattcaaagggatagaaaaaaaagcagtgataaagtgtgattttcaggtgggattcctggttagagacattaatgagatcaagagatataatgatacatcatatctcgttgttttattgcacctagcttcttcaccttgggtttggtacagaactgccgatgatgacattgaagaatcagtaccatttgatttgctagatgatgatgatccttggattagaaccactgattttactcccagtggggcaattggtcgatgcaatttttatagaatttcaatcccacctcgccatggtgcaaaattgatgaaggccatgctttatctgaaaggtcaaagagtgcaaatgcaagaacttgcacttaaacagacacttaggacactgaatgaacctgattttggtgtgcccatgtcagatgctttcttctatatacattttcagaaggacattgcttttgacataatgtttttggtcaatgctattgtacataaaggcatattcaatcagcacaggttgtcggataggttttttgaattgctgaaaaatcaacctaaggagctcaatgtggctgccctgaagcatttatgttcttacaagcgcccagtatttgatgcaactaagaggctaaaaatagtccaagaatggttgctcagaaatcctaaactttatcagatctctaaacagttggatgatattgttgaggttagaagattggttattactccatcaaaagcctattgtataccgcctgaagttgaattgtccaacagggttctcagaaaattcagagaagtttcagattgtttcttgagagtcacctttatggatgaaggcatgcaaacaattaatgtgaatgctcttaactattatgttgctcctatagtgaaggaaatcacatcgaattctttctctcaaaggacaaaaatatataaaagggtcaagactatcttggaacagggattttacttttgtggccgaaaatattcatttttagccttttcatccaatcaacttagagatagatctgcttggttttttgctgaagacaaaataagatgtgatgatatacgaaattggatgggcaagtttaatcagaggaatgttgcaaaatgtgctgctaggatgggacaatgcttctcgtctacttatgcaacagttgaagttgctgcaaatgaagttaactccatgctacctgatgttgagaggaacaattacattttctctgatggtattggtgttatcactcatgatcttgcaagggaagttgcagaaaagttgaagttggacaatgtaccctctgcttaccagatcagatatgctggttttaaaggggttgtggcctcttggccggccaaaggggatggagtcagactttctttgaggcctagtatgaacaagtttcaatctactcataatatcttggagatctgtgcttggaccaggtttcagcctggttttcttaaccggcagattataacattgctttcagcactgggtgtgcctgatgaagtattttggcaaatgcaggaggcaatgcttttgaagttaaatcaaatgcttgtggatgcagatattgctttcgatgttcttaccaaatcatgtgctgagcatgggaatgctgcagcaataatgttaagttgtggcttcagtcccctaacagaacctcatcttagaggaatgctaacttctacacgtgctgcgcagctttggggacttagagaaaagtccaggatttttgtatcgtctgggagatggttgatgggtgtcttagatgagtcgggcgtgcttgaacaagggcagtgctttgttcaagtgtctactccttctcttgaaaattgtttctcaaagcatggttcaagattttcagagacaaagaacctgcatgtagttaaaggttttgtgattatagcaaaaaatccttgccttcatccaggagatgtaagagttttggaggcagttgatgcccccgatttacatcatttaaatgattgtcttgttttccctcaaaagggtgacagaccccatacaaatgaagcttctggaagtgaccttgacggggatttatattttgtcacatgggatgaaaatctcattccaccaagtaagaggagctggatacctatggagtatgcccctcaagaaagcaaacttaagacacgtcaagtgatgacccgagtatgtcccttttgaatttcattctatgaagttccatagttagctagctgtatgctttgtgctatacatgggaacattaaaatatgattgttgtttttcacatgaattattcatagcctcctgcatttgattggtaattcaaatgacatattcactacagggacttgcctatagtaaatagcttttcatatttgggaaatatttcatctgatctcaaacataaaatttcaagtatgctgtaattcggcagtcacattcaatcataaagatttaaggtatatgttgcaattgtgttctctttcacattgtcctctaagttgtcttgttgtacatttggagtgatttttcttgttgaatatgcattgcgaaaatgagtcaactatttaaagttgttcccatgtatgctttgtgctatacatgggaatatttacataggattgtttttttcacatgaattctcatagtctcaatgtgtcatgcatttgattgtaattcaaatgacatattcactacagggacttgcctatagtaataacatttcatacttgggcaatatttcatctgatctcaaacataaaagtttgtgagtatgctggaactaattctacacagtcacattcaatcatagatttgaggtatatgttgctagtgtgttctcttgcacatgtttacatgctctgcacattgtcctctaacttgtcttgttgtacatatggtgtgttttttcttaaaatgagtcagcaatttaaagttgttttgtcttccgcattgcaggacatcatagaattttttgtcagaaacatggtaaatgaacatttgggtgcaatctgcaatgcacatgtggtacatgccgattccagtgactacggtgccttggatgagaaatgcatacacttggccgagctagcagccactgctgttgattttccaaagaccgggaagcttgtcactatgcctcctcatctgaaaccaaaattgtaccctgatttcatggggaaagagcggcaccagtcttacaggtcgaagaaaatcctgggtagactttaccggcgtatcaaagatgcttatgatgaagatattgatgctccctatttgaactttgtgactggcgatataccgtatgataaagatcttgaagttccaggatctgctgattttattgctgatgcgtgggagcaaaaatgctcatatgatggccaattgagtgggctacttggacaatacaaagtgaaaagagaagaggaagttgttactggacagatttggtctatgccaaaatacaacagtaggaagcaaggggagcttaaagagaggctgaagcactcttacagtgccctgaaaaaagaatttaggcacacttttgagaaattgaattcagatgttggagaattaagcgaggaagaaaaaaatttgttctatgagcagaaagcttcggcctggtatcaggtgacatatcatcctgagtgggtgaaaaaatcccttgatctgcaagataaatcctcagagaaccaagaggctgatagtttgggaagtacggtgatgttgagttttccttggattgcagttgattacctagctcgcacaaagataaggcaacgacatcagagatgtggaaattttgactcaactaagccagttgattctctggcaaagtatctatctgaaaggttataataattctattgagcttgctcttggctactaggccactctgccatcctataatattacgtataatgtgtcttcactttagctgcttcgattgtaactaggtttgttcccaagccaggaaatgcctctggttttgaggcttaagactgtatctagtctagttacatttgatactgtttgaccgttttgttatagtagtcttgtgcatgcggttatatgtatgtgattgtgattaaattatgtttcttgagctttctaaacatagtttgaacaatggtgaagctatcattgaaatctttgtgtgcagcattcataagtattttaaacaatagtgaagttattattgagatctttggcttataggcacagttaaagctcttgggaattaaatgtcttggcgaagtacatatgtgtcaactaataagaag

SEQ ID NO: 205 - DNA, 7773 bp, Glycine max; identical to SEQ ID NO: 204

SEQ ID NO: 206 - DNA, 7540 bp, Glycine max
  misc_feature (1258)..(1357): n is a, c, g, or t
tgtctatcaagtcttaagcagtgggtggtaataggcggtgtggggatttatgttatagtcccacatcgaacgatattacaaaggagctaaattagcttctataagaggaaaaagctttggctcttaaaagtcatgatccttcaggcagttaatgggatatgaggagtggtaaaaatctcgcacgaaatatgcgagtggggtgtccgccccagcctggttacgacaactgggcactctcccttgaaccaatctgatccctaacctgaagtacgattatttttagtaactaaaatctataaacaacaaactataaaaacttttgttgtttataaaaatgggtaaaaacaatttaaaaattatataacaaagcaaatcagtccacccctttcttgtttccagaatgcattttaaaatggaaattgaaaactgacaaccatttgctccttgatgggttgtttgagaaaaaatagagctgaaattatttttatacttatttttaagtttttttttgtgaattttgtttttagtttaaaaaagaatacatatttgctatgatcactatattgttatcaacttctgttattagcacctatcactgtgctatatacattatcatcattattattgcgttacaatcacccaaaatatttttaaactaattttaatataatatgaatctaattatattttaaaaattaatttgaaattttattgaaactaaaattaaaaactaattgttatttttaaaaatttcaaaactcaaagaaaaaatcatccaaaagaagacctatggttcaatattttgttttagagtagtttagtttataggaaagaaaaataacgaattttaccacatgaattatttaaaattataaaattatgaataagacattaaataagaacttcatgtggataaattttaatttctattaaacgaaaaatattttagagataacatcattaatataataaaattagttaaagtttacttatatttaaaattaaaatatataaaaagaaatgttattttattttagatttgtgtggataaattttaatttcaattagacgaaaagtattttagagataatattattaatataataaaattagttaaagtttacttatatttaaaattaaaatatataaaaaaatgttaccttatttagaccaaaatagtataattttactttttaaacatgtcatcataaatttaaatttttgattcgtatgtatgaaaagtatctattaaagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaacctacatgcgattttttttttttgaacccaaagataatgactaatttatcgaaataggaagattatttaaggaacgaaaatctgccaacagatatttttcgtacacacatgaaacaaatgatttaaaactgtttaatttttgttttccagccctaacaaatgaaaatggcgaaactgattacagagcgacttgatagcaaatagcgacaagacaaaggacacgcacactcattcactcagtcacactatctttgtgtattgtaaaatgtaaacttcgtggagaaggcatcgcaaaccgaatcaatcagacttgacttgactcgtcatgctgcaactctctctcactttatcttccactcttcaatcgcaattcctccacactctcatacacagctacatcactttctattactcttttctaattcttatatgcttataatgtaatgtgaaccttaagttttcaaccatttcttatcaaagggtattgcgagcgagactctgcggttgctgatactttcatgatttgatcacaacgctatcctgcgtttttagtttggttactgggtaagcttttcgcatttagtgggttctgcttcttcttcttttgccccaagatttttatttttcgacattggatttagtacttggttgtgttttggatcgtgggtattctaaaatgcttggaagccattgttgtcaaatttttgagttaactcgtacgctctctggactttatgattctaggtagtaaaaacgaattaactagctgtttaactccttttttttttgggatgaactcaggtaaactcgataaactcgtgtaaattcgcatgaactcttgagtcaagaaagtgagtcaaccagtttgaaatcaaatgataaatttctgttttgttaggagtttttatttatttttggtttccgttttgaaattagttctcgtagtttccttgttcttatgaattctacttaaattccagccgcagtgactccaaaaaccttgatgttggactgttttttaaaaccttgcattcaaaaagtgtagacgctcacccaaacacatacttaaagcctctgatttgtatttgttttgcagcaatcttaatctgaataatatttctctgatttattatcatattcttcttgatttgtgtgtcaaattgtttcattcttcggctgctccataaattgatatgtgggaaatttgtctcatgttttagtgaagccttggggtctgttcttggtgcattttgtttctgtatcgttagttttcttagtgcacatatttttggagcaacgaaaaaatgaaggggcagggtaggatatgttctgtctgtctctgaagaagaaggttcttattgatagaattctttgaaaaaaaacaattagtttgtggaaattctctcataatttactaaatataaaaaccatgctcagagttcaaatctgtctctctatgtgcagctgtctctccctgtatctcgttctttctatactcattgaatttgctgtttttgatgactgatttattgagttatctttaattatatttttgtaaccaaagttaatctagagctgatgataccttgggctagctttctctttatgctcataaaccccccactctgaatcttcattagatgggtatttttttggctaatattgaaggcttccctttcccacactgtactttattttttttctctattctcaaatattgatttatgttgtcaatttcaaaaggttaatgttgcaaatttgtgtggtttagaatttacagactactaagaacatggacttagaaggaagtgaaaagggttcagtggttactcagattagcattggtggatttggcagtgaggtcaaagcaagtgatctcctgaattacttggaggataaaattggacttgtgtacaggtgtaggttgaagacttcttggacccctccagagtcatatccagaatttaaaatcattgatactgcaaagattagaagaacggaagactacaagaaggtggagccccatgcctttgtgcattttgcatctccggaatctgtgactgcagccctgaatgcttcaggttgttgtgatctatttttgaagaatcaaccgttaaaggtcagctgtgggcccaaaaatccatacttcctgaaccaaaggaggagaactacaactccttttaagatgtctgatgtacttgttgaaattgggactttggttagtccaggggagtttttcgtttcttggagaggacctgataaaggtgtaaaatttcttgtggatccctttgatggcatgtgcaggttttgtttcagtagagatactgcattctcattcaaagggatagacaaaaaagcagttataaagtgtgattttcaggtgggattcctggttagagacattaatgagatcaggagatataatgatacatcatatctcgttgttttattacacctagcttcttcgccttgggtttggtacagaactgccgatgatgacattgaagaatcagtaccatttgatttgctggatgatgatgatccttggatcagaaccactgattttactcctagtggggcaattggtcgatgcaatttttatagaatttcaatcccacctcgccatggtgcgaaattgatgaaggccatgctttatctaaaaggtcaaagagtgcaaatacaagaacttccactcaaacagacacttaggacacagaatgaacctgattttggcatgccaatgtcagatgctttcttctatgtacattttcagaaggacattgcttttgacataatgtttttggtcaatgctattgtacataaaggcatattcaatcagcacaggttgtcggataggttttttgaattgctgagaaatcaacctaaggagcttaatgtggctgccctgaagcatttatgttcgtacaagcgcccagtatttgatgcaactaagaggctaaaaatagtccaagaatggttgctcagaaatccaaaactgtatcagatctctaaacagttggatgatattgttgaggttagaagattggttgttactccatcaaaagcctattgtataccacctgaagttgaattgtccaacagggttctcagaaaattcagagaagtttcagattgtttcttgagagtcacctttatggatgaaggcatgcagacaattaatgtgaatgctcttaactattatgttgctcctatagtgaaggaaatcacatcaaactctttctctcaaaagacaaaaatatataaaagggtgaaaactatcttggaagagggattttacttttgtggccgaaaatattcatttttagccttttcatccaatcaacttagagatagatctgcttggttttttgctgaggacaaaataagatgtgatgatatacgaaattggatgggcaagtttaatcagaggaatgttgcaaaatgtgctgctaggatgggacaatgcttctcatctacttatgcaacagttgaagttgctgcaaatgaagttaactccatgctacccgatgttgagaggaacaattacattttctctgatggtattggtgttatcactcatgatcttgcaagggaagttgcagaaaagttgaaattggacaatgtaccctctgcttaccagatcagatatgctggttttaaaggggtcgtggcctcttggccggctaaaggggatggggtcagactttctttgaggcctagtatgaacaagtttcaatctactcataatatcttggagatctgtgcgtggaccaggtttcagcctggttttcttaatcggcagattataacattgctttcggcactgggtgtgcctgatgaaatattttggcaaatgcaggaggcaatgcttttgaagttaaatcaaatgcttgtggatgcagatatcgcttttgatgttctgaccaaatcatgtgctgagcatgggaatgctgcagcaataatgttaagttgtggcttcagtcccctaacagaacctcatcttagaggtatgttaacttctacacgtgctgcgcagctttggggacttagagaaaagtccaggatttttgtatcatctgggcgatggttgatgggtgtcttagatgagttgggtgtgcttgaacaagggcagtgctttgttcaagtgtctacaccttctcttgaaaattgtttctcaaagcatgggtcaagattttcagagacaaagaacctgcatgtagttaaaggttttgtggttatagccaaaaatccttgccttcatccaggagatgtaagagttttggaggcagttgatgcccccgatttacatcatttaaacgattgtcttgttttccctcaaaagggtgacagaccccatacaaatgaagcttctggaagtgaccttgatggggatctatattttgtcacatgggatgaaaatctcattccaccaagtaagaggagctggatacctatggagtatgcccctcaagaaagcaaacttctgacacgtcaagtgatgacccgagtatgtgctttttgaatttcattctatgaagttccatagttagctagctgtgtgctttgtgctatacatgggaacattaaaatatgattgttgtttttcacatgaattattcatagcctcatgcatttgattagtaattcaaatgacatattcactacagggacttgtgtatagtaataacatttcatatttgggaaatatttcatctgatctctaacataaaattttgagtgtgctggaactaattctacagtcacattcaatcatagggacttgcacattgtcctctaatttgtcttgttgtacatatggtgtgatttttcttgttgactatatattgcgaaaatgagtcagcaatttaaagttgttttgtcttccacactgcaggacatcatagaattttttgtcagaaacatggtaaatgaacatttgggtgcaatctgcaatgcacatgtggtacatgctgattccagtgactatggtgccttggatgaaaaatgcatacacttggccgagctagcagccactgctgtcgattttccaaagaccgggaagcttgtcactatgcctcctcatctgaagccaaaattgtaccctgatttcatggggaaagagcggcaccagtcttacaggtcaaataaaatcctgggtagactttaccggcatatcaaagatgcttatgatgaagatattgaagctccgtatttgaactttgtgactggcgatataccatatgataaagatcttgaggttccaggatctgctgattttattgctgatgcgtgggagcaaaaatgctcatatgatggccagttgagtgggctaattggtcaatacaaagtgaaaagagaagaggaagttgttactggacagatttggtccatgccaaaatacaacagtaggaagcaaggggagcttaaggagaggctgaagcactcttacagtgccctgaaaaaagaatttagatacactttcgagaagttgaattcggatgttggagaattaagcgaggaagaaaaaaatttgttgtatgagcagaaagcttcggcctggtatcaagtgacatatcatcctgaatgggtgaaaaaatcccttgatctgcaagataaatcctcagagaaccaagaggctgatagtttgggaagtacggtgatgttgagttttccttggattgcagttgattacctagctcgcacaaagataaggcaacgacatcagaggagtggaaattttgactcaactaagccagttgattatctggcaaagtatctatctgaaaggttataattccattgagagcttgctcttggctacaaggccactctgccattctataatattacagtgaacctgtgttgtatacgccttataatgtgtcttcactttagctgctttgattgtaactaggtttgttcccaagccagggaattcctttgcctttggggcttaagactgtatctagtctagttacatttgatacattgaccgtatgttatagtagtagtcttgttgtgctgcggttatttgtatatgattgtgattgtgattagattatgtttttttgagctttctaagcatactttgaacaaaggtgaaactattgttgagatctttgtgtgcagcattcataagttatttcaaacaatagtgaagttattattgagatcttcg

SEQ ID NO: 207 - DNA, 7540 bp, Glycine max; identical to SEQ ID NO: 206
  misc_feature (1258)..(1357): n is a, c, g, or t

SEQ ID NO: 208 - DNA, 9761 bp, Glycine max
agtatcataaatatatagttgtgcaaacttgggtgagttattgggcatatgtaggaggcttccaataagatgatgtctttgaccatgtatgcggaatgtaggaagacctctgccactactatatcttgtgtcaacttttgtaccaggtaatgtgaatgaaaacattagattatatgaacgaacgttggccgggaagttcttagattttgtactgttgttgtcaaaaagtagttgtctcattggttgtagaggatcttttagtagagaaagctgtattttgccatcgccacaacataatgcaaatcttgggtttttggactgcttgtctttatcaatcctttcatcataccacatcatagcttttacagtggatgcatttccaaactggatctctaatatcattgtaagttgcacctaaagatgaattaggaagtttagatgctccacacgtccaatagaaatggaaacacaggaaaaagtaagttggaattttaaggtcaatattggtatttttataatcatacgatgtatgatcattgcaatcatggtcactatcagcatcatcatttgttgttgttgggctatcaaatgaatattctacaatgcaagaatttgtgaaagttaaaatgtaagttatcagtttgacattacataattatagtcgacaaccatgtattcattttctatgtaataacaataaccacacattacctgcatcaatgtctgtttgatttatattgatttccttatcactatcatatgaaatctgagctattagtattgatttgtgtattgtatatttcctaggatgcatatgttgaaatgtactacctgaagtaattggagcagcaactatgagtgtatttgatgtagaagttgatagcggattcaaatttgatgaaattaatttttttttcctaaacttgtacaatagatttgtttggattgtagaagcctcaatgctatgtacattggcaatgtgtctcggacgaattcatgaggttttatgcaacatcttttaacataataaaaatgttttagtaattataatatatatacatatatatttagaaaaaataatttaaccaaacacatatttcaattgagaatataaaaaatatttctaaccattttaatagttaatcaaacatattttttaataacacccgacaaaaatatactccgaagactacaaaaattgtccgtgaaacaaatatcaccattgagttttgccgaaaatgcaattcttaaattgaaagcaaatatataaacattaatgatagactaattaaagggagatactaacaaatgcaagcaacgctttttcttgtttcctctccgcactctccttcgtctcgaagtttacccgtacgtgccatatgcccatattcacatttcttttatatatatatatatatatatatatatatatatatatatatatatatatatatttatttatttattttatttttttttctgttctctgtactgaataaatcacatttcattaaaatttcaagtccaccttggtcttccagctctaacgttactttgtcccgcatacttcacgcctctgctgttaccacactcactcactactactactcgctctccccacgctacactggttgcgcgtgagtctcaatcgccgcattctcttcgcgcgatctttctacgatcactggtgattccttcctttctttctctccgattttctcactttttttctttttgaaccgtacgatgtcgttttgtcttctataatgtcttgtttgttgcctgcattggttcttgcttcttggttgggaaagctcgttttgcatgtttcccttccatgtaaagatgatgaatatattaaaactaaacaaacaataattaataattaagaaagaaagaataaaatcggtttgtatctaacgaaggttttcggcttgttttcacgtttaactgcattttctatttctggttgaatatgatggagcatagtgagaattaagccaagactctcagcagtagttaagctattctaagttttagatttttttttggggtttcaaaccgtcagtaatattttacggcgaatcttccctgaacgctatgaattttcatatttaatcttggctgtgtgttggtgttttttttttttttttttttaagattggatttatggttttttttttttgccgtatcttcttcaagcttccaaaagaatttgaaatcgatggatttttatggagggattctgttgctgttgtttatctctaatttgtaatattacaataacacaataacaaaacctcgtggcttctactatctctgtggcttattatatatttattctaaaattctctcatttaatagtatcttttataggagtaattgtttgtttgaaaatagcaattaaatagggatatatgtagaaagaaaatagttaatgagacttggaatttgtaaaacatcagtgttttttggatcagagggagtataatctagctgcgtttcaatttcaatgtgctcacttaatattctaagcaaaataaaagtgtggcctgagtgcatttgcaaatgtgtcttttctggggtccttttgtgagagaaccatgctgttaaatgttaatttcaatacatgtaaaagctttactgtgttatgattttgtggaatcaccttttccctccctttttgtaatgatgtgaaatgttgtgttatgattatggcaatcttcatttatctggagctttggctgttgtgtgttatgtaccgtaattgtaagtgcttccccttgcatttgattcttgtaaaaccattatcctatcagtgttggtgttttgtggtattacattgagatccctcctctcatgtgtattgcgtctggatttaattcatgtaaaagcataatctgctcatgtgcatgtccattgtggtgatcttttttttagtattacattgtgattcctctttgtagtaatacagtgagattactcccttcaagtgcattgcccctgcatttgattcatagtagtcaatactgcaccattgcaccagtataatgatgacatgttccagcacagccccctgcaatgtctgtgtggcctgtagtggagcagtttagtgttgctcttattgtggcgtgaatcatgtctgcttttgtgtagaatcatggccaccctgtatcttatttttgcatgtacaaaaccccatttgtttggccctctaacagtgtcgtttggggttgcttctgtgtggtttgcagtggagcattacagtgtcatggactcatggttattgcgtcacgaattatggcaaccctacttgttattctttccctgtgcaaaaccctgtttgtttggccactcgaaaatgtcatttgatgctgtttctgcatggcctgtattggagcagttcagtgttgctgttattgcagtgcaacttgtggccacttttgcatagacctgtggccatcctagctgttattctttccatgtagaaaactctgtttgtttggtctctcaaaatgtcatttgatgctatttctgtggcctgtagtgcagctgctcagtgttgtggttattgcggcgcaaattgtggcatttccagctgttattctttccatgtacaaaaaactgtttggttggctcctctaacggcgccgtttggtgtcataaggctactataccatgcgaaaccggccacaatctgcctccaaaaaaaacctgtttgttttgttaggaagtcccacattgcttgcctcaattcttggggtgcagcttatatatttgttgggcaacttcccttagaaccaattggttttaagctaaatctaacatgtttggcccctctaacgatgtcatttagtgtcataaggtggggcagtcttgggatttttcatccttaaaagacagaccctacttctcttcgctatttgattcaaatcatctgacccggagctctcagctgcgcttctggccaatctgtggcactccagttgagtttcctgccaaccctcaatctgaatttttggcacactgttctgtggtctctattctgttcacatcctttggtctacattctattttgtgtgcgtgtgtatcaattttgtcaagatcctgagtaaaaccatgatcttgcatgatttcacgatcttgctccttgcatctgagttggatcttgaagcggttggatcggagtaagatcgtagtcaaatcggattgaattcataatattggttggtttttcttatcttctgagctggatttttggcacactgttctgtggtctctattccaatcacatcctttggtctatgttctattctgtgtgcatgtgtatcaattttgtcaagatcctgagtaaaatcgtgatcttgcacgatttcacgatcttgctcccagcttccgagttggatcgtgaagcggtgggatcggagtaagatcatagtcagatcggattgaattcgtagtattggttggtttcacttatcttctgagctagattttgagacaggttgcatgcctcaagtttattttaaccaactctattggtgccctaaattgatactttctgtttctcccccattttcagacctagacaagcactacccagcttttctgtctctcccttttcgattctcactatctctcggcttatcccttttgtctcctcagtcttgactcgaccctctctctactatgattgtttaatgctgtgcgcctgtggtgtgtgttatacttgaccctctctctctctggtctgctgtgatcatgactgagtgtctgttttgcactcctgttctcaccgaacatgacacctttgactctaaactttattttgtttacagccatgacctttctcagtattatttctatttctctttttcttttccctaaaactcatgagttgggtgattttggcctttattcgagatatcttctctactgtgtcttctattatattctatggttttatggtatatttacttcttttatgttttccataaattattacaaaatacagaagataatgaaatattttttccataaattattacaataggtataaaataaatttaattttttaaatggattttagtgatattattatatgttttagctaattatactatcatttataaatttgtggcattaaaatatatttttatatttttggtaggttcttctcatccttgttacaatcctgtgtttataattttgcaactctctggctgatcttaagtaggatatcgatcttgacaacattggtgtctatgtattgttttctctttctttcactgtcgtgcttagataggtaaccttatgttgctttagtttattttttcttttacattacatgactcttattattaacttctatatttggcttaaaagtatgacttgattattaattatgaatatgtctctaactatggctatttttttatttgagcatatatatgtgtgtgtgtgtagcataaaattaaattctataaatttcatagtagtggtcaactggtcatcctggtatccgctatcctgctatagcagttttgtagttggccattctgtgctgctatcctccatcctttcatgcacattgtgttggtctttttgtagttttacattgggatcctccatgtgcattgcccccgcatttgattcatgtactagcattatcctttttgcacgcattgcattggtctttttgttttattacattgagattcctcccttcatgtgcactgcaccctgcataagcattgtcctttcacacatattgcattggttcttttgtagtattacattgagattcctcccttcagttatattctatttattgtgtgcctcctttccatgttgagttcataatgaagtgttgattatgttctttatttgagattctaagaatgtaatattttactgaatgaattttttacaatgctttgatttgcttgtgtttttagctgtaggtggattaagatttctctttcttaagtttataagtttattgtagttgacaaatgaactgattttctcttttcaagttccttcagttttatgattctctatgcacctttacctcttgcatctattatgcgtaatgcaaaaaaatattgatccagaacagagcatatacaaatgagttcgaaaagagggggtgggagacctgtaaccgtggctaacaatgatatgtccaaagggaaaagcatatctgaagctcatccaaaagttgagcagttgactcagggtatcgctgacactaagctaaactcaggacaagatgatggtgagtgggaggtatatgcaaggaaatccaagaacaaggctggaagcagtgctgcaaaaccatgggcccccccagcccataattctaatcctagggcatgggggaatgcagaaatggctcaaaagccaggcatccggggtcatggtggacttggaagatcttcgggaaatccctggcagacacaaaatgctaactttaggagaccagctggcagaggaaatggaaggcctcagttagcaacaagtggatatgaaagcaactatgttccaaatcctgcaattcggcctccacttgagcatggctggaactggcaatccagacctggtgcattgcagtccaatgcaagggatgaaatttcaccagaggaccttcaaaagaatgatgatgttgatgacgatgatggggaggaggactctgatgcttttgaagataccgatgatgatctgatgagtgatgactatgattcagatgctagtcaaaagagtcatgagacacgtaagaaaatcaaatggtttaagaagttttttgagattttggatggcttgactgttgaacagataaatgaaccagaaagacagtggcattgtccagcttgccaaggtggtcctggagctattgattggtacagaggactgcagcccttggtgacacatgccaaaacaaagggatctaaaagggtgaagattcacagggagcttgctatacttttggatgaggaattacgcagaaggggtacttcagtaattccagctggggaagtatttggaaaatggaaaggtttgaaagaagaagaaaaagaccatgacatagtttggcccccaatggttgtcattcagaatacaaagcttgaacaggatgaaaatgataaggtatatattattggtgtcaaatgatgaataactagtagtgtcatatttgatattttgtttgcttgtatttatggagcataacattcacaatttgcgaataacatcactggtttttgtgttaactttggattttgttctttgtattcagtggataggtatgggtaaccaagaacttcttgattattttagcacatatgatgctgtgagagcacgacactcttatggcccacagggtcatcgtgggatgagtgttttgatatttgaagcctcagctagtggctatctagaggcagagcgtctccacaagcattttgcagagcaaggaactgataaagattcttggttcagtcgccctattttatatctccctggggggaatcgccagctctatggatacatggctacaaaagaagatatggactttttcaacagacattcccaaggtttcatttcctctttcttggttacttttcttcatatttgcattatgcagatggtttgatgtctacctacaggttaatttatggagacaaagtataagctgacatttttttttggcctcctgatgaaattatgtaggtaaatctagactcaaatatgacataagatcatatcaggagatggttgtacaccaaattcggcaaatgaatgaagacaaccaacagctgctctattttaagaacaaggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagaggtaatactaacatcagacagacttcatggctattaattttattgaaaagtggttactttgttgtggaatgtactttagtatattatttctaatgccactgagttgtggttaggatatgcttctgcttgattgctttgttgaaaagttttagctataatttatatttttgtagtacaagagtggataatctaaagttattgtcacatcttttatcttcttgtatgagatgttttgcatataaaaatgtgattcatgtacataccattgaacttcagtttgatgtgtcaaattagactagcactgaatatgagatacagttgcatattgttactcttttatatcttttcccttttcattaaaagtaaaagaaatcaatgagcgatgatagattgatagggttgcactggcctagactgcattaggctatttatctagatgggttgttttttaatgccttgaaagaaaggcacaaaatattgttaagatttggatctagattgattatttttgttttgttgtggaggtctgatgcataccattaacccagttttccagaacaacttccatttatttataaattgaatgaacaaaattgttattttgttaattttcccttctggaggtcatgatattatttttttcatagttttgttttctcactaatgtatcctgtcaatcatgaaagatgtatatgcaagaacaattcttcaaggaccagatcaaaatcattcatgattcaagggatgcaaaggaagaagatttcgagaggatgcaacaggaggaacgtgagaaggtgaagcagtcaagtactactggtcatgtgaatgctgaggaatatagactcaagtatgtaattgtcattccttccattggactattggtatattcacatctgaagccaatttaatctaaataaattttgcgaaattattatgtaggttattttaagttgaattgttgaaggacattttcttcttaaaaaactaatttcacgtgactctagaaagctaggttaattttttaaagagtaagaattatgtacatgtgcagaaaaattattgcctgttttgtgtgtgtacaataatggctgaggtttgaacttataactttgtgcaaactattcaaacccctggccgaccgtagtaggttaaaaaattattatctagttatttggatagtggtaattatatttttcaattgcttttgagtgaatttgacttctctggatgtagggtggaagagtatctgaaatttgttgaggtccaagataaagaaatggagaactttgttgctgaaaaggagaagctgttacatgctcatggcacgggttatgctgcaatgaagcggaggcattgggaggaagaagttcagtatgagcagaagtttgatgaggaattggctaacctcatggaaaagtactccccgtcgtagaagtccaatggtatctaatggtagggtcttttgcacagactcatacaaacagataaacacagccaaataggtagagaaaataaatagagacatcagctttctagagattgagacttttactaaattcagtatgtcattttcttttctttagtacttgttggcatttggtacattcttggatatagaaacctggttaaaattttaaatggtggtgcatgcggttcgaattgaatgacaaattttacaaattggacgttgccatgccctgatgaatgatttatgcattatgagtttgaatatcttgagccaggggattttactgtttcaatatgtttgaaagttccgttaagaatcaac

SEQ ID NO: 209 - DNA, 9761 bp, Glycine max; identical to SEQ ID NO: 208

SEQ ID NO: 210 - DNA, 7794 bp, Glycine max
atgatgaatatattaaaactataaaataaaaaattaataaagaaagaataaaataggttcgtatctaacgaagattttcggcttgttttcacgtttaactgcattttctatttttggttgaatgttatgaagaagagtgaaaagaaagaaagacaaggctcacagcaatagttgggtcttccaaaaggattaaactgttttttggggtttgaataaactcataatattttacggtgaatcttccctgaacgctatgagttttcatatagaatcctggctgtgtgttggtgtttttttttttttttttaagattggatttatgtttttttttaccctatcttcttcaagcttccaaaagaatttaaaatggatgggtttttaaggagggattctgttgctgtcgtttatctctgtttgtaatattagaataacacaataacaaaaccttctgccttctactactacctctgttacctaaactgttgatgtttaaagtcagtacacacagcttaaggaatagttaatactacctataataaattattactatttagtctaaaattctctcatttaatatcttttataggagtaattgtttgtttgaaaataacaattattaaataggggtatatgtagaaaaaaatagttaatgagacttgaaatttgtaaaacatcaatagttttggacttgaggaagtatcatctaagctgcgtttcaatctcaatgtgcgcacttaatattcaaagcaaaataaaaagtgtagcctgagtgcatttgcaaatgtgtcttttcttgggtcctgctatgagagaagcatgctgctaaatgttaatttcaatatctgtaaaagctttactgtgttatgattttatcgaatcacctttaccctccctttttgtaatgatgtgaaatgtttataagatggcaatcttcatttatctggagttttggctgttgtgtgtcttgtaccataactataagtgcttccccttgcatttggttcatgtaaaaccattatcctttcatgcacgttgtgttggtgttttgtggtattacattgagattcctcccttcatttgttttgtgcctgcatttgattcatgtaaaaggatcatctgttcatgtgcatgtccattgtggtgatctttttacagtattacattgtgattcttctttgtagtaatacaatgagattactcccttcaagtgcattgcccctgcatttggttcatagtagtcaatactgcaactttgcaccagtataatgatgatgtgttccagcacagccccctgccatgtctgtgtggcatgtagtggagcagttaagtgttgtgcttattgtgaggtgaatcgtgtctgcctgtgtagaatcatggcaatcctatatgttattttttccatgcataaaaccccatttgtttgacccctcaaacaatgtcatctggggctgcttctgtgtggcttgcagtggagcattacagtgtcatggattcatggttattgcatcacggattgtggccaccctacttgttattctttccttgtgcaaaaccctgtttgtttggccactcaaaaatgtcatttgatgctgtttctgtgtggcctgtattggagtagttcagtgttgctgtaattgcagtgcaacttgtggctgcttttgcatagacctgtggccatcctagctgttgttctctccatatacaaatccctgtttgttttgcccctcaaaatgtcatttggtgctgtttctgtgtggcctgtagtggagcagttcagtgttgtggttattgtggcacgaattgtggtctctttcgcatggaattgtggcatttccggctgttattctttccatatacaaaaacctatttgtttggctcctccaacgacgtcgtttggtgtcataaggctacaattccatgtgaaacggccacaatctgcctcaggaaaaaacccgtttgtttggcccctctaacgatgtcgtttagtgtcataaggtgggcagtcttgggattttttgcccttaaaagaaaaccctacttctctttgctatttgatgcaaatcatctgaccctgagctctcagctgcgcttctggccaatctgtggcactccagttgagtttccggccaaccctcaatctgaaattttggcaaactgttctgtggtctctattctgatcacatcctttggggcctgtactcttgacatcaaagaggggcccatgttctgttatgtgtgtgtatcaatgttgtaaagatcccgagtaaaatcgtgatcttgcatgatttcatgatcttgtaccctgcttccaagctgaattgcgggtaaaatcgtgaacttgcatgatttcacaattttgctccctgcctctgagttggattgtgagcaaaattgtgaaacggtgggatcggtttatgatcatagtcacagattggattgaaatcgtaatatcggttgatttttcttatcttctgagctggattttctgagacaggttgaatgcctcaaatttattttaacccactctattggtgccctaaattgatactttctgtttctcccccattttcagacctagacaagcactacccagcttttctctctcttttctattctctctatctcttggcttatcccttttgtctcctcagtcttgactcgaccctctctctgctatgattgtttgctgctgtgtgcctgtgtgcgttatacttgaccctctctctctggtctgctgtgatcgtgactgagtgctctgttttgcactcctgttctcactgaacagtgacacctgtgacactaaactttattttttatgcagccatgacctttctcagtattatttctttttcttttcttttccctaaaactcatgggttgggtgattttagcctttattcaagatatcttctctactgtgtcttttattatattctttggttttatgttatattcacttcttttattttttccacaaattattataaaatacagaacagaatgaaatattaattatacttatacagtatttataacttataaaataataggtatataaatatttaattttttaaatggattttactgatattattatatgtattatctaattatatttatcaaatttttgcattaaagtatatttttatatttttggtagattgttatgatccttgttaggatcccatgttcatgattttgcaaccctctgcccgatcttaagtaggatatatcgatcttgacaacattggtgtctatgtattgttgtctctttctttcactgttgtgcttagataggtaaccttatgttgctctttgttgctttactttattttttcttttgtattacttgactcttactattaacttctgtatttggcctaaaattatgacttaattattaattatgaatatgtctctaattatggctattttatttatttatttgagcatatatatatatatatatgtatatgcatatatatgtatatgtagcaaaaattctataaatttcatagtaatgatcaactggtcatcctggtatccacaatcctgctgtagcagttttggggttggccattctggctgctattctccatcctttcatgtgcattgtatcggtctcgtttcatgcacattgtgttggtctttttgtagttttacattgggatccctaccctccatgtgcattgcccctgcatttgattcatgtacaaccttttgcacacgttgcattggtcttttcgtattattacattgagatttctcccttcatgtgcactggcccctgcatttttcatgtacaagcagtatcctttcacacatattgcattggttcttttgtattattacattgagacttctcccttcagttatattctatttattgtatgcctcctttccatgttgacttcatagtgaagtgttgatttctttatttgagattctgagaacgtaatatttcagtgaatgaatttcttacaatgctttgacttgattgtgtctttagctgtatgtagattaagatttctctttcttaggtttattagtttattgtagttgacaaatgaactgattttctgttttcaagttccttcagttttattattctctatgcactttacctcccatctattatgcgtaacacaaaaatattgatgcagaacagagcatataaaaatgagtttgaaaagaggaggtgggagacctgtaactgtggctaacaatgatatgtccaaagggaaaagcatatctgaacctcagccaaaagttgagcagttgactcagggtattgctgatactaagctaaactcagaacaagatgatggtgagtgggaggtatatgcaaggaaatccaagaacaaggctggaagcagtgctgcaaaaccatggggccccccggtccataattctaatcctagggcatgggggaatgctgaaatggttcaaaagccaggcatccggagtcatggtggagttggaagatcttctggaaatccctggcagacaccaaatgctaactttaggagaccagctggcagaggaaatggaaggcctcaattaggaacaagtggatatgaaagcaactatgtgactccaaatcctgtaattcggcctccactcgagcatggctggaactggcaatccagacctggtgcaatgcagtccaatgtaagggatgaaatttcaccagaggaccttcaaaagaattatggtgttgatgatgatggggaggaggaggaatctgatgatttggaagatactgatgatgatctgatgagtgatgacgatgattctgatgctagtcaaaagagtcatgagacacgtaagaaaagcaaatggtataagaagttctttgagattttggatggcttgactgttgaacagataaacgaaccagaaagacagtggcattgtccagcttgccaaggtggtcctggagctattgattggtacagaggactgcagcccttggtgacacatgccaaaacaaagggatcaaaaagggtgaagattcacagggagcttgctatacttttggatgaggaattacgcagaaggggtacttcagtaattccagctggggaagtatttggaaagtggaaaggtttgaaagaagaagaaaaggaccatgagatagtttggcctccaatggttgtcattcagaatacaaagcttgaacaggatgaaaatgataaggtatagctatattttattggtgtcatatttgatattttgtttgcttgtatttatggagcataacattcacaattttttaataacattactggtttttatgtttactttggattttgttctttgtattcagtggataggtatgggtaaccaagaacttcttgattattttagcacatatgctgctgcaaaagcacggcactcttatggcccacagggtcatcgtgggatgagtgttttgatatttgaagcctcagctagtggctatctagaggcagagcgtctccacaagcattttgcagagcaaggaactgataaagatgcttggttcaatcgccctattttatatctacctggggggaatcgccagctctatggatacatggctacaaaagaagatctggactttttcaacaggcattcccaaggttccatttcctctttcttggttacttttattcatatttgcattatgcagattgtttgatgtctacccggtacaggttaatttatggagacaaagtataagttgaccttttttttggcctcctttcttctgaaactatgtaggtaaatctagactcaaatatgacataatgtcatatcaggagatggttgtacaccaaattcggcaaatgaatgaagacaaccaacagctgctctattttaaggacaaggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagaggtaatactaacatcaaacagactacatggctattaattttattgaaaagtggttaccttgttgtggaacgtactttattatttctgatgccactgagttgtggttagcatatgcttctggttgattgcttcgttgaaattttttagctgtaattacaagagtggataatctaaagttatctttaatcttcctgtatgaatgttttgcatataaaaatgtgattcatgtaccattgaacttcagtttgatgtgtcaaattagactagcactgaatatgagatacagttgcatattgttgatcttttacattttttagggttgcactggccaagactgcattaggctatttatctagatactataatgccttaaaagaaaggcacataatcttgttaagatttggatctagattgattatttttgttttgttgtggaggtctgatgcctaccattaaccctgttttccagaacaatttccatttatttataaattgaatgaataatttcatcctagttcttgctttcttggtttacttttttttactaacccagcattggtctgttttctcttcaaaaaaacaaaaattgttgttttgttaattttcccttctggttagcttttgtcttgaatgataaggtcataatattatcttttcatagttttgttttctcactaatgtttcctgtcaatcatgaaagatgtatatgcaagaacaattcttcaaagaccagatcaaaatcattcatgattcaagggatgcaaaggaagaagattttgagaagatgcaacaggaagagcgtgagaaggtgaagcagtcaagtagtactggtcatgtgaatgctgaggaatatagactcaagtatgtaattgtcattccttccattggactattgatatattcacatctgaagccaatttaatctaaataaattttgtgaaattattatgtaggtgattttaaattgaattgttgaaggacattttattcttaaaaactaatttcacgtagctgtaaaaagctaggttaattttttaaagagtaagaattatgtacatgtgctgaaaaattattgcctgttttgtgtgtgtacaataatggctgaggtttgaacttgtaactttgtgcaaactattcaaacccctggccgaccacagtaggtttaaaaaattattatctagttatttggatggtggtatttatatttttgaatggcttttgtgtgaatttgaattctctggatgaagggtggaagagtatctgaaatttgttgaggtccaagataaagaaatggagaactttgttgctgaaaaggagaaactgttgcatgctcatggcatgggttatgctgcaatgaagcggaggcattgggaggaagaagttcagtatgagcagaagtttgatgaggaactcgccaacctcatggaaaagtactccccgttggagaagttcaatggtatctaatggtagggtcttttgcacagactcatacaaacagataaacacagccaaataggtagagaaaatagagacatcagctttctagagatcgagacttttactaaattcagtatgtcattttcttttctttagtacttgttggcatttggtacatgactggatatagaaaaccttgttaaaattttaaatggtggtgcatgtggttcgaatgactagaaattttacaaatagaaattttacaattgggagttgctatgccccgatgaatgattgatgcattgtgagtttgaatatctttagccaggggattttacagtttgagt

SEQ ID NO: 211 - DNA, 9716 bp, Glycine max
gttacttggttttgttcattgcataataagtccgacaaactacttggaagaaatggttaaaatgtcagttttaatttgcaatacatttactttatccttagtatttgacatcaatattttaatcgtacaatatacatgcatgcttctcttaacgagtgctttgaatggattcaataataatcactgaagtaaatccaaggcaaatgctaaatggattccaattaaaataagtaatttaaacaatgttttatctctttaaaatgacattttattacttcgtaaattaattttgggataaatttgaatttgttattgaatttagtgtaataagcaaagagaaaccactgagtgcaactattatgtcatgtattagatgtcaaccataatcctagaaagttttaaggataattgagaaatgataattgtttatttcataactaatttcatttgttatagttgttattatttacactgattaagttgtgttttattatatgatgcaaaatttgactaatctaagaccattgtaactagagagaataaagacaattcacattcaatggataaaatatttactaagagttataataaaacactaaatgtttaaggaattttagaattgttagagttatgtttagcttaggttataaatgatatttatgtatcgagattattgtttcatgtagtttcagtgtttttttatttaatagtatttatttaacaataatttgaatataatatatattgtttggattgtttctgacctacattggttttgcttttaatttacatgtttgggttcatttatcaacaaaatataaaaaaagtgcaaaaccaatatcaattaagtcaaaactgatgttggtatgataacaaaacaacatcagttttaccaaaattgacattataatgcactgtacaacatcggttttgaccaaaattaatgttgtaattactattcaacattggtttggggaaaactcatgttgtatagtgcattacaacatcaattttggtataacatatactatttttatattatttttttatattttatctatctattgccataacacatcgattttgggaaaaattaatgttgtataatggatttaaacattaatttttataactaatgttaaaaatgacttattttaacaatgattgtttcaatacggatgttaaatattctttaaaatggatgttaatgacctattttctaataatgacgtttctatattcaagttttgaaaattatttaataggcaaaccaatcaagtttctcactccttagcaacaacttctaaattttatgtttgtcaacaattgtttttccatagttctcttgtattaactctcttgtttatattgatataatatgtctttatccttgaaaaaaaaaacagacttaagttttttttgccgaaaatgtaattctgagattgaaagcaaaaaatataaacattaatgagagactaattagagggggagagagtaatgaaacagaggcaactctttttcttgtttcctatcaacaacattctccttcgtctcgaagtttatccgtacgtgccattttaccatttcttgtttatttatttttcttttcctttctctgtactcaataaatcacatttcaagtccaccttggtcagtcttcctcctctaacgttccttcctttgctgttacaacactcactcactcgctctccgcgcttttctggaggcgcgtgagtctcaaccgccacattttcttcgcgcgatcttcctacgatcagtggtgattcctctttttctctccgattttcacacttttctttatgagccgatacgatgccgttttgtcttcgttatgagttctttgctacctgcgttggttctgttgggaaagttcgttttgcatgttgctcatccatgtaaagatgatgaatatattaaaactataaaataaaaaattaataaagaaagaataaaataggttcgtatctaacgaagattttcggcttgttttcacgtttaactgcattttctatttttggttgaatgttatgaagaagagtgaaaagaaagaaagacaaggctcacagcaatagttgggtcttccaaaaggattaaactgttttttggggtttgaataaactcataatattttacggtgaatcttccctgaacgctatgagttttcatatagaatcctggctgtgtgttggtgtttttttttttttttttaagattggatttatgtttttttttaccctatcttcttcaagcttccaaaagaatttaaaatggatgggtttttaaggagggattctgttgctgtcgtttatctctgtttgtaatattagaataacacaataacaaaaccttctgccttctactactacctctgttacctaaactgttgatgtttaaagtcagtacacacagcttaaggaatagttaatactacctataataaattattactatttagtctaaaattctctcatttaatatcttttataggagtaattgtttgtttgaaaataacaattattaaataggggtatatgtagaaaaaaatagttaatgagacttgaaatttgtaaaacatcaatagttttggacttgaggaagtatcatctaagctgcgtttcaatctcaatgtgcgcacttaatattcaaagcaaaataaaaagtgtagcctgagtgcatttgcaaatgtgtcttttcttgggtcctgctatgagagaagcatgctgctaaatgttaatttcaatatctgtaaaagctttactgtgttatgattttatcgaatcacctttaccctccctttttgtaatgatgtgaaatgtttataagatggcaatcttcatttatctggagttttggctgttgtgtgtcttgtaccataactataagtgcttccccttgcatttggttcatgtaaaaccattatcctttcatgcacgttgtgttggtgttttgtggtattacattgagattcctcccttcatttgttttgtgcctgcatttgattcatgtaaaaggatcatctgttcatgtgcatgtccattgtggtgatctttttacagtattacattgtgattcttctttgtagtaatacaatgagattactcccttcaagtgcattgcccctgcatttggttcatagtagtcaatactgcaactttgcaccagtataatgatgatgtgttccagcacagccccctgccatgtctgtgtggcatgtagtggagcagttaagtgttgtgcttattgtgaggtgaatcgtgtctgcctgtgtagaatcatggcaatcctatatgttattttttccatgcataaaaccccatttgtttgacccctcaaacaatgtcatctggggctgcttctgtgtggcttgcagtggagcattacagtgtcatggattcatggttattgcatcacggattgtggccaccctacttgttattctttccttgtgcaaaaccctgtttgtttggccactcaaaaatgtcatttgatgctgtttctgtgtggcctgtattggagtagttcagtgttgctgtaattgcagtgcaacttgtggctgcttttgcatagacctgtggccatcctagctgttgttctctccatatacaaatccctgtttgttttgcccctcaaaatgtcatttggtgctgtttctgtgtggcctgtagtggagcagttcagtgttgtggttattgtggcacgaattgtggtctctttcgcatggaattgtggcatttccggctgttattctttccatatacaaaaacctatttgtttggctcctccaacgacgtcgtttggtgtcataaggctacaattccatgtgaaacggccacaatctgcctcaggaaaaaacccgtttgtttggcccctctaacgatgtcgtttagtgtcataaggtgggcagtcttgggattttttgcccttaaaagaaaaccctacttctctttgctatttgatgcaaatcatctgaccctgagctctcagctgcgcttctggccaatctgtggcactccagttgagtttccggccaaccctcaatctgaaattttggcaaactgttctgtggtctctattctgatcacatcctttggggcctgtactcttgacatcaaagaggggcccatgttctgttatgtgtgtgtatcaatgttgtaaagatcccgagtaaaatcgtgatcttgcatgatttcatgatcttgtaccctgcttccaagctgaattgcgggtaaaatcgtgaacttgcatgatttcacaattttgctccctgcctctgagttggattgtgagcaaaattgtgaaacggtgggatcggtttatgatcatagtcacagattggattgaaatcgtaatatcggttgatttttcttatcttctgagctggattttctgagacaggttgaatgcctcaaatttattttaacccactctattggtgccctaaattgatactttctgtttctcccccattttcagacctagacaagcactacccagcttttctctctcttttctattctctctatctcttggcttatcccttttgtctcctcagtcttgactcgaccctctctctgctatgattgtttgctgctgtgtgcctgtgtgcgttatacttgaccctctctctctggtctgctgtgatcgtgactgagtgctctgttttgcactcctgttctcactgaacagtgacacctgtgacactaaactttattttttatgcagccatgacctttctcagtattatttctttttcttttcttttccctaaaactcatgggttgggtgattttagcctttattcaagatatcttctctactgtgtcttttattatattctttggttttatgttatattcacttcttttattttttccacaaattattataaaatacagaacagaatgaaatattaattatacttatacagtatttataacttataaaataataggtatataaatatttaattttttaaatggattttactgatattattatatgtattatctaattatatttatcaaatttttgcattaaagtatatttttatatttttggtagattgttatgatccttgttaggatcccatgttcatgattttgcaaccctctgcccgatcttaagtaggatatatcgatcttgacaacattggtgtctatgtattgttgtctctttctttcactgttgtgcttagataggtaaccttatgttgctctttgttgctttactttattttttcttttgtattacttgactcttactattaacttctgtatttggcctaaaattatgacttaattattaattatgaatatgtctctaattatggctattttatttatttatttgagcatatatatatatatatatgtatatgcatatatatgtatatgtagcaaaaattctataaatttcatagtaatgatcaactggtcatcctggtatccacaatcctgctgtagcagttttggggttggccattctggctgctattctccatcctttcatgtgcattgtatcggtctcgtttcatgcacattgtgttggtctttttgtagttttacattgggatccctaccctccatgtgcattgcccctgcatttgattcatgtacaaccttttgcacacgttgcattggtcttttcgtattattacattgagatttctcccttcatgtgcactggcccctgcatttttcatgtacaagcagtatcctttcacacatattgcattggttcttttgtattattacattgagacttctcccttcagttatattctatttattgtatgcctcctttccatgttgacttcatagtgaagtgttgatttctttatttgagattctgagaacgtaatatttcagtgaatgaatttcttacaatgctttgacttgattgtgtctttagctgtatgtagattaagatttctctttcttaggtttattagtttattgtagttgacaaatgaactgattttctgttttcaagttccttcagttttattattctctatgcactttacctcccatctattatgcgtaacacaaaaatattgatgcagaacagagcatataaaaatgagtttgaaaagaggaggtgggagacctgtaactgtggctaacaatgatatgtccaaagggaaaagcatatctgaacctcagccaaaagttgagcagttgactcagggtattgctgatactaagctaaactcagaacaagatgatggtgagtgggaggtatatgcaaggaaatccaagaacaaggctggaagcagtgctgcaaaaccatggggccccccggtccataattctaatcctagggcatgggggaatgctgaaatggttcaaaagccaggcatccggagtcatggtggagttggaagatcttctggaaatccctggcagacaccaaatgctaactttaggagaccagctggcagaggaaatggaaggcctcaattaggaacaagtggatatgaaagcaactatgtgactccaaatcctgtaattcggcctccactcgagcatggctggaactggcaatccagacctggtgcaatgcagtccaatgtaagggatgaaatttcaccagaggaccttcaaaagaattatggtgttgatgatgatggggaggaggaggaatctgatgatttggaagatactgatgatgatctgatgagtgatgacgatgattctgatgctagtcaaaagagtcatgagacacgtaagaaaagcaaatggtataagaagttctttgagattttggatggcttgactgttgaacagataaacgaaccagaaagacagtggcattgtccagcttgccaaggtggtcctggagctattgattggtacagaggactgcagcccttggtgacacatgccaaaacaaagggatcaaaaagggtgaagattcacagggagcttgctatacttttggatgaggaattacgcagaaggggtacttcagtaattccagctggggaagtatttggaaagtggaaaggtttgaaagaagaagaaaaggaccatgagatagtttggcctccaatggttgtcattcagaatacaaagcttgaacaggatgaaaatgataaggtatagctatattttattggtgtcatatttgatattttgtttgcttgtatttatggagcataacattcacaattttttaataacattactggtttttatgtttactttggattttgttctttgtattcagtggataggtatgggtaaccaagaacttcttgattattttagcacatatgctgctgcaaaagcacggcactcttatggcccacagggtcatcgtgggatgagtgttttgatatttgaagcctcagctagtggctatctagaggcagagcgtctccacaagcattttgcagagcaaggaactgataaagatgcttggttcaatcgccctattttatatctacctggggggaatcgccagctctatggatacatggctacaaaagaagatctggactttttcaacaggcattcccaaggttccatttcctctttcttggttacttttattcatatttgcattatgcagattgtttgatgtctacccggtacaggttaatttatggagacaaagtataagttgaccttttttttggcctcctttcttctgaaactatgtaggtaaatctagactcaaatatgacataatgtcatatcaggagatggttgtacaccaaattcggcaaatgaatgaagacaaccaacagctgctctattttaaggacaaggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagaggtaatactaacatcaaacagactacatggctattaattttattgaaaagtggttaccttgttgtggaacgtactttattatttctgatgccactgagttgtggttagcatatgcttctggttgattgcttcgttgaaattttttagctgtaattacaagagtggataatctaaagttatctttaatcttcctgtatgaatgttttgcatataaaaatgtgattcatgtaccattgaacttcagtttgatgtgtcaaattagactagcactgaatatgagatacagttgcatattgttgatcttttacattttttagggttgcactggccaagactgcattaggctatttatctagatactataatgccttaaaagaaaggcacataatcttgttaagatttggatctagattgattatttttgttttgttgtggaggtctgatgcctaccattaaccctgttttccagaacaatttccatttatttataaattgaatgaataatttcatcctagttcttgctttcttggtttacttttttttactaacccagcattggtctgttttctcttcaaaaaaacaaaaattgttgttttgttaattttcccttctggttagcttttgtcttgaatgataaggtcataatattatcttttcatagttttgttttctcactaatgtttcctgtcaatcatgaaagatgtatatgcaagaacaattcttcaaagaccagatcaaaatcattcatgattcaagggatgcaaaggaagaagattttgagaagatgcaacaggaagagcgtgagaaggtgaagcagtcaagtagtactggtcatgtgaatgctgaggaatatagactcaagtatgtaattgtcattccttccattggactattgatatattcacatctgaagccaatttaatctaaataaattttgtgaaattattatgtaggtgattttaaattgaattgttgaaggacattttattcttaaaaactaatttcacgtagctgtaaaaagctaggttaattttttaaagagtaagaattatgtacatgtgctgaaaaattattgcctgttttgtgtgtgtacaataatggctgaggtttgaacttgtaactttgtgcaaactattcaaacccctggccgaccacagtaggtttaaaaaattattatctagttatttggatggtggtatttatatttttgaatggcttttgtgtgaatttgaattctctggatgaagggtggaagagtatctgaaatttgttgaggtccaagataaagaaatggagaactttgttgctgaaaaggagaaactgttgcatgctcatggcatgggttatgctgcaatgaagcggaggcattgggaggaagaagttcagtatgagcagaagtttgatgaggaactcgccaacctcatggaaaagtactccccgttggagaagttcaatggtatctaatggtagggtcttttgcacagactcatacaaacagataaacacagccaaataggtagagaaaatagagacatcagctttctagagatcgagacttttactaaattcagtatgtcattttcttttctttagtacttgttggcatttggtacatgactggatatagaaaaccttgttaaaattttaaatggtggtgcatgtggttcgaatgactagaaattttacaaatagaaattttacaattgggagttgctatgccccgatgaatgattgatgcattgtgagtttgaatatctttagccaggggattttacagtttgagt

SEQ ID NO: 212 - DNA, 5674 bp, Glycine max
ataattgtgcatttagtgattatttttgtctttacaactaagaagttttggatataatattcatcaatcaccacctccatattaactaaaaggcttgagaattttattaagcatagattaagagtaattagactaatcaggatcttctaaattgatctcaacatttttttaatgtattttttatattatttcattatgttacaagtgattcattttttctcatataatttattattcatttttatatcaattattttcacacaattttttttttcaaacatgcctatatataatcaacgcgacccatgcgtatgcacacattatcaactagttatatctaaatgaatttcaataatttctaaaaaatatgaattgttaaaaataactttatattaaaaattaaattattcactataaattcaaattttaatttatatattatatttatttatttattataatttctactatataaaaacaaatatttatcatacgcaaatacacaaactgtgagtagtgcccatttttggagccactcttaaccgaatatggtggaagcaggagtagatttggagaaagacaagagtttatgtttaattaatttttaaatagaaaatataaaaaataaattgaaaatgtcataaaaatactaagttatttaaatataatagaatttttttacacgtaaaataaaaagataaaactgatcaaacatataaagtacaaatcaagtaaatattatttagatgtttctattaaacattttaataataaaattaaatttattaaattttcaaaatattatattacaataaacaattatataaactatttaaacaatgctattagatttttaaaaatatttatgttgtttattataattttgttattttattttttaatttaattgtttctaaagatattgtttaaaagatttaaaatatgatatacgtaataatttatatatttaatgaaaatgaataataataatatttttatgttattaaagtttatttaatgtaaaataaattttgtattaaatttttagatttctttttcagctaaaaaagaatttattctaatttaacaaattaggaagttaaataaatataattatcaatgatttatttaaaaaaaacatgatcttttcctaataaataaaaatcttaaaagcgttactatcttttaaagaatataaaaggtttagttccagtaacacactttttcaaatatattatctctaattaattagttaaaatttgaaaaccctaaaatttgaaaaaagggcatcaaacatgacacgaaactcaccaatttttaattaaccaataatatatttaaagaagtgtatcaggagtatattaataatatttctcataaaactttactatctttaaagaataacactctcatttagttttcataataaaaataaacactcatttaaaattaaaacagtaaaacacactcccttaagagtaattgttagagagtctctcacgggtaccgtgtgggactttttattgtgtgattatgatacacatacacattacacgctagactctggaccatcatctgctatcgggtatggctgctgctactgcattctctctccaattccatggatttttgtttttttaaattcttattgcttctttcacatgcaaaactcttaatagtacaattgccttatgaatgcgttattgctatgctgttataaaccaatgctttgttctgttgctccttctgctgttttcttttgttggcaggggtaagtagattcttttcatgaattctcaatgcatgtacccgatatttgctctttctcagataactctgttcctcgattgctcctttgttggggctgaaaaaagaggaacacaacgattgtttgtgtagttaatcaaccaaatgagaaaaaagaggaacacaacgattgagaattaagggataggtaatcaatcaaacttgttcttgactctgtgctatttccatcacagttgctggaaaggttttcactttatcattgaattgatccaatgctctggctctcggtttatgaattaattaaactgttttcattgacatgaattggaacttttggactgtttcttatgacaattttcaaactttatatataaattagcttgggtaaggattgttgtttatgaaaccaattcctttggaacttctgatgctagatgtatttttttaattaagccatccatttgcttgtttattgtttccctgattcccagaggcttcaatattttgaccactggaagctgttttgttgcctttgtatgaggtgtcattgataattatgcttcgaagtgacagtatcaactccctgagataggtggtgaaaattgaattatggctgatgatggtgctgatccatttccgaagttgacaagtgtgtatagagtgtctggttccaaaaacaataagctgagctggaatgtagccaattctcagcaaagtgttgactccagtgtaaacaactcaaggcagttacagagcatttctgatggcagtgcttcaagatcctggttttctcaaaattctagaccaaatgcatgggaagttccaagtgtgattcagaagctgaggctggggaagcggggtaatgacggattgactaacaacagtaacctacaggacaaaagtaattctccagatgctctggctttgacgggaagtggaattttgaatgacagcaagttgcctcctgagtcagcaatatctccaacatcagagacatgtttaaattcatctgttgatgttgttgatacaactacatccaaggatttaaaaaatgttgaatgcaaggatgagagaatcccagaaccccattgtgaagacaatggatctgatattgtttttgatagtgatgacgattgttttttagacaacattgacttggataccggggagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggttgcagccccttttggatcattccagaacaatacaaacaacgagggcaagactgcaccggatgtttgctgaaactttggaggaagagtgtttcaggagaagagctccattaacaacggttggcgaagtccacaatatatgggagggtcttgataagaaagtcaaggatcatgaaatagtttggcccccaatggttattatcatgaatacaagatatgagcaggacgaaagtaataaggtacaataatattgtcttattttctagtttggatatgatgtgttaaatcaaatatgcagctacttgctgatgttctctctgtgtgtgtgggtgtgtgtatgtgttaaatcaagtatgaagctacttgctgaatttcttttatgttatatgcatgtgtagtttcacctcattgaattcaattgtagtggaatggaatggggaaccaagaactcgtcgattgcttcagtgactatgctgcattgaaggctcgacactcgtatggtccacaagggcaccgagggatgagtgctttaatttttgaggaaaccacggcaggttatctagaagctgtgcggctgcacaagcattttaaagagcaaggaagagatagggaagcttgggattgctgtcaaaatccatttctcccaggtgggaagcgccaactttatggttacttggcttctaaagaagatttggatattttcaacaaacactccggaggtaattttttcctctctcttaatcagttttgtatttattgtatgtcagccctgtacagttgttacttgattgaaataattgatgatgaacttgaatatggcaactctacatttcttaagagtttggtaatctagtaattcttagttggcatattttttttttctgtctctaagagagggaactaagtgttatttttgtgtttcttctcttttttggcaatcgtttaatattttaaatgaatgctgctgatacatctacattctttaggaaagacaaaactgaagtttgaaatgagatcatatcaagagatggttgagagaaagataaaacatattaatgatgatagtcggaagcttgactattataagagcatggtagccaaagaacaaatcaaatcacaagtcggtgcagactctttatgtaaatcaagtgagaagttaagcatgacaactgaaaaaaaccgtgttgaccaacaggacaaggaggtaaggttatgaggatgaaattaaattaatgttattcttgttgggctcattgggtttcgcaagaagaagctctgattgttatcatataattgagagcctttatgcataaaattggttataatgctttatgttttgagggtaatcatatatgctggtgaatggtggctgtctttatgaaaatatgatatttacgagaaaccaaaccgataagataaggctatttttcttattcttacaacttcatttatttgttcctgtttttctcacttccatttttttggtgtctgctcaagcctttattgctgtacaacttttttagtgtgatcttttctggggaggaattttataaatttgtctttcttgattctggttgtagctttctgaatgatgatcattttgaaatactgttttctagatggatgcactagaaaaaaatttccagagccaaatccaagacattcaacaagccatagctgcaaaggaggataagtttgtgaaattacagctgcaggcaatgcaagaaaaagtgaaagagtcctgcaaagaatcttctgagaaagaggacaagtacacctaatatttcctaattgtgcattattccaatttccaaggatgtttcatattatcattcttttactacatatatatcttagctttcttttgccattttggtaaaatactcaactaagtgattagcaagcaatattctaatctatcttctttctgaagcaaaattctcttttgcgttcggcattttctaatatatcatcttctatcaacagggtggaaaatatctctagtttcctgaagcctcaagacaaggagatgaagcaattcgaggcagagagagagaaaattaaaaaaattcatgaagagaaaaagttggctctgaagaagaagcagtggcaagagcaggttgaacttgagaaggagttagagaatgaactgacgcagctcatggacaagtacaattgcaaccaatctcaagaaaaaaactgttagaaatgaatgacagctaggtaacattattaaggaaaacatacacagaaatggtaaaagccaaaagcattcataggcatacatatcaggcagagtacatgattatgtgttctttctgccacattttattttccataaattaatacttttttcttttggtttacccttgcattttttattttgaaagttgaaaagtgagagttaacaagccccaccggcaccgaaattctggtcccattttcattgatacttgatatagttttgctcattatatctgtagcgtgctttgcttgcaaatggtttcgaatataagtaattttctgttgattgaagttactgttgggaattttggatgcatagtttgaaatagaattagtctgaga

SEQ ID NO: 213 - DNA, 5657 bp, Glycine max
gattatttttgtctttacaactaagaagttttggatataatattcatcaatcaccacctccatattaactaaaaggcttgagaattttattaagcatagattaagagtaattagactaatcaggatcttctaaattgatctcaacatttttttaatgtattttttatattatttcattatgttacaagtgattcattttttctcatataatttattattcatttttatatcaattattttcacacaattttttttttcaaacatgcctatatataatcaacgcgacccatgcgtatgcacacattatcaactagttatatctaaatgaatttcaataatttctaaaaaatatgaattgttaaaaataactttatattaaaaattaaattattcactataaattcaaattttaatttatatattatatttatttatttattataatttctactatataaaaacaaatatttatcatacgcaaatacacaaactgtgagtagtgcccatttttggagccactcttaaccgaatatggtggaagcaggagtagatttggagaaagacaagagtttatgtttaattaatttttaaatagaaaatataaaaaataaattgaaaatgtcataaaaatactaagttatttaaatataatagaatttttttacacgtaaaataaaaagataaaactgatcaaacatataaagtacaaatcaagtaaatattatttagatgtttctattaaacattttaataataaaattaaatttattaaattttcaaaatattatattacaataaacaattatataaactatttaaacaatgctattagatttttaaaaatatttatgttgtttattataattttgttattttattttttaatttaattgtttctaaagatattgtttaaaagatttaaaatatgatatacgtaataatttatatatttaatgaaaatgaataataataatatttttatgttattaaagtttatttaatgtaaaataaattttgtattaaatttttagatttctttttcagctaaaaaagaatttattctaatttaacaaattaggaagttaaataaatataattatcaatgatttatttaaaaaaaacatgatcttttcctaataaataaaaatcttaaaagcgttactatcttttaaagaatataaaaggtttagttccagtaacacactttttcaaatatattatctctaattaattagttaaaatttgaaaaccctaaaatttgaaaaaagggcatcaaacatgacacgaaactcaccaatttttaattaaccaataatatatttaaagaagtgtatcaggagtatattaataatatttctcataaaactttactatctttaaagaataacactctcatttagttttcataataaaaataaacactcatttaaaattaaaacagtaaaacacactcccttaagagtaattgttagagagtctctcacgggtaccgtgtgggactttttattgtgtgattatgatacacatacacattacacgctagactctggaccatcatctgctatcgggtatggctgctgctactgcattctctctccaattccatggatttttgtttttttaaattcttattgcttctttcacatgcaaaactcttaatagtacaattgccttatgaatgcgttattgctatgctgttataaaccaatgctttgttctgttgctccttctgctgttttcttttgttggcaggggtaagtagattcttttcatgaattctcaatgcatgtacccgatatttgctctttctcagataactctgttcctcgattgctcctttgttggggctgaaaaaagaggaacacaacgattgtttgtgtagttaatcaaccaaatgagaaaaaagaggaacacaacgattgagaattaagggataggtaatcaatcaaacttgttcttgactctgtgctatttccatcacagttgctggaaaggttttcactttatcattgaattgatccaatgctctggctctcggtttatgaattaattaaactgttttcattgacatgaattggaacttttggactgtttcttatgacaattttcaaactttatatataaattagcttgggtaaggattgttgtttatgaaaccaattcctttggaacttctgatgctagatgtatttttttaattaagccatccatttgcttgtttattgtttccctgattcccagaggcttcaatattttgaccactggaagctgttttgttgcctttgtatgaggtgtcattgataattatgcttcgaagtgacagtatcaactccctgagataggtggtgaaaattgaattatggctgatgatggtgctgatccatttccgaagttgacaagtgtgtatagagtgtctggttccaaaaacaataagctgagctggaatgtagccaattctcagcaaagtgttgactccagtgtaaacaactcaaggcagttacagagcatttctgatggcagtgcttcaagatcctggttttctcaaaattctagaccaaatgcatgggaagttccaagtgtgattcagaagctgaggctggggaagcggggtaatgacggattgactaacaacagtaacctacaggacaaaagtaattctccagatgctctggctttgacgggaagtggaattttgaatgacagcaagttgcctcctgagtcagcaatatctccaacatcagagacatgtttaaattcatctgttgatgttgttgatacaactacatccaaggatttaaaaaatgttgaatgcaaggatgagagaatcccagaaccccattgtgaagacaatggatctgatattgtttttgatagtgatgacgattgttttttagacaacattgacttggataccggggagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggttgcagccccttttggatcattccagaacaatacaaacaacgagggcaagactgcaccggatgtttgctgaaactttggaggaagagtgtttcaggagaagagctccattaacaacggttggcgaagtccacaatatatgggagggtcttgataagaaagtcaaggatcatgaaatagtttggcccccaatggttattatcatgaatacaagatatgagcaggacgaaagtaataaggtacaataatattgtcttattttctagtttggatatgatgtgttaaatcaaatatgcagctacttgctgatgttctctctgtgtgtgtgggtgtgtgtatgtgttaaatcaagtatgaagctacttgctgaatttcttttatgttatatgcatgtgtagtttcacctcattgaattcaattgtagtggaatggaatggggaaccaagaactcgtcgattgcttcagtgactatgctgcattgaaggctcgacactcgtatggtccacaagggcaccgagggatgagtgctttaatttttgaggaaaccacggcaggttatctagaagctgtgcggctgcacaagcattttaaagagcaaggaagagatagggaagcttgggattgctgtcaaaatccatttctcccaggtgggaagcgccaactttatggttacttggcttctaaagaagatttggatattttcaacaaacactccggaggtaattttttcctctctcttaatcagttttgtatttattgtatgtcagccctgtacagttgttacttgattgaaataattgatgatgaacttgaatatggcaactctacatttcttaagagtttggtaatctagtaattcttagttggcatattttttttttctgtctctaagagagggaactaagtgttatttttgtgtttcttctcttttttggcaatcgtttaatattttaaatgaatgctgctgatacatctacattctttaggaaagacaaaactgaagtttgaaatgagatcatatcaagagatggttgagagaaagataaaacatattaatgatgatagtcggaagcttgactattataagagcatggtagccaaagaacaaatcaaatcacaagtcggtgcagactctttatgtaaatcaagtgagaagttaagcatgacaactgaaaaaaaccgtgttgaccaacaggacaaggaggtaaggttatgaggatgaaattaaattaatgttattcttgttgggctcattgggtttcgcaagaagaagctctgattgttatcatataattgagagcctttatgcataaaattggttataatgctttatgttttgagggtaatcatatatgctggtgaatggtggctgtctttatgaaaatatgatatttacgagaaaccaaaccgataagataaggctatttttcttattcttacaacttcatttatttgttcctgtttttctcacttccatttttttggtgtctgctcaagcctttattgctgtacaacttttttagtgtgatcttttctggggaggaattttataaatttgtctttcttgattctggttgtagctttctgaatgatgatcattttgaaatactgttttctagatggatgcactagaaaaaaatttccagagccaaatccaagacattcaacaagccatagctgcaaaggaggataagtttgtgaaattacagctgcaggcaatgcaagaaaaagtgaaagagtcctgcaaagaatcttctgagaaagaggacaagtacacctaatatttcctaattgtgcattattccaatttccaaggatgtttcatattatcattcttttactacatatatatcttagctttcttttgccattttggtaaaatactcaactaagtgattagcaagcaatattctaatctatcttctttctgaagcaaaattctcttttgcgttcggcattttctaatatatcatcttctatcaacagggtggaaaatatctctagtttcctgaagcctcaagacaaggagatgaagcaattcgaggcagagagagagaaaattaaaaaaattcatgaagagaaaaagttggctctgaagaagaagcagtggcaagagcaggttgaacttgagaaggagttagagaatgaactgacgcagctcatggacaagtacaattgcaaccaatctcaagaaaaaaactgttagaaatgaatgacagctaggtaacattattaaggaaaacatacacagaaatggtaaaagccaaaagcattcataggcatacatatcaggcagagtacatgattatgtgttctttctgccacattttattttccataaattaatacttttttcttttggtttacccttgcattttttattttgaaagttgaaaagtgagagttaacaagccccaccggcaccgaaattctggtcccattttcattgatacttgatatagttttgctcattatatctgtagcgtgctttgcttgcaaatggtttcgaatataagtaattttctgttgattgaagttactgttgggaattttggatgcatagtttgaaatagaattagtctgaga

SEQ ID NO: 214 - DNA, 5638 bp, Glycine max
actaagaagttttggatataatattcatcaatcaccacctccatattaactaaaaggcttgagaattttattaagcatagattaagagtaattagactaatcaggatcttctaaattgatctcaacatttttttaatgtattttttatattatttcattatgttacaagtgattcattttttctcatataatttattattcatttttatatcaattattttcacacaattttttttttcaaacatgcctatatataatcaacgcgacccatgcgtatgcacacattatcaactagttatatctaaatgaatttcaataatttctaaaaaatatgaattgttaaaaataactttatattaaaaattaaattattcactataaattcaaattttaatttatatattatatttatttatttattataatttctactatataaaaacaaatatttatcatacgcaaatacacaaactgtgagtagtgcccatttttggagccactcttaaccgaatatggtggaagcaggagtagatttggagaaagacaagagtttatgtttaattaatttttaaatagaaaatataaaaaataaattgaaaatgtcataaaaatactaagttatttaaatataatagaatttttttacacgtaaaataaaaagataaaactgatcaaacatataaagtacaaatcaagtaaatattatttagatgtttctattaaacattttaataataaaattaaatttattaaattttcaaaatattatattacaataaacaattatataaactatttaaacaatgctattagatttttaaaaatatttatgttgtttattataattttgttattttattttttaatttaattgtttctaaagatattgtttaaaagatttaaaatatgatatacgtaataatttatatatttaatgaaaatgaataataataatatttttatgttattaaagtttatttaatgtaaaataaattttgtattaaatttttagatttctttttcagctaaaaaagaatttattctaatttaacaaattaggaagttaaataaatataattatcaatgatttatttaaaaaaaacatgatcttttcctaataaataaaaatcttaaaagcgttactatcttttaaagaatataaaaggtttagttccagtaacacactttttcaaatatattatctctaattaattagttaaaatttgaaaaccctaaaatttgaaaaaagggcatcaaacatgacacgaaactcaccaatttttaattaaccaataatatatttaaagaagtgtatcaggagtatattaataatatttctcataaaactttactatctttaaagaataacactctcatttagttttcataataaaaataaacactcatttaaaattaaaacagtaaaacacactcccttaagagtaattgttagagagtctctcacgggtaccgtgtgggactttttattgtgtgattatgatacacatacacattacacgctagactctggaccatcatctgctatcgggtatggctgctgctactgcattctctctccaattccatggatttttgtttttttaaattcttattgcttctttcacatgcaaaactcttaatagtacaattgccttatgaatgcgttattgctatgctgttataaaccaatgctttgttctgttgctccttctgctgttttcttttgttggcaggggtaagtagattcttttcatgaattctcaatgcatgtacccgatatttgctctttctcagataactctgttcctcgattgctcctttgttggggctgaaaaaagaggaacacaacgattgtttgtgtagttaatcaaccaaatgagaaaaaagaggaacacaacgattgagaattaagggataggtaatcaatcaaacttgttcttgactctgtgctatttccatcacagttgctggaaaggttttcactttatcattgaattgatccaatgctctggctctcggtttatgaattaattaaactgttttcattgacatgaattggaacttttggactgtttcttatgacaattttcaaactttatatataaattagcttgggtaaggattgttgtttatgaaaccaattcctttggaacttctgatgctagatgtatttttttaattaagccatccatttgcttgtttattgtttccctgattcccagaggcttcaatattttgaccactggaagctgttttgttgcctttgtatgaggtgtcattgataattatgcttcgaagtgacagtatcaactccctgagataggtggtgaaaattgaattatggctgatgatggtgctgatccatttccgaagttgacaagtgtgtatagagtgtctggttccaaaaacaataagctgagctggaatgtagccaattctcagcaaagtgttgactccagtgtaaacaactcaaggcagttacagagcatttctgatggcagtgcttcaagatcctggttttctcaaaattctagaccaaatgcatgggaagttccaagtgtgattcagaagctgaggctggggaagcggggtaatgacggattgactaacaacagtaacctacaggacaaaagtaattctccagatgctctggctttgacgggaagtggaattttgaatgacagcaagttgcctcctgagtcagcaatatctccaacatcagagacatgtttaaattcatctgttgatgttgttgatacaactacatccaaggatttaaaaaatgttgaatgcaaggatgagagaatcccagaaccccattgtgaagacaatggatctgatattgtttttgatagtgatgacgattgttttttagacaacattgacttggataccggggagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggttgcagccccttttggatcattccagaacaatacaaacaacgagggcaagactgcaccggatgtttgctgaaactttggaggaagagtgtttcaggagaagagctccattaacaacggttggcgaagtccacaatatatgggagggtcttgataagaaagtcaaggatcatgaaatagtttggcccccaatggttattatcatgaatacaagatatgagcaggacgaaagtaataaggtacaataatattgtcttattttctagtttggatatgatgtgttaaatcaaatatgcagctacttgctgatgttctctctgtgtgtgtgggtgtgtgtatgtgttaaatcaagtatgaagctacttgctgaatttcttttatgttatatgcatgtgtagtttcacctcattgaattcaattgtagtggaatggaatggggaaccaagaactcgtcgattgcttcagtgactatgctgcattgaaggctcgacactcgtatggtccacaagggcaccgagggatgagtgctttaatttttgaggaaaccacggcaggttatctagaagctgtgcggctgcacaagcattttaaagagcaaggaagagatagggaagcttgggattgctgtcaaaatccatttctcccaggtgggaagcgccaactttatggttacttggcttctaaagaagatttggatattttcaacaaacactccggaggtaattttttcctctctcttaatcagttttgtatttattgtatgtcagccctgtacagttgttacttgattgaaataattgatgatgaacttgaatatggcaactctacatttcttaagagtttggtaatctagtaattcttagttggcatattttttttttctgtctctaagagagggaactaagtgttatttttgtgtttcttctcttttttggcaatcgtttaatattttaaatgaatgctgctgatacatctacattctttaggaaagacaaaactgaagtttgaaatgagatcatatcaagagatggttgagagaaagataaaacatattaatgatgatagtcggaagcttgactattataagagcatggtagccaaagaacaaatcaaatcacaagtcggtgcagactctttatgtaaatcaagtgagaagttaagcatgacaactgaaaaaaaccgtgttgaccaacaggacaaggaggtaaggttatgaggatgaaattaaattaatgttattcttgttgggctcattgggtttcgcaagaagaagctctgattgttatcatataattgagagcctttatgcataaaattggttataatgctttatgttttgagggtaatcatatatgctggtgaatggtggctgtctttatgaaaatatgatatttacgagaaaccaaaccgataagataaggctatttttcttattcttacaacttcatttatttgttcctgtttttctcacttccatttttttggtgtctgctcaagcctttattgctgtacaacttttttagtgtgatcttttctggggaggaattttataaatttgtctttcttgattctggttgtagctttctgaatgatgatcattttgaaatactgttttctagatggatgcactagaaaaaaatttccagagccaaatccaagacattcaacaagccatagctgcaaaggaggataagtttgtgaaattacagctgcaggcaatgcaagaaaaagtgaaagagtcctgcaaagaatcttctgagaaagaggacaagtacacctaatatttcctaattgtgcattattccaatttccaaggatgtttcatattatcattcttttactacatatatatcttagctttcttttgccattttggtaaaatactcaactaagtgattagcaagcaatattctaatctatcttctttctgaagcaaaattctcttttgcgttcggcattttctaatatatcatcttctatcaacagggtggaaaatatctctagtttcctgaagcctcaagacaaggagatgaagcaattcgaggcagagagagagaaaattaaaaaaattcatgaagagaaaaagttggctctgaagaagaagcagtggcaagagcaggttgaacttgagaaggagttagagaatgaactgacgcagctcatggacaagtacaattgcaaccaatctcaagaaaaaaactgttagaaatgaatgacagctaggtaacattattaaggaaaacatacacagaaatggtaaaagccaaaagcattcataggcatacatatcaggcagagtacatgattatgtgttctttctgccacattttattttccataaattaatacttttttcttttggtttacccttgcattttttattttgaaagttgaaaagtgagagttaacaagccccaccggcaccgaaattctggtcccattttcattgatacttgatatagttttgctcattatatctgtagcgtgctttgcttgcaaatggtttcgaatataagtaattttctgttgattgaagttactgttgggaattttggatgcatagtttgaaatagaattagtctgaga

SEQ ID NO: 215 - DNA, 5575 bp, Glycine max
aattttattaagcatagattaagagtaattagactaatcaggatcttctaaattgatctcaacatttttttaatgtattttttatattatttcattatgttacaagtgattcattttttctcatataatttattattcatttttatatcaattattttcacacaattttttttttcaaacatgcctatatataatcaacgcgacccatgcgtatgcacacattatcaactagttatatctaaatgaatttcaataatttctaaaaaatatgaattgttaaaaataactttatattaaaaattaaattattcactataaattcaaattttaatttatatattatatttatttatttattataatttctactatataaaaacaaatatttatcatacgcaaatacacaaactgtgagtagtgcccatttttggagccactcttaaccgaatatggtggaagcaggagtagatttggagaaagacaagagtttatgtttaattaatttttaaatagaaaatataaaaaataaattgaaaatgtcataaaaatactaagttatttaaatataatagaatttttttacacgtaaaataaaaagataaaactgatcaaacatataaagtacaaatcaagtaaatattatttagatgtttctattaaacattttaataataaaattaaatttattaaattttcaaaatattatattacaataaacaattatataaactatttaaacaatgctattagatttttaaaaatatttatgttgtttattataattttgttattttattttttaatttaattgtttctaaagatattgtttaaaagatttaaaatatgatatacgtaataatttatatatttaatgaaaatgaataataataatatttttatgttattaaagtttatttaatgtaaaataaattttgtattaaatttttagatttctttttcagctaaaaaagaatttattctaatttaacaaattaggaagttaaataaatataattatcaatgatttatttaaaaaaaacatgatcttttcctaataaataaaaatcttaaaagcgttactatcttttaaagaatataaaaggtttagttccagtaacacactttttcaaatatattatctctaattaattagttaaaatttgaaaaccctaaaatttgaaaaaagggcatcaaacatgacacgaaactcaccaatttttaattaaccaataatatatttaaagaagtgtatcaggagtatattaataatatttctcataaaactttactatctttaaagaataacactctcatttagttttcataataaaaataaacactcatttaaaattaaaacagtaaaacacactcccttaagagtaattgttagagagtctctcacgggtaccgtgtgggactttttattgtgtgattatgatacacatacacattacacgctagactctggaccatcatctgctatcgggtatggctgctgctactgcattctctctccaattccatggatttttgtttttttaaattcttattgcttctttcacatgcaaaactcttaatagtacaattgccttatgaatgcgttattgctatgctgttataaaccaatgctttgttctgttgctccttctgctgttttcttttgttggcaggggtaagtagattcttttcatgaattctcaatgcatgtacccgatatttgctctttctcagataactctgttcctcgattgctcctttgttggggctgaaaaaagaggaacacaacgattgtttgtgtagttaatcaaccaaatgagaaaaaagaggaacacaacgattgagaattaagggataggtaatcaatcaaacttgttcttgactctgtgctatttccatcacagttgctggaaaggttttcactttatcattgaattgatccaatgctctggctctcggtttatgaattaattaaactgttttcattgacatgaattggaacttttggactgtttcttatgacaattttcaaactttatatataaattagcttgggtaaggattgttgtttatgaaaccaattcctttggaacttctgatgctagatgtatttttttaattaagccatccatttgcttgtttattgtttccctgattcccagaggcttcaatattttgaccactggaagctgttttgttgcctttgtatgaggtgtcattgataattatgcttcgaagtgacagtatcaactccctgagataggtggtgaaaattgaattatggctgatgatggtgctgatccatttccgaagttgacaagtgtgtatagagtgtctggttccaaaaacaataagctgagctggaatgtagccaattctcagcaaagtgttgactccagtgtaaacaactcaaggcagttacagagcatttctgatggcagtgcttcaagatcctggttttctcaaaattctagaccaaatgcatgggaagttccaagtgtgattcagaagctgaggctggggaagcggggtaatgacggattgactaacaacagtaacctacaggacaaaagtaattctccagatgctctggctttgacgggaagtggaattttgaatgacagcaagttgcctcctgagtcagcaatatctccaacatcagagacatgtttaaattcatctgttgatgttgttgatacaactacatccaaggatttaaaaaatgttgaatgcaaggatgagagaatcccagaaccccattgtgaagacaatggatctgatattgtttttgatagtgatgacgattgttttttagacaacattgacttggataccggggagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggttgcagccccttttggatcattccagaacaatacaaacaacgagggcaagactgcaccggatgtttgctgaaactttggaggaagagtgtttcaggagaagagctccattaacaacggttggcgaagtccacaatatatgggagggtcttgataagaaagtcaaggatcatgaaatagtttggcccccaatggttattatcatgaatacaagatatgagcaggacgaaagtaataaggtacaataatattgtcttattttctagtttggatatgatgtgttaaatcaaatatgcagctacttgctgatgttctctctgtgtgtgtgggtgtgtgtatgtgttaaatcaagtatgaagctacttgctgaatttcttttatgttatatgcatgtgtagtttcacctcattgaattcaattgtagtggaatggaatggggaaccaagaactcgtcgattgcttcagtgactatgctgcattgaaggctcgacactcgtatggtccacaagggcaccgagggatgagtgctttaatttttgaggaaaccacggcaggttatctagaagctgtgcggctgcacaagcattttaaagagcaaggaagagatagggaagcttgggattgctgtcaaaatccatttctcccaggtgggaagcgccaactttatggttacttggcttctaaagaagatttggatattttcaacaaacactccggaggtaattttttcctctctcttaatcagttttgtatttattgtatgtcagccctgtacagttgttacttgattgaaataattgatgatgaacttgaatatggcaactctacatttcttaagagtttggtaatctagtaattcttagttggcatattttttttttctgtctctaagagagggaactaagtgttatttttgtgtttcttctcttttttggcaatcgtttaatattttaaatgaatgctgctgatacatctacattctttaggaaagacaaaactgaagtttgaaatgagatcatatcaagagatggttgagagaaagataaaacatattaatgatgatagtcggaagcttgactattataagagcatggtagccaaagaacaaatcaaatcacaagtcggtgcagactctttatgtaaatcaagtgagaagttaagcatgacaactgaaaaaaaccgtgttgaccaacaggacaaggaggtaaggttatgaggatgaaattaaattaatgttattcttgttgggctcattgggtttcgcaagaagaagctctgattgttatcatataattgagagcctttatgcataaaattggttataatgctttatgttttgagggtaatcatatatgctggtgaatggtggctgtctttatgaaaatatgatatttacgagaaaccaaaccgataagataaggctatttttcttattcttacaacttcatttatttgttcctgtttttctcacttccatttttttggtgtctgctcaagcctttattgctgtacaacttttttagtgtgatcttttctggggaggaattttataaatttgtctttcttgattctggttgtagctttctgaatgatgatcattttgaaatactgttttctagatggatgcactagaaaaaaatttccagagccaaatccaagacattcaacaagccatagctgcaaaggaggataagtttgtgaaattacagctgcaggcaatgcaagaaaaagtgaaagagtcctgcaaagaatcttctgagaaagaggacaagtacacctaatatttcctaattgtgcattattccaatttccaaggatgtttcatattatcattcttttactacatatatatcttagctttcttttgccattttggtaaaatactcaactaagtgattagcaagcaatattctaatctatcttctttctgaagcaaaattctcttttgcgttcggcattttctaatatatcatcttctatcaacagggtggaaaatatctctagtttcctgaagcctcaagacaaggagatgaagcaattcgaggcagagagagagaaaattaaaaaaattcatgaagagaaaaagttggctctgaagaagaagcagtggcaagagcaggttgaacttgagaaggagttagagaatgaactgacgcagctcatggacaagtacaattgcaaccaatctcaagaaaaaaactgttagaaatgaatgacagctaggtaacattattaaggaaaacatacacagaaatggtaaaagccaaaagcattcataggcatacatatcaggcagagtacatgattatgtgttctttctgccacattttattttccataaattaatacttttttcttttggtttacccttgcattttttattttgaaagttgaaaagtgagagttaacaagccccaccggcaccgaaattctggtcccattttcattgatacttgatatagttttgctcattatatctgtagcgtgctttgcttgcaaatggtttcgaatataagtaattttctgttgattgaagttactgttgggaattttggatgcatagtttgaaatagaattagtctgaga

SEQ ID NO: 216 - DNA, 6708 bp, Glycine max
tgatttacatttggagcagaaagtggtatttcagacctcttgtggttcagcccattttagacttggtggagtactgataccattctatagcctcaggtccctatcctagttgcttgggttccacctcaatgcgagtttcttaatgaaagatattaggaaggtagattgaaggacctactgtagcattttcccatagtttaaggattcagttagagtgaaagtggtggctacaatcatgcaatagctccaacagtgaaaactatgcaataaccccaagaagtacaaggtgtaggacctatcataattagatgataaaaattatgtaaattctaggttatgtgggtttgtcagcgtgtaacattattcttatctgctaagatcttgatactttggaaacgtgcgatttgacaagaggctgttgctttgatttctccggctgttaaatggattccaggttggccttaaggatcccaaaatgaatagactaataacagcaataccattctgttgtccaactagggttggaacttgtaaaaacttaacctgcaaaatctttggcagcatcagcatgctacgttggaccagtaaggctttatgttgtttagcattaatattggattccaagacattctttgccggtaaacttcaaaaggatgcgaccgcctcttatattgcaagatcaattggtgggtattccgatttatgatgcagcggagacaaatgaatgttgtattgttggagtcagttgactgcattatgtaaccatttttttaaaatagtttatgtaaccattctattctttgaaggtttatgtaaccattcatggtagtgtttgcttccatttttttttaattgttaagatatgcacgaatcacgggcgaataaaatgtatatatgatcactgattaatggtatttgttgtgtcaaatgtaattgatttcctaaattttaataattttccaattgtatgagacattggttgatatttacattttagttatgttgtaaacaggtaataaatagttaacagataatataaataataataagaaacaaatagtgattatcttttttcattaagtataatatgtaacagataactattttttttcttttttacaatagcataatgaatcctagcgtgttcattattaatttacgttagttatctaaaaaacaataaaaatctcattaattttaaaaaaaatataaatttaagataaatttaataatactgttaattacattaattccataaaagaagactgaatgagtatataatgagaaagcgggtaaaggaagatagatagatttcgtagcagtaatagatgattcggtgttgtaaaatgattcacactagttgtaatggttgtgtcttaataaagttctttatgataaagattaattataatttctgacgaaaataacttggtactaatattaagattttttatatatataaaaaaaaaaaagatgattcggtggatcggacagcgttgaaatttaagacgcgtgtgaaaattgacaaaaaatgaaatttgataaaaatttcaagtccgaaaatacaacaaatgagagaaaatgccaagtcaacttaaagttcacttagctatcagccctttcgttttgcttcacacaacagccggcgatcgccttcggatctctgaggtaccaagttctttgttcctctccaacattctcttactctctcttcttagatttcagtcttgtacttctatttgtactaatttctatatagtatcgaatttaagcataaagggaaagattctcattcattatacatacacgtaatttctatacagagaccagacaggcataactacctgacccaaaactgtctaaccaactaacagagaaactagctaactaaatattaccaaaaataggctttgtgcaattaattagagaaaatagccttttcattaacagattaaagcatatttataccgttatttaattacaaatgattaaatttattgacttttattaaactcaattcattattgactatatttggatatatcattatcctgtaatattatacgtgatatcatgctttgggttttgcattttttggtccttaatatttctttatcttacgtgaaaaatatcacgacttttttttcttttttcttttgagaaacgttgagtttccacgttacgtgatgaggtcatttagagaatctctaaactctaaagggaactaaccatgataacttgaaagtaacaaacatatgtggtaatatatgataatactaggaaacttaattaagttgaagacgaatgaaaagtttgtttgagcatcatgtattttatattagtattgtttatatgctatattaaataatagaatgttaaattttgatgtggaaagctttttatgccaaccctcaatcatttgtttggtgattctttatgaatattatggattctctgtttttgtgtttgacaaacaaaaattgtgatccagaaaaggaattcaaaaagagggtgtgagagacctttcactatggcagacattggtgattcttcttccaaagggaaaaatgtattggaatctcttccaaaaattgagcaattaactcaaggtgttgctgatgttaacatagagtcaggacaagatgatggtgaatgggtggtatatgcaaagaagtccaagaatagagcccgaagcacaactgttaaaccatggagtcctccggttcataattctagacccactggaaatacaaagatggctcacaagccagttactcggaatgatggaggagttggaagggcttctgggagtggaaatccttggcagtcccaaaatgctaacttcaagagacctgctggcagaggaaatggaaggccacagttaactgcaagtgaatctgaaagcagcaataatgtgacttctaatccagtcattcgacctcccctcgagcatgggtggaattggcaatctatatctggctccaagcagtccaagagtgttgatgatagcctggtgaagggtgaaattacagaagagtcccctatgaagaatgatagtgttgatgatgaaggggatgaagaggaagggtttgatgctatggaagatacggatgatgatctaatgagtgatgattatgattctgatactagtcaaaagagccacgagactcgtaagaagagcaaatggtttaaggatttctttgagaacttggatggcctatctatcgaaaagatcaatgaaccggaaaggcagtggcactgtacagcttgtcgaggtggtcccggtgctattgattggtacagaggactgcagcctctgattactcatgccaaaacaaaggggtcaaaaagggtgaagatccatagggagtttgctgagcttttggaagaggaactgcgcaaaaggggctctgcagtaattccacctggggaagtatttggtaagtggaaaggtttaaaagatgaggagaaagatcatgaaatagtttggcctccgatggttgtcattcagaatacaaggcttgaacaggatgaaaatgataaggtatgagtatttttttttcttttttgcatcaaatgatgaataattagtgataataaaaaaaaaacttcgtaccccattgcccggaggctcttcgctatgcgaaggtatgggggagggatgttgtacgcagccttacccttgcatatgcaaagaggctgtttccggattcgaacccatgaccaacaagtcaccaaggcacaactttaccgctgcaccagggttcgccctctgaataattagtgataataatagtattattttattataacctttcgtgttaatgtagcaaaatattcttaaatttcctgaactatttctggattttgtgttaaattcttattttcttctttgtatgtagtggctaggtatgggtaaccaggagcttcttaattattttagcgcatatgatgctgtgaaagctcgacacgcttatggcccccagggtcatcgggggttgagcgttttgatatttgaagcatcagctataggttatcttgaggctgagcgtctacacaagcactttgcagaacaaggaactgaccgagatgcttggtttagtcaccaccgtagattatttctccctggtggccggcgacagctctatggatacatggcaataaaagaagacctggactttttcaacagacattgccaaggttcctatttctcttcctttttcagtccttttccttcctgtgctgctggttgtttgatgtgatctggttgcgtgttaacaaagccagttctatggagaaagtatattgacttgtattttgggggtaactttttaatctgaaattgtgtataggtaaatctagactcaaatatgacatgagatcataccaggagatggttgtaaaccaacttcggcaaatgaatgaggacaaccagctgcttatttatttgaaggacagggatgccaaaaaacaaaaacaaacaaaagctcttgaagaatctttgggtatagtgactgagaagctgcgaaggacaatggaagaaaatcgcattgtgaggttgagaactaaaatgcaacatgaagagaacaaggaagaggtaatactaacagttgacagtgacaaacttgtggctttgattgtggcatgtacttttagctgttgatagatgagttttggatgtgcttcggaatgaattgtttcattgaaaggtgttagctgtaatttatatttttatagtacaattgctgaagtttcgttagtatgtataagctaaacttctcacattttccttcagtataataatgggcctttgtgtcaaaagaacttcagtataacctgtcaaattagaggagcaaggaagaagagatcttctttggctatttgatctatgtgccttctctctcataataaatcattgagcaatgtaatgaaattcctagaattctttagtaaaacaactgatattcttaattcttgtaatgatttagtaaatggtggttgctactgttttgttgtggagtctgttgcatactttccgtgacccacccagttttccagatcagtttgtgttgattaatgaattgatccaatagcttttctactgagtgccctgataatttcatgtgattcatagttagttagctcttttctagctatctgaaaaataatttattctttcagacagatgatttcaatcccaatttgctttcccttctggttattccttatcaatatttcactaatatttttttctaggttatgaaatatttcttctttttcttgctattttttctgaccattggaactttgtctcaatgaaagatgtacatgcaagaagaattttttaaggaacagatcagaatcattcatgattcaagggctgcaaaggaagaagagtttgagaggatgcagcaggagaaacgagagaaggtgaagccgtcaagtactagccctttaaatgaagaggaagggagagttaagtaagcactttacattccttgaggttatatgttagattcagttgaagtgttggactaatccctataattatttattcacatctggtggcatgctagtatgttgtaatttttgggaaacacaatatcaaagaaacctaaattcacgatagtctaacaaattaatattttgagaagagatgtatatacatttatagaaacactgtagtccagttgttttggttgtgcactcgtgctatttaaatttttcattggcctatgataaattttcatttctttggatgatagggtggacgaatatctaaaatttgttgagtttcaagataaagaaatggaaaactttgttgctgaagaggagaaactccgtcaagctcataaagacaatgttgatgcaatgacgcggaggcactgggaggaaaaggtgcagttggaggaaaggtttaatgaggagctagccaagctcatggaaaagtattccctatctcacccagaaaagtccaatggtatctgatgacagtgtgttgcacatcgcagacaaaaagataaatacagcattataaacagaagataaatggatagagtgattgttctaagttgaagaccctcagatatctgcacttttgtacttgaatacaaggacatgcctagagaatggagatagaaagcttgctaaaatacaaatgacattgcttattttctcctttggtattagtggcttgaacttttgatgtaattgcttttatgcaaattttttgaatagcagcaatttggatggagtgaaatacaccactttaggttatctctggctttggtgaatcgtatgaatggaagcctgatagctctgctgtaagagaagtgttagcgacacactccctaacacacttcctattattattagtgaaaatttattggaaattacaaagtttgagtgaaactcattaaatagttaagacttaccaataaatttcagtcactaataagtgtgttaagtatgttgttaacatttttcttactgtattcatctgtgaagcctgcttctgtattcatctgtcaagcctgcctctgttgcttcaaaactcaaaaggcctgaattcaacgttgtaataaatattgaattttgtttttataggggttaatatttatgtttatccttgtgttcacttgtccgttcgccccatggttatgtttttcaaactttgaggtaataggtttagttgcctttaaatgtaac

SEQ ID NO: 217 - DNA, 5687 bp, Glycine max
ttaaacttaaaattagcattgatgacaataaataagagaaaattgttttacattgacatagacattaaactcaataataaaagaaaattgattatgtatttataaaaagttttacacgattctctaataacaatttattatgtatgataattttttttatttttaaaataattattttaaattaatttaaacgatgattaataattagatgataatataaaattattttacattaaactgataaaacaaatacttgttgttgtttttttttttttatcatatggagaaagtaaaaacaaaacgattacagacgaaggaaaacagtgccaatgacatttattgtcaacacaggaataacatcttctgggcagagaatatgattaactaagaggtctaaactaacagcacatttcttagctaatatattacaggcccagccctgaactatgatgagggatgggttcacaaatttttattttggtgtaatattttaaaaaaatcattttaatatgactaattaattcatagactaatcaattaaaaaaaccctttcagtttcctctccacttttcgatataacccacccaatggctgttctcaaattcaaaggttacaagcaattgaatattaaatttccaccaacttattcaatagcttttacaaatttatagttttgtggccctttatttatgattttgtactggacccataaaatattaataccggctccattggaaagagagcaggttcttgatgcttgcattaatcaccatagcaaaagggtgagaactagcagattgatgatgaattgaagatagagaatcagtctccagcataataaatccgaatccattgtcccatgaagaatgcccagatccacatttgtcgtattgctgcagtgacccaactaatactttagtaaatataattttttttaatagattcggtgtaagacaagagtttatttatgattatttttttaatagaaaatataaataaataaaaaatatgtcataaaaatactaaattatttaaatataataaaaaaattacacgtaaagtaaaaatataaaattaattaaacatataaagtaaaaatgaatgaaatattacttagatgtttctatcaaatattttaataatgctattatatttttaaaaatatttatgtttttgaatataatttatgttattttattatctaatttaattgtttctaaagatattgtttaaaagattaaaaatgtaatttatatatttaataaaaatgaaaaataataatattttatttaaaatttatttaatttgaaataaatgtcgtattaaatctttaaatttctttttcagtaaaaaaacacgaatttattctaattgcaaaaattaggaagataaataaatataattactaatgatttatttttaaaaaatccatcatctttacataataaataaaaatctttaaaacgttactatctgttaaagaataataacactctgatcgtttaaaagtaaattgttagagaggacgcagtcacgcctgtgactgtgtgatacactagactgtattgctgctactgcattctctctccaattccatgcatttttgcttttttaaattcttattgcttctttcacatgccaaactcttcgagtacaattgccgttacttttattcctccttatgaatgcgttactgctatgttataaatagatgctttgttcttgttgctccatctgtcgtgttcttttgttgacagggtaggtagattgttttcatgaattctcaatgcatgtacctgggatttgctatttctctgataactctgttcctggattggtcctttgttgggggtgaaaaaagagattgtgtgtgtagttaatcaagcagatgagaaaaaaaaaatgaattctttgtccctcatgtaaaaaaggatccattttttttttttatagaattgtttgtggggtgtttgagaattaagggataggtaatcaatcaaacttgttcttgactctgtgtgctatttccatctggaattacatccaatgttagttgcgggaaaggttttcactttatcattgaattgatccaatgttttgcctctcggtttatgaattcattaaattggtttcattgacatgaattggaatttttgaactttttcttatgacaattttcacactttgcatttaaattagcttgggaaaccatttgctcgggaacttccgatgctagatgcatttgattttatttttttagttaagccatccatctccttatttattgtttgcatgactcctgaggcttcattattttgatcactggaagctgttttgttgcctttgtatattcttcgaaataacaatatcaactccctgtgataggtggtgaaaattgaattatggctgatgatggtgctgatccatttccagtgttgacaagtgtgtatagagtatctggttccaaaaacagtcagctgggctggaatgtagccaattctcagcaaactgttgactccagtgtaaacaactcaaggcagttacagagcatttctgatggcagtgctccaagaccctggttttctcaaaattttagaccaaatgcatgggaagttccaggtgtgattcagaagctgaggccggcaaagcggggtaatgacggattggctttgacgggaagtggaattttgaacgacaagttgcctcctgagtcagtaatatctccaacatcagagacagagagagggacagggttaaattcatctgttggagtcgttacaactacatccaaggattgtgaaaatgttgaatgcaaggacaaggataagagaatcccagaaccccaatgtgaaaacaacaatgatcagattgttgacaatggatctgatattgtttttgatagtgatgatgattgttttttagatgacattgactcagatactggagagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggctgcatccccttttggatcattccagaacaatacaaacaaagagggcaagactgcaccggatgtttgctgaaactttggaggaagagtgtttcaggagaagagctccattaacaacagtcagtgacgtccatgatatatgggagggtcttgataagaaagtcaaggatcatgaaatagtttggcccccaatggttatcatcatgaatacaagatacgagcaggacgaaagtaacaaggtaaatgatgttgtcttaatttcttgtttggatgtatgcacttaatcaaataatcagctactcgctgaagttctctttgtgggtgtgtgcatgtgttaaatcaagtatgaagctacttgctgaatttcttttatttctttacacgcatgtgtaatttcacctcattgaattcaattgtagtggaatggaatggggaaccaaggactccttgattgcttctgtgactatgcagcattgaaggctcgacactcgtatggtccacaagggcaccgagggatgagtgccttaatttttgaggaatccacggcaggttatctagaagctgtgcggctccacaagcattttaaagagcaaggaagagatagggaggcttgggattgctatcggaatccatttctcccaggtgggaagcgccaactttatggttacttggcttctaaagaagatttagatattttcaacaagcactctagaggtaatttttttttcttctcttaatcagttttcctatacagtttttttcttattgagataattggtgatcaacttgaatatggcagctctactttccttagagtttggtagtttagtaattcttagttggcaatcgtctattctctttaggaaaagagagggaaactggtgttatttttgcgtttcttctctttggcaatcatttactattttaaattaaagttctgatacatctatattctctaggaaagacaaaattgaagtttgaaatgagatcatatcaagagatggttgagagcaagataaaacatattaatgatgatagtcggaagcttgactattataagagcatggtagccaaagaacaaatcaaatcacaagtaggtgcagactctttattgagattaagtgagaagttaagcttgacaaccgaagaaaaccgtgttgatcaacaaaataaggaggtaaggttatgtggctgaaattcaattaatattattgttgttgtgctcattgggttttgcaagaagctctgattgttatcatataattgaaaacttttatgcataaaattggttacaatgctttatattttgagggtaatcatatatgctggtgaatggtggctgtctttatgaaacaatatgatatctatgagaaaccaaaccgataagttaaagctattttacttattcttacaacttgatttatttgttctgtatttctcacttccatttttttggtgtctgctcaagcatatattgacgtataatttttttagtgtgatcttttctgggaaggatttttacaaatttgcaaatttgtctttcttgattctggtagtagctttctgaattatgtaaaaagtctttctacaactgatcattttgatatactgtttttgttttttctagatggatgcactagaaaaaaatttccagagccaaatcctagacattcaacaagccatagctgcaaaggaagataagtttgtgaaattacagcaggcaatgcaagaaaaagtgaaagagtcctgcggagaatcttctgagaaagaggacaagtacatctaatattccctaattgtgcattattccaatttccgagcgtgtttcatattatcattcttttactacatatatcttaactttcttttgccatttagataatactcaactaagtgattagcaagcaatattctaatctatcttccttctgaagcgaaattctcagtggcgtttggcattttctaatccatcctctatcaacagggtagaaaatatctcttgtttcctgaagccccaagacaaggagatgaagcagtttgaggcagagagagagaaaatcataaaaattcatgaagagaaaaggttggctctgaagaagaagcattggcaagagcaggttgaacttgagaaggagttagagaatgaacggacgcagctcatggacaagtacacttgcaaccagactcaagaagaaaactgttatgtggatcattaaggaaaacatacacagaaatggaaaaagccaaaagcatccacaggcatacagatcatgcagagtacatgttatgtgctctgccacattttccatgaatttatacttttttcttttggtttactcttgcatttattttgaaagttgaaaagtgagaaagttaacaagccccaccggcaccaaaattctggttccattttcattgatacttgatatagttttgctctcattatatatgtagcgtgcatgctttgcttgcaaatggtttcgaatataaattttctgttgattaaagttactgtcttactgtagggaattttggatgtatagtttgaaatggaattagtctgagactcatactgaataataccaaag

SEQ ID NO: 218 - DNA, 10714 bp, Glycine max
ggttttaccctttaaaatagctgttagttttgatggttgcaaattttagaggttttgaaaataatttatattattaattatgatgctacatggcgttaagtgactgatgaaataatatgcataattagttaattcacatcacatcatatatatatatatatatatatatatatatatatatatatatttaaatgtatatacatatatttatatataaatatatattatgaaaactaaaattaacaaaaagaattaaagaactaaaataaaaatttattatatttaaatgaattaaaaatatatttaacttttattatctattttacatataaaaaagatttcttcttcatactataattgatgtcactgttatcattttatatactttttatttcatatcatttatattttatttttacttcataacaagacacatttctttcatatcatttatattttatttttacttcataacaagacacattattaagttattatgttatcattttttgggtctatctttttctctttttcctatttcttttatttctatcctaatttcccaaaaacaaggtgtcctattatccctactctacataaaaatatacattaggtaagaaagatcaataatatgacatcttgtacttgcatagtcatttctattccatatgttgtctttatgccaattaccttagatacatttactaataacaacattacaacaatacataagagtaatgttaaataataaaagaatacctggtacaatttgcataaaacacaaaaaatacaagtataatttactctaaataaagtaaaagtcatgatttttgtttactataacaatgaaaaaagtaatattcatctagaagaaaatattaaaaaatgaaattacatattaattacaataaaaatttaaaatacaattaaatatctcatcttctaaaaaagaaagcacattgaaaaaatcaaaaccactaaaataaaataatagttataaccttccacctacttctttttctctattattttcacactattatttttcatattgtctttgtctttcacattatttattacatatattacttatttttttttctgtttctatttttctcttatttttcatgtgactagcctcatttatatattttttctttcatatcattcacattttattttcacttcttaataagacacatcacttacttatttacttattacatcatcatttcctctctcaacccttttcttttttatttatttctattattcttaccttaattaactaattcataattataatctttcacctactttcttttatatattattttcacctattatcttttcatgtgtctctttctctttcatattatttattataggtattactttttttcctagtctacctctccaatttcctatgtatatcctcatttatatactttttctttcataccattcacatttcattttcatatcttaataagacacattgcttaattattatataatcactttttctctctacgtttttctttttaacttttctctcttattcctaccctaattgactaattcaccaggtgtccattcatcaccactccacataaacctatacactaggtaagcaagatcaagaatcacatcttgcatttgcttcttgcacaacaatttccacctttttttataaaagaaacttcaatgttcaaatgtctgaaactattagttcataaatttcaaaccccacccaatccggaaaccaaaaatttcccaattgtccatttcccctccaatgcatcttcttccctccaaatcaccatttccaaagctccttctccttattcttcttcgccttcttcttccaatctgaaccctacccaacaccatcaccaacaagaacaccaccttcttctataacactaccatgaattctctcttttcgccggaaaaccttcctccaccaccgggaatcccaatccccgccacaattgccgccgccagcaccaccaccccaaacccaattctaatcccaaagctggaacctttcgatgaatggctcaacacccacacaccccaacaacagcaacaatctcaggaccccaattcttcaaatgggtccctcgacctcgaccttaagctcttcggcgacgaatcccccgaagatttctccggcgaccctaacttgctctccgacttcaaccgtctctctcagcttttcagaaccgctttctccaacaacaacgccgttcccgaccccatcacccaagggatccagcagctcggaaacgacgccgtttccaacccctttgccaaacccccccaaaacgaaaccaccgtggttccaccgccgagcttccaaaacggcaccgtttcggaccccgggatgctgctgcagcagcagcagcagtatccgaacggcgccgtttcagacccagattcgcgggcaattgtgccggtcccggaggacgggcggtcctcctcggtggcggtcaccacgccgcggcagccgcggcgctgcaaagagctggtccgcctgatggatgtcggcgggccggagcagcgtcacttccgggacgtggtccggcggacgaggatgctttacgactcccttcgcgtcctggcgacggtggaggacgagggccgggtggatgcccggcgggggcgcagcgatttgcgtgcctcggcggtgatgaggaactgtggcctgtggctgaaccgtgacaagagaattgttggtgcaattcccggtgtctgcattggtgatgtgttcctttataggatggagttgtgtgttgttggccttcatggtcagcctcaggctgggattgattatctccctgccagcatgagttccaatggtgaaccaattgccactagtgtcattgtttctggtggttatgaggatgatgttgatgagggtgatgttatcatttactctggccacggtggccaggacaagcattctaggcaggttttccaccagaagcttgaggggggaaatcttgcaatggagaggagtatgcactatgggattgaggtcagggttattcgtggggtgcggtatgagggtgctgcctctgctaccgggaggttgtatgtgtatgatgggttgtataggattcatgagtgctggtttgatgtggggaagtcgggtttcggggtttataagtataagctgtgtaggattgatgggcaggctaagatggggactgtggtgatgaaggaggcgcttatgcttaggaaggatcccttgagtttcaaacccatgtgttgtttgtctcttgatgtttcgaataggaaggaaaatgtggccattcggctttttaacgacattgatcgtaactatgaccctctgcagtatgagtatcttgtgaagacaaattttccgcagtttgtctttcatcagagtgggagggggacgggttgtgagtgtgtggatgggtgtgttgaggggtgcttttgtgctatgaagaatggaggggattttccttataatcagagtgggattctcttgagagggaagcctttggtttttgagtgtggcccgttttgtcattgtcctcctcattgtcgaaaccgtgtcacgcagaaggggttgaaaaataggttggaagtgtttagatctagggaaactggttggggagttaggtccttggaccttattcaagctggtgcttttatatgtgagtacacgggggttgttctcactagggatcaagcacagcttttgacaatgaatggtgattcgttgatatatccgaatcggtttactgataggtgggcagaatggggggacttatctatgattgactccaattatgtgcgtccatcgtatccgtcaatacctcctttggattttgctatggatgtgtcaagaatgaggaatgttgcttgctatatgagtcatagttcgactcccaatgtgttggttcagtttgttctctatgatcacaataatttgatgttccctcaccttatgctatttgcgatggagagcatccctccgatgagagagctcagccttgattatggggtagctgatgagtggacaggaaagctctctataggtaactgaacaattttgggagtttcatacactttataatatactgaagctgagttttgggcattgtttgcagaggtaaagccaagttctttcatcgacttactcgttttcagaattttcatcattgtttttccatttcattttatgtcatatctcaatctttgtgtggtctccattataagctctgttaaccatatgaggttgtaggcatattattcattatgaactgctccattttgtggtcttcctagcatcctggtgtacttcagatgacaggaagtttaatatttattgtgactttgaagattgagataatatgttgtaatatcttatcattgtagtttggtttgcaaaccgatcagtattgtgcttgctctgaatatgagatttttctgcttctggcagtcgaaatctgttttcctgtatttgggtttatatgtgtgtttgcattccatctatctattattggcgctattttattgaacacatgatcttaaaactttcctttcctttcctaagaaatccactttatttacaatgacatcatattatgtattagtattatgaattattcaattataatttgtaagactgtaaccattaattctttgatataaaatatccctgagcaatagtctttcaaaattatttgtggaatattagaagactttgttcatagcttcatattgggaattcaggtgtgaccgtagaagttccctatttaaaagtaatgggtttgcgcagttagcacaaggtgttaagttctaacctttttgctgccattatttattttttttggaaggcaaacatagatatatattattaataatatcaaatcagtaccagaagtactgatgaattacacataaagacaagacactaagagtgtcgcctcccaaacaaagcaagccccctaaaaatccactacaaaggataaaatacccatcccaatacagatatacaataacccagcccaattcaactaaaataagccacaagattagaagaccattggttgaaagaaatgctgaagtgtttgtctctggtttttaaccatgtccagttgaggaataaagcatcctccatcactttagatggttgaaagtgattaccctcaaaaaccaactgatttctatgcttccatatagaaaaagtaatgggctaagggaggaatatgtcagttaaatgacccatagacctaattaagtttttgggccgggaagtggtgtaaagcctataagtgtggttcttgcttaagcccatgaaaagagatattctcaatgttttgggcttcccttctccttacagttcacttgttattgtattctttcagtgtgggtttgatagagacttggaccggatgatgtaaattgtaaacagtttagatgggctggatgatgtaaggcacctttcaggggaggggctaagcagtgatggaatgttttttgtcatgtggatttgctgacatggacaagttagttaagctagccagccagtgttataggggagagtaggggactaggtgagaatcatgttgagcagtattgtcacggtgtggccgagcatgttctctgaaatgccttggatctggtaggagaaattgtaatttctatggttatattttaattcaataatagtatcagattcaaccatagttaccaggttcacaatactctctggaacgtggtatgggtacctgtacacggtatgcaaccatacaaagtattggtacacggggtatatagagttggtatgcttattaaaataaagcccttttaaaaatatgttaatttatttttacaattttaaatttctatcatccacttaaattttaaagcgagaagtgttgaataactataaaaagtaaatgaataactctttattttatgttactcttcttctttgtacattcgagttgtgtttggtagagaggaaagagatagagggagtggaaataggcaggtgggaaaagaagggaaataaataagaaatagagtagaaatattggttgtttggtttaagaaaaatagagtggaacgaacattgatgctgtttagtttgaaagaaagaaaaggaaagaaattagataatcaagaaatataccattttagtgattttaccttcacatatgtagtcattattttttacttgtaggccccatgctctccatataatcgattatatggctcctatcacacaaaatagaggaacatgttgcaactaattgattatgcttgcatataattggttatgtttagacacaatcaattatgtgcaagcataattgattagctgcacttaaaaatccattttgggttacttttggtaaagtgaaaaaaaaaccaagacctctgtagtatttcatcgttcatgagagtggaaataaaaagtgtgggtccacactttttttgaaaatctctatttcttgggtaccaaacaagggaacttccgtacttcaacttcatttccttgccgttcctcgcattcttacatctttcaccactaccaaacacaagattttttattaattgattggtttgtctaatatgattctgattccaccggttatagagcatataaatggaatttgccgttataggttacctcttgatctcgtattgaaaattgataataggtgacatcatagtcaattcacctccaaatttccatattttcatggtggtaattgcattgttgttgagattgtgtaatcgcacaatcttaagcattaaaagccccctttcgtgctaactcgtgctgtggatcatggttgagcgggaccagtcttccacacccaatagtgtagttggcggtcccctgtgagcaggaagaaacagaaaagcagagtggtcgtccactactcttgaggcacttgttgcgaagcacctgtctgttgcagatgttgtgcagccatttggggtgcaaattgcagcgttttgtgggcttcatagtagctcctccatttcttctgttgccagacatagcactgcaacctgcactgttgctggacagcctctgtcacctccctcttgctgcttccaacctcccagtacacctccatttgtgttctcgccatatgcaatagggaattaaggttgcacttgctttttcagaacagcggcagcacttagtagaaaagctgacgggtcctagggttttagggaaattgcgtccaaacatttctctctgttttcctttttctggtttgatttgttgggcctcaacttgagttcaattcagcttctccctcttttttttttttttttttttacgtaaaacataacatatactataataaactgaagaataactgtaataaaaaaatattagtattaaaaatatagtaaactatttaaagcataacatataacatatatataatataataactaagtaataataaactaaaaaaagcatataatgtgatataataaattaaagaatgatagtaataaaaaatatgtattatatataagtattttaggcaggggactgtagggtcttatgatctgagttacaggttttcatccccttcttgttcctcttgattttaacaaccttagataattgagacttggttacaaatggtagtgcttctgctgtaactaaatgtcaatgttaatatatatttctttttacccgaattaattcctcatgaagataaaagaggctactaattgctctttgttattgaatttttccttctctacttgaagttgaactgaagcttatttgctctagtattctgtatctaattattgtgtgtattcattaagtgcatttcctattctgtgaaataaggtgtatgatttttaattgttccagtaaaattatttccaaaattaatgatttattttttttcagttgttcatagattgtcttctagatttatataggttcaatatattttggtttcaaaatcatatctctggttccagtttcctagttttctccaagaaggttgctaggttgttgcaaaacttggctaatttaaatgtttatagtgtatagtaactgaataagttcttcattttggtcttctattaattttagcatttacctctactgatgggatgaagaactggataattactttcatatttttgtaattacttatagactttttattgctgtaccatgaatctttgcttcaatataaggtgaacatgtcatcttgtaacacaacagctgaaagatggtcattaggctcaagtaatttatgttgccaaaatgtgctttatttttttccatcctgcctgacttcccattgggtttcactacatactttcttttcatgtgggcttttgcagcgtcttttaggtttgttcctaacttcctatcaaactagattggtgattcaaatattgttgtggatctgtaaatggtcaaatagaaatttattattatttgtcatgttctgataattttctttatgtttacaatttgcattgaaagctggttgattgaaaatatttctagtctgtgtttggggggatgcttactttgggattggcaaatggatgcctctgaacattcaattttagcaattgagtctcttggaattttgcaaaatatatcattagcacttctatctaattttttggtcaattcatattttgaaatttaacattttatttatttatttgaaattcatatttgacttgctgtaaagaagattggactgtagaccgcatagtcacagaagctatgataaatgtcattaactaattattctagaaacataaattgttgggtgaaggctcatgcatggttgtaagtaaaacaaactgcttgtaacttgaaatgttttcaataagcaagctttccattccgtgttaaaatattcatgcttaatgttatgaactattttatttttaattattaggcatttaagtccttttcctttttatgatttatattcaattgggccatatttgaacctgcttctatattgtctgtgggcataaaatttggtataaattagtcatttctttgagtacaaattagttactgcatcttttttttttttttttaaattatgttaaagtaggttagttgacaaaattaatgttccaggggtctgattgcaatccccctaaagttaaaggagctcgtgtgctttacatttatatggtcctcacagtccattattccacccccattcttcacactgtcacgtttatatggtcctcacatagtccatgattctcttgttcattgtcctacattttctttactcttttagctgtattcccaagtttgtaactttgtcaggttatctcaaaatttaatttagtacattaactgcacagaagttttttacattgccatcaagtcatatattgttatgaatgataaaattgttgacttttgtaataattgctttgaaagtcatttctagggtgatttttaattggttagctgtgtaacaaaactttacactgacagtgcatggaaaatctctttatctttaaagaaaagactcaaatgagtgtggtcaatgatatctgcagaaataactgttctgagataaaatcataacataaatattgatggtgtgagatattttatcatcatagatttaaaacagatcctattgtattcttttgttcattttgcttcaataaggctttttatcatagaccaaacaataacatactggttcgatatattttatcgaagaactcaacagacaccaccattctttacctttttttattgattgtgctttgaaagttttacatgtgtttttaccatacatgttggccccatctgagcagttgagtttaggtgcaaatggtaactccatttactacgtttgaaaacttttatatactttcttgaaactctagtgtgacttaaatcatatttgtctttcatcatcagcattgtaattattttgggttagtcctggattttacatttccctattttgatttttcaatttactatcccatatagttttgctattgcaattaatcaatatccaggcatgccaatttgagttgatattcatttgcagagatagtcaagttgatgcagcacaactttcacaagttttcaaccccgccaatttacaaggaacagtagtagaattgcttgctatttacggtgtcaggatatcaaaattcaaatataaagaaatgtctattacgttattctatctaactgttggtggctagtacacggtgtgcctttgtgttgagaaagatcaggaattgaagttgccaagtctgcttaatcttgaagacttctgtaggtttctcacttgttgatgtcatttgttttttctgtaattgatgtcttcctcatctcggcgaagcattttcacacatttttgtaagcactaatagtgcaagctgtattaactctttcttcttttggagtactttgtatatagtataagttcaaaacttgtataggttttgtattagtgactggtatcggatgcagcattttaattagtttagaactgggtaaattgggcatctggttattaagatgataggatatagccattgttgctaatgatcttgtatgaggaaagtcaattatgatgaaatggacaatttggttatgaatttcacccaataaggttgtagaacatctatgataagacattgtttgcacgttgcatgtaga

SEQ ID NO: 219 - DNA, 18794 bp, Glycine max
aataatagttgattaaattatttgaatttgacttaatttcatttggtatggattataatttttatatttgaattgcaaaaaaataaattaaaattaaagcacaattataattatgagttgaatttgaattttaatgagagtgttgataacacaaatattaagataatatttaattatttttattagtataatatttatataaatatattatatgattttttaattatgaattattgagtagaatttaattaattttattaatatataatcattaattgctaatatctctttttataaaaaagaagccccatttaagaaataaaaaaaatattgaaataaaacaataattatgatcttcttcctaattccttttctatattattttcaccccattttctttttatatgtttatttttgtttctctttcacattatttaatacataaatgatctttttttatttatttatcataatttacctatcctattatatatgtcactattattcttttatatattttctctttcatgccatttatattttattttcacttcataatacaatacattgcttagttattacattatcactttctttatctaccttttactcttttttccatctctcttatccctatcctaattcctccaaaatgagatgtcatgttatccataatataagagggtgtttgatttgaccgtgaacaaccaaaaatcgtggtgagaacataaaaaaataattaaaacagttaaatgttgctttctcgtcatgattttgacccccattatgatctaccttaccaccaccccaaatacactgtacataaaaatacacattaggtaaacaagatcaataatgtgacatcttgcacttgcttgactatttcattgcatactcgacattttctacaaattatactccatatagttaaggataataacattacaataataggtaaaagtaatgtcaaatgatggaagcttgtgaacacaatttatataaaatacaaaaatacgagtttaatttactctaagaaaagtgaaaaaaatttaaatctttattataacaataataatgaaaaattaatatttatctagaaaaattagttaaaaaataaaattacatattaattacaataaaaaattaaaattaaaattaaatatcatcttctaaaaagaagaaagcctcattaaaaaaaatcaaaattacaaaattagaaaaaattaaaataaaacaataattatgatcttttacctactttcttttctatattattttcaccccattttctttttaatgtctctttgactttctctttcacactatttattacatgtatttttttttctctataccttttttctttctttctaattctcttctatttatatctactttacctctcttattacatgtcactgtcatcatttatgtattttctctttcatctcatttatatctcatctcaacttaaagaaacttacttatcttttaagctatcattttctcactttatctatttcttttcttctcatctctcttcttcctaccctaattcccaaaaaatgaggtgtccattaatcaccactccacataaatctacacattaggtaagcaacatcaaggatctggcatcttgcacagctatctctacctttcccacaaaacaaaaaagcaattcaaagttcaaattctgaagctcttagttcataaatttcaaaccccacccaaccaaaatttcaaaaccggaaaccaaaaatttcccaagtgtccatttcccctccaatgcatcttcttccctccaaatcaccatttccaatgcttcttcttcttccaatctaaaccctacccaacaccaccaccacctccacctccaacaagaacaccttcttctataacattaccaccatgaattttctcttttcacgggaaaaccttcccccacctccgggaatcccaatccccgccaccattgccgccgccaacaccaccccaaacccaattctaatcccaaagctcgaacctttcgacgaattgctcaacacccacacaccccaacaacaacaacaatctcaggaccccagtttttcaaatgggtcccttgacctcgacctcgacctcgacctcaagctcgtctgcgacgaaacccccggtgctttctctggcgacccaagcttgctctcagatttcaaccgtctctctcagcttttcaaaaccgctttcaccaacaacaacgccgttctcgaccccatcgcccaagggctccagcagctccaaaacgacgctgtttccgaccctctagacggcactaccgttgttccaccgcagagcttccaaaattcggaccccgggatgcagcagcagcagcagtacccgaacggggccgtttcggacccggattcgcgggcaattgtgccggtcccggaggaagggcggtcctcttcggtggcggtcaccacgccgcggcagcggcgcttcaaggagctggtccgcctgacggatgtcggcgggccggagcaacggcacttccgggacgtggtccgccggacgaggatggtttacgactccctgcgcgtcctggcgacggtggaggacgagggccgggtggatgcccgccgggggcgcagcgatctgcgcgcctcggcggtgatgaggaactgtggcctgtggctgaaccgtgacaagagaattgttggtgcaattcccggtgtctgcattggtgatgtgttcctttataggatggagttgtgtgttgttggccttcacggtcagcctcaggctgggattgattatctccctgctagcatgagttccaatggtgaaccaattgccactagtgtcattgtttctggtggttatgaggatgatgttgatgagggtgatgttattatttactctggccatggtggccaggacaagcattctaggcaggttttccaccagaagcttgagggggggaaccttgcaatggagaggagtatgcactatgggattgaggtgagggtcattcgcggagtgcggtatgagggtgctgcctctgctactgggaggttgtatgtgtatgatgggttgtatagaattcatgagtgctggtttgatgtggggaagtcgggttttggggtttataagtataagctgtgtaggattgatgggcaggctaagatggggactgtggtgatgaaggaggcgcttatgcttaggaaggatcccttgagtttcaaacccacgtgttgtttgtcgcttgatgtttcaaataggaaggagaatgtggcggttcggcttttcaatgacattgatcctaactatgaccctctgcagtatgagtatcttgtgaagacaaattttccgcagtttgtgttccatcagagcgggagggggacaggttgtgagtgtgcggacgggtgtgttgaggggtgcttttgtgccatgaagaatggaggggattttccttataatcagagtgggattctcttgagagggaagcctttggtttttgagtgtggcccattttgtcgttgtcctcctcattgtcggaaccgtgtcacgcagaaggggttgaaaaataggttggaagtgttcagatctagggaaactggttggggagttaggtccatggaccttattcaagctggtgcttttatatgcgagtacacaggggttgttctgactagggagcaagcacggcttttgactatgaatggtgattccttgatatatccaaatcggtttactgataggtgggcagaatggggggacttgtctatgatagactccaattttgtgcgtccatcatatccgtcaatacctcctttggattttgccatggatgtgtcaagaatgaggaatgttgcttgctatatgagtcatagttcaactcccaatgtgttggttcagtttgttctgtatgatcacaataatttgatgttccctcgccttatgctatttgcgatggagagcatccctccgatgagagagctcagccttgattatggggtagctgatgagtggacaggaaagctctctatatgcaatgaatgattttgaaagtttcatacactttataatatactgaagctgactttcgggcattgtttgcagaggtaaagccaagttctttcatcaacttatttgttttcataattttcactgttgttttccatttaattttatcttatcgctcaatctttgtctggtctccattataaactctgttaaccatatgagttggtcttcctagcattctggtgtacttcagatgacaggaagttcaatatttattgtgacttttaagattgagataatatgttgtaatatcttgtcattgtagtttggttttcaaactgatattgtggttgttctgaatatgagctttttctgcttctggcaatccaaatctgttttcctgtatctgggtttatgtgtgtgtttgcattccatctatctaatattggtgctattttattgaacatatgctcttaaaactttcctttcctttcctaagaaatctactttatttacagtcacatcatattatgtattagtattatgaattttcaattctaatttgttaagactgtaaccactaattctttaattttaaatatccccaagcaatagaaactttctgtgttgatttggtgatcatgctggggcaatttctctgaattctagatcttggttctttctaaattggttgtggaatattagaagacttactttgttcatagcctcatgttgggcattcaggtatgagcgtggaagttctccatttaaaagtaatgggtttgggttgttagcacaaggtgttggttttaatcttgttgttgccattatatgcacacacaaaaaaggtaatgggctaatggaggaatatgccagttaaaggacccattgacctaattaagtttttgggtcggggtgtggtgtaaagcctataagtgtctcttgcttaagcccatgaaaggagatcttcacaatgttttgggcttcccttgtcctaacagttcacttgttattgtattgtttcaatgtgggtttgatagaaaccttggactgcatgaggtaaattgtaaacggtttagatgagctggatgatgtaagccacctttcagaggaggggctaaatagtgacggaagttttctgtcatgtggatttgctgacattgacaagttagttaagccagccagccagcattatagaggggagtagggggctaggtgagaatcatgttgaggagtactgtcatgatgtggctgagcatgctctctcagggattccttggctctggtaggagaaattgtaatttctatggttatattttaattcaataatattatcagtttcaaccacagttaccaggtttgcaatactccctgggacatggtataggtacctgtacacggtatgcgatcatacaaagtattggtacacgggtatatagagttggtatgcttattaaaaagaagcccttttaaaaatagaagaattttaaattttaaatttctattatccactataattttaaagtgaaaagtgttgaataactgtaaaaagtaaatgaataactctttaatttatattactcttctcctttgtacactagggttgtgtttggtagataggaaggaaatagaggtagtggaggtaggtagatgagaaaagaagaaaagataaatagattagaaatagagtggaaatagtggttgtttggtttaagaaaaatagagtgaagataagataaagaaatatagcgatgatcataaaaatacaattttaccctacacaaagataacattttattttatttttttaccattggacaacataatcaactattttgaatgcataatcaattaagttggagatcgaatgctggagcttgcgaggaagaagacaccagcagcacgacatcaaaagctagagcaaaagaggaagaagacacaaggagcacagggtcagttttgtaaaagaagtagctccctcaagatttccacgaaaataatctccgtggagtgtggaagctgatgactgtgggccccaccaattttttatttttatatattttcaatacatctcgtgtgtaccaaacaagcgaatttgtacacttctttgcatttccgttctcaccacttcttttctttggtacttcatgtgtaccaagagagcctcaatcaagttttattgagaaaaagagctgcacaaccttcctaaattaaaagaactggataacactcaagtgtcaagtcttattaatatatattttgttataactctttaattctaaagcaaggctgtgctatccagagtttgaagttgaatggatttattgactgcacatttaatcttatcttctcactctaatgagcgtgcaaatgtttcctagaaaaaattaccctattaatgcactcttcaatctctctctctctcctactgcacttattgagaatttggaattctcatattctctctcttcaatttgtcatacttcatattcttggatcgtcactgccatgaatttttgccaatttttagcataccagtatgagaacgttccgtgaattggtactcatgaacccatttgcagttcttttttaaaatcatgaattatgtttcactggtttcaatcttgtactattatgcatattctggtgttctattagggctctggttcctacactagaaattgtttctctaaggatttggtactttttgtgaacatgatattaaaatgtgggttttgggtctaattcaacctcaaaagttagctcatagggtgaggattgtggcccacttatatattctatcttagtcttatctctagccaatgtggaatttggattttttccaatacactccctcatgcccaatacttttttggacttggtgcatggatgacatggtgggtggttcgtttaatggatctaggatagactttgatatcatttaagagttatttattgctttgtgttgttgtatcataccacccgaaatattcttatttataatcaaggaggtttacaaaataaggaaacaaaataatgagtaataatggaaacaatcccatactaaactgtaattaaaacatatcaaatcatatctttgacactccccctcaagttggagtatatatgtcatatgaaccaagtttgttacaaatgtggtaaacccaacagaaacgataaacggttctagttgggtgattgtgccagataagcatggctcgacagtatccaatgaaggcccatagtggtgatgtgtgttcaccagtaaataaaagcacaccttgaggtggaaggaggtggttccagtgtgacgcttgccggagatgcgttgtgtgtgtgaacttcacgaactgaaaaagggccctgcgtcatgtcgtgttaagatattatatgatagagatttaggagttttgataagatatgatgatgttataatatggtagagattaagatatgattctgtgtatgatatggtagagatatgatagcttatttctaggaaagtgggaaacttttatcttatctagtaggattatatctctaagatttatagtagattttggttaatcttttcctttttactagcttatatttttttgtaagctaggtaggatttaagaatgttacaattgagatagtacaagtccttttaattaaaattgtattgaaaattgatccctgaatttttcacctacaatataaaacttgtaaaatagaagaaaccgagggatatttggactgaaaaccgtgtgtatttctgtgtctgaaatacacacgggtcattgtttatatagacatattgcattaaatacacataagtagagaggataataagtttcatcgaaatcagatcctctaaatcagatatcatatcctatcacatcattatacattaaattccttattctcaacaaaactaaattacaaggttaataggggctgctcaatgctttcattaaataatttgttctgaaaatattgactaagattcttaaaaatacagatgacaatttactaactaactttctgctactttatgtcattaaaggtgttaattactaaatttgtccagccaacaaactacagagaagaccaagataaggttggaaccttgaacaagaacaaaactaatatagttgagaatcgaacaactatagagaaccttaagctatcattttaagatgctcaagagattaaggtcattaacattgtgtttggtagagagaggaaatagaaggagtggaaataggcaggtaagaaaagaagagaaatatataagaaatagagtagaaatatttgttgtttggtttaagagaaatagagtggaacaaaaattgaggttgtttagtttgaaagaaagaaaaggaaagaaattagataattaagaaatataccattttacccttcacatatgtagttgttattttttacttgtagcccccatgctctccataaaatcgattatactattagtatagtcaattatatgtctccaatcacacaaaaatagaggaatgtggtgcagctaattgattatgcttgcatataatcaattatgtttagactttagacacaatcaattatgtgcaagcgtaattgattagctgcacttaaaaatccattctgggttacttttggtgaagtgaaaaaaaaccaagacctctgtagtatttcatcgctcacaagagtggaaataaaaagtgtgggtctctcactttttcaaatatctctctatttctctgttactaaacaagggaacttgtgtactacaaccttatttccttgctcttcctcccattcctatatctttcactgctaccaaacacaacataaattttttgataaattgatttgttttgtctaatatgattctgattccactggttatggattatataaatggaaattgccattaaaaggttacctcttgatctcatattgataattgataataagtggcatcatagtcagctcacctccaaatttccatatatgcatggtggtaattgcatcgttgttgagattgtgtaatcacacaatcttacgcattaaaagccccctttcgtgcaaacttgtgctgtggatcatggttgagtgggatcagtcttccacactcaatcgtatagttggtgatcccctgcgagcaggaagaaacagaaaagcagagcaatcgtccactgctcttgatgcactcattgcgaagcacctgtcttttgcagatgttgtggagccattttatggggtgcaaattgcagtgttttgtgggcttcatggtgactcctccatttgtgccgttgccagatatggcactgcaacctgcgctgtcgctggacagcctctgtcactggacagcctctgtcacctccctcttgctgcttccgacctcccagtacacctccatttgtgttctctgtcatctgcattgtgcaatagggaattaaggtggcacttgctttttcagaacagcggcggcacttagtagagaagcttatgggtcctagggtgataggtacagaatgagaaagaaagcacatgaagagagggagagaattgttacttttctgatattcctcctacagtgcacatataacgtatatatacacatgtagggcacaaacgacaaaacatgaaaacatgcaatatacgtgaatacacatagtgctataacccactaagaaattgcaggtatattcctgacaacctacaacacacacgtactatcgggatttgcaaatcctactgatttgcaaatcctttatttcaatccgcgcctattacacgtaatcttggaaagctcaggagctgatgttctccttttgggccttttgttcttggtctgagtcgtgcttggcctatcattcccggcttcataaaaaatcaccttgtcctcaaggtgataggcctccttcaaggtggtccagtcctcccatgatgtgtcgtccacatgaagaccctgccattgcactagcacctgcaagcgagagttgtctgcggagccctcccatcgagtacttaaaatggccagtggcatgattactggttggttatccaaggttgacggtggcagcgaaagtggcttgggtgtggctgaagtatcgtgaaggaagggtttaaggagagagcagtggaaaaccggatgaatacgagaaccttccggtaagcagagtttgtaggccacaggaccaatacgttcgataacctagaatgggctgtaaaaacgtttggcaagcttgttttggctggttcccgtcactgaagattgacggtgaggtcaaagcttgaccattatgttatcaccaaccttgaagtgaacctccctgcgatgcatatcggcgaaatgcttcatgcgctcctgagctttgagtagttgcttttgtaagctagcaaacatggcatccttggagcacaattagttatccacgacatcaactggggatgagcttggaatatattggagaattgtgggaggtttctttccgaaagtgacctcaaacggtgaaatacccgtgcttgtgttacgggaggtattgtatgacccctccacccaaggtaggaatttgccccatgtcgcgggtcgtttatgaacaaaggctctctggtactactcgatgatacgattcatgacctttgtttgaccgtcaaattgggggtgataagcaaagcttagccacaattttgttcctgagagtttgaatagttcctgctgaaacttgctgatgaagaaaggatcctgatcagagaccaaactcttaggcataccatggtgtttggctaagatatccaaaaagagagtggcaacttggtaagcgaaatatttcattggaaggatacccggatggatccccttcgagaatcaatcaacaatgaccggtacagtggtgtttccccggtacggtggtaacctgacgataaggtcgagagataatcctcccaaggtctgtgcgaaattggaagtggttccaagagccctgctatttttttagtttcgtatttggttgcctgacaatcaacacactgcaccataaatttatgaacatccttgtggattgaattccaatttaaattctcctataatattgacaatgtcttagtaatccccatatgtccgcccgtaggtgttgagtggaattcttgctgcaaaagatggataaattttaagctattgggtaaccaaatacaacccttcttcagaattaagccattgttgtaattgtactccgagtgactcaagggctcgtcttgcaacgatttttgaagagccacaaactcttggtgggcagctagttcatttttaagctcggtcaagaacgtgaagtgcggaattgataataaaaacaccatgcctgtgggtgtcttcagagtatgagaaagtgcgtccgccactatattcgaactatccgagcgatattggatggtgaaatcatagcccatcaatttggttaaatacttatgctgttctggggtttgcacaatttgactcattagctccttaaggcttctatggtcagtgagaataacaaaggaatgaccaagcaagtactgtctccattttttgacagcaatcgtgatcgcatggttcacgaacataagttgaagcttgttgaagccttggataaaactgtttactaaagaatgcaattgggtgagtttgctgagatagcacgacacccattccagaacctaaagcatctgtttccaagtaaagggtaaggtgaaatccggtaagcgaagaactggggcagtacttacgatggatttcaaggtttggaaggcatcctgtgtttcaagtgaccattcgaagtgtttcgggttaagagatgaaccaaaggggctgctatcgcagcatttcccttgatgaatcgtctatagaaccccataaggcccaagaatccttgaagggtgcgaaatgaagtgggttggggccattgctgcacggcgagcaccgtttcgagcactggttgaactccagccccggacacgacatgtcccaaatattcaatttgctgttgggccaggcaacatttagataatttgaggaaaaatcgaccatccttcgggacctgcaaggcacaatccaaatgtcgcaaatggtcttcaaaggacttgctgtaaatcaatatatcatcgaagaagacgataatgaatttacacaagtagggttgaaacgttgtgttcatcagtgcctgaaacgaggagggggcattgcacaagccaaagggtataacacgaaattcataatgcccttgatgagtgtggaagactgttttatgaatgtcttcttcattcaccaaaatttgatgatatccctgcaacaaatccagcttcgtaaaccagctagcgccccccagttcatctaatagttcatcaatcatgggtatagggaatcgatctttaatggtaatagcattcaacgctttatagtttatgcaaaactgccaagtgccgttgcgttttttcaccagaaggactggtgatgagaaaggactttgactaggtcaaatgatgctgctacacagcatggtctcctcctaagattcgatttcctattactgaaaaatgtgggtacctataaggttgcacattgaccggggttaagtggggaagaaggttaatggtgaggtttgtttcgtggtttggaggtagggtagtgggtgtttggagaaggaaagtgtaacggtgaaggatggactctatttctggtgagtggttgttaagtgtggagatttgggtagaagggggctcaggtgtggtgaggcgaatgtggaagagggtgctgacaccattggtttgaaccatgcgctgtagctggtggtggttgacactgaatgttagcttcacgtttcccctgtagctcaacaacatgaccatgctgcatgaacttcatagtcaagtcagcataatcggtcaaaacgggtcccaaggatttaagccattgaactccaaggactaggtccgtccctcctaatggcagcacatgaaagttgactgtgaaacgatgcccttgaatgtggaggatgacatctcgacaaacctgcaaacagtcaatttcactatcattgccaaccatcacctgcaacatttgagtgggttgcactcgtaagcccaaagtagtgaccaagcgttcctggagaaaattatgagtacttctgctgtcaatcagcaccacaacattactgtcgtagatggttcccacaaggcgtagagtttcaggagctaggtggccacaaatggcatgaaaactgatttgagcgggagatttatcatcttgatctgttgcttcttgaacaaattcttcatgagggaggtcgttcgggtccagctcgtcttcatcagcgatgaagagaaacaactttgaagaacaacaatggcctcgggtgaatttctcgtcacaattaaaacacaatcctttttctccgtgcaatgtaagttcctctggggacaagcgtttatatggaactggtggtttaggtggggtaggcaataaaaggggaggtggtagggaggaagaggtagggatgggtcacggaaagttagaaggttgggtgtacgaacgagggcgaaatggcttgtgcaactcacagaacttgtcttcttgcagacgagtcagtgcggcagcatgaatcatggaaagaggttggagtgcttgtacttcacaatgaatctctggggataggccgaagataaaacaactcaacaaaaatgagggtggaaggcctaggatccggttcgcctacgcttcgaactcggttaggtagtcattcaccgagccttgctgggcaagcttaaacaaagaccccgtaggatcctcgtagtgagacgacgcgaagcccgcttcaagggcctataacagacctgaccaggaagtaatctgtccgttgcaggtcatccattgataccacgcaagtgcaggcccatccatgtaaaaggagacaatcgtcagccatttgttttttggagttgcatgataataaaaaaattgattgattttaaagagccagccaactgggtccgtgccattgaaacggggtatttcaagtttcaggcgatatggtgtgatcgtcggagacggagatggagggtgggccgaagaagcaggtgagtgctgcgtcgactccattactgcaaacttttgacaaagatcatcaagtttagctgacatggaaagctggtttgtggtgagttttgctatggcatcttccagcctatcaagatttgattttgagtgtgtggagtcggccatgagagttcaggatgagagcaccaattgataggtacaaaatgaggaagaaagcacaggaagagagagagagaattgttacttctctgatattcctcctacagtgcacatgtaacatatatatacacatgtagggcacaaacgacaaaacatgaaaacatgcaatatacgtgaatacacgtagtgctataacccactaatgatattactgttatattcccgacaacctacagcacacacgtactattgggatttgcaaatcctactgttttgcaaatcctttatttcaatcggcacctattacacgtaatcttggaaacgcttaggagctgatgttctccttttgggcctttcgttcttggcctgagtcatgcttggcctatcatagggtttcatgggaattgtgccccatatgtttctctctgttttctcttcttttggtttggtttgttgggcctcgacttgagttcaattcagcttctttttttttttttttttttttttgcgtaaaacataacatatactataataaactgaagaataacagtaataaaaaatattagtattaaaaatataataaactatttaaagcatgacatataacataatataataactaaataataataaactaaaaaaagcatataatgtgatataataaattaaatgatagtaataaaaaaatgtattatatataagtattctaggcaggggactgtaggatcttatgatctgagttacaggttttcatccccttcttgttcctcttgattttaacaaccttgggtaattgagacttggttacaaatggtagtgctcctgctgtaactaaatatcaatgttaatatatatttctttatacctgaagtaattcctcatgaagataaaagaggctactaattgctctttattattggatttttccttctctacttgcagttctactgaagcttatttgctctagtattttatatctaattattgtgtgtattcattaagtgcatttcctatactgtgaaataaggtgtatgatttttaattgttccagtaaaattatttccaaaattaatgaattattttttcagttgttcatagattgtcttctagatttatataggttcaatgtattttggtgtcaaaatcatgtcttgggttgcagttccctagttttctccaagaaggttgctaggttattataagacttggctaatttaaatgtttatagtgtatactagcagaataagttcttcattttgatcttttattaattttagcatttagctctactgctgggatgaagaactggataattactttcacatttttgtaattacttatgaatcgtttattgctatactgtgaatctttgcttgtatataaggagaacatgtcatcttgtaacacaacagctgaaagatggccattaggctcaagtaatttatgttgccaaaatgtgctttatttctgttggatttccatccatcctgacttcccattgggtttcactacgtacatttgtttcatgtgggctttttgcagcatcttgtaggtttgttcctaaattacaatcaagctagattggtacttcaaatattgttgtggatctgtaaaagttcatatagaaatttattgttatttgtcatgttctgataattttctttatgtttgccatttgcattgaaagctggttgattggaaatatttctagtctgtgtttgggaggatgcactttgggattggaaaatggatgcctctgcactttcaattttagcaattgactcttggaattttgaaaaatatatcattagccacttctatctaattttttggtgaattcatatttgaatcgtgtcatgaactaaatatccaaaaagtattagctgtttgggtgaagttcttacacatccatagttaataacaaagcacagtggctgacctccaaaatgctataggggaatagcacatagtggggatgaccagttttatatacttcatcttccattttgcccccttgtacaattcccatccccttcctagacctagagctagcagcatcttttttcttccttccacttgttttctgcgtagtgttagttgaaggctaaccagattcaaatgcatcagcaataggtctctaagttaaattatcaccatcaaaaaccaattcattttcagtatgttctccattttcacccatttctcctatcaacctcacattacaatcattaatgatatcatccaggacaatgggatcaatcatatctcgaatttcataatgatctttcaaagtccaattatacttcacaaaaaccaaatcttgcaacttttggtgcttaagtctgcttctcttagaatgaatctaagaaaacactctgcaatagtattgtgtgtcggccaaagactgctccagcccccatccccactgtgatagtgctgctatcacctgttattgataaatatcaacatgccttaaattatagtcagtgcacagggcctgtactatcttgtttttgaaatttaactttttatttatttagaagaatgtgtaatgaagtttgggctgtagactgcatagtcacaggtggcatgataaatatgtcatgaaccaattattctagaaacttaaattgtagggtgaaggctcatgtatggttgtaagtataacaaactgcttgtaacttgaaatgttttcgacaagaaaactttccattccttgttacaaatagtcatgcttaatgttacgaactatgtttttttagttatttggcatttaagtccttttcctttttatgattttatatccgtacatttatcagtatatttatattcagttggtccatatttggacttgcttccattgtctctttgttggcgtgccccttttttcaatacttaaataaaataaaatttggtaaaaattagtcaattctttgcgtacaaattagttattgcatcttcccctcccccccttttcataaaaattagttaaaggagggttggcaaaattaacgtttaggggtctgtttgcaatccccctaaagttaaaggagctccggtgctttacaattatttggtcctcaaacagtccatattccacccccattcttcacactgttccattcccttgaaatctttccagcactgattctcttgttcattgtcctgcattttctgtactccttagttataaacttaatgtgaaggagttgcttcaaaactgtattcctaagtttcaatggatcaggcttttatgatatatttttgtgaatggtaaaattgttgacttttgtaataactgctttggaagtcatttctagggtgatttttaattggttggcagtgtaaaaaaactttacactgccagtgcatgaaaattaatctctttatctttaaagaagagactcaaacgagtggtcaatgatacctacagaaatattttttctgagataaaatcataatataaatattgctggtgaaatattttatcagatttagaacagaccctattctattcttttgttcattttgcttcaataagcctttttatcatagactatacaataacatgaatattgttggttcgatatattttattgtagaatgagacagacaccactatactttacatttttttttttattgtgctttgaaagttttacatgtgtttttaccatacctgttggtcacatctgagcagttgattttaggtgcaaatggttactccctttactacgtatgaaaaaatttatatactttccttgaaactctagtgtgacttgaatcatatttgtctttcattatcagcgttgttattattttgggttagtcttggattttacatctcttccctattttgattgttcaatttactatcccgtatagttttggtattacaattaatcaatgagttgatattcatttgcagatagtcaagttgatgcagcacaagttttcaacactgccaatttacaaagagcagtagtagaattgcttgctatacgacggtgtcaggaaatcaaaattcaaatataaagaaatgtctattacgttattctggtttttatctaactgtcaatggctagtacacggtgctcctctggtgaggaaggtcaagaattgaagttcccatttctgcttaatcttgaagacttcagtagttttctcacttgttgatgccatttgtttgttctgtaattgttgatgtcttcctcagctcggcgaagcattttcaaatcacatttttgtaagcaataatagtgcaagctgtattaactctttcttcttttggagaacttgtttgtatatagtataatttcaaagcttgtaaaggttttataatagtgactggtatcggatgcaacattttaattaatttagaagcgggtaaattgggcatctggatattaagattactaggatatagccattgttgctaatgatcttgtatgaggaaaatcaaattatgatgaaatggacaatttggttgttatgaatttaacccaataatgtagtagaacaactatggtaaagaaattgtttgcactttgtatgtaga

SEQ ID NO: 220 - DNA, 3557 bp, Glycine max
  misc_feature (3130)..(3229): n is a, c, g, or t
aggattcttttgttttttttgttattattgtgttgttattattgtgagattttcaatatgtcacaaatgcatttatcacataaaatgatatttaagtatatataacaaataatttgatcaattatgtataattagacatatatttacaaaaataatatattaatctattatgttacctaacaaataaagaatataagtaaaattatgtatatattaattatttcaatatataaattttagcacaataaaataaaaaaatgcatacatataagcatgttaagcctgtattttcgctagtatttaataaaatgcatttaatgttagtccatcaatgtcttctatcaagatcctttagaacaatgatcagttagactcatttaaaaaaaaataatttgataattatttttatatttaaataaaataagtcaatgagtgctctaaaaatttttgtttttatttttcacaaattttctataagagtgtgtcttactcacaacctgatggactttaaatataaacatttactggaattcaaaccataattaaccaaaatgtgaaggtatacttctcgttatattgaatatttttaataataatattcaataaaatatatttaatgttcgtcaaccggtggcttctaaccagtgccagtgcccgtagaaaaattattagttgaattaatctaaaaaaaaatatatatcattttttatatttttattaaaaataggtcaatgagtgttctaaaaatgatttttatttttcacaaattttctatatgagtttgtctgactcgcaacagggttggactttgaatgtaaatgtttactccaatgaaattcaaatcataattaaccaatttgatgaactcttttcgttagattgaattttttcaataataatatttgataaaatacatttaatgttcgtcaaccattgctttagaacaaattttagttggattcatttaaaaaaataattttatatactaataaaaataggtcaatgagagtgctaaaaaaataattcttaaggagtacatatttcctctctgtttaatgccttgaaaagtgtagacgagtgctctaaaatgtgttaatcctggtcattcttttagtcctcctcccaaacaagcacgtaggagagagagactatgacatgagcaaccttccaagtttaactgagaggcaaggcttaagtgagttatcattaatccattttctgcgattttctcgagaaaagtgcgtccatttccaattccaaatgtacgtcactcgcttggccatctttcttagtagtagtaatttttgcaccattcccaccatcattttctgttgctcttctttttggcacacacactcctgagaggagagttcagtttcggttctattaattgtgatgatggattctgttctccccgatacttccactaatgccattgcctcttctacacccacttcacaccctcattcccaaccctcactcccacaaaccctcttagtccccaaacccgaacccttctgggatacccacatcgaaacctccgacgaactcgacctctactccgagttcaatcgcgtcactgagctctttcacttcgccttcggagccaccaacgttgtcgaccctttcggagccaccaatgttgcatgccccgaacagactccgctggttcctgttcctcaggagctcgattcagcggcccagcccgacccgaattcgccctccgaggacgtcttgcgagcgatcgttccggtaccgccggagcagcaggacggcgcggtggccaccgccaccgtgccgaggcggaagcagagccggcagaaggagctggtgagagtgatggatctgtctccgagggacgaggctcatttgcgcgagaccgtgaggaggacaaggctcatatacgactcgctgcgagtgttgacctccgtggaggaggagaagcgagtcgcctcagtggcagcggcggcggtggcagcagcagcagcagtgacaacactagagggctgtctgccggtggatggctccaccggcaagttgcggcgtctccggggagacctgcgggctgccagcctgatgagagagcgtggactgtggctgaaccgtgacaagaggatcgtcggggcgatccccggaattatggttggggatttgttcctttttcggatggagttgtgtgtggttggattgcacggtcagatacaggctggaatagattttcttcctgcaagcatgagttccactggagaacctattgctaccagtgtcattgtttctggtggctatgaggatgacatggatgatggtgaggttatagtttacactggccatggagggcaggagaagaattcctccaggcagatctctcatcagaagttggagtcagggaaccttgcattggagaggagtatgcattatggtgttgaggtaagggttatccgtgggatgaagtatgaggggagtgctgctgggtctggtaaggtgtatgtgtatgatggggtgtataggattgttgattgctggtttgatgtggggaggtcgggttttggggtttataagtttaagctttggaggattgaggggcaggctaagatgggtagtgctattttgaaggaagctaggaatgttaggaggagtgagctggatttgaatcccacatctgctgatatggctaacaggaaggagaatgttgcagttcggctttttaatgactttgatgatgatcggggtcctctttgctatgaatatcttgtgaggacttgttttccgaagtttgtgtttcatcagagtgggaaagctactggctgtgactgtgtggatggttgtggtgatggatgcttttgtgctatgaaaaatgggggtgagtttccttacactctgcaggggcatcttgtgagagggaagcctttgatttttgaatgtggcccattttgctcctgtcctcctcattgtcgcaatcgtgttgcgcagaaggggctgaaatataggttggaagtgtttaggtctaagcagacatcttggggagtaaggtccttggaccttattcaagctggttcttttatctgtgagtttgcaggggttgttttgaccagggagcaagctcaactcttaacaatgaatggtgattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattgatatatcctaatcggtttcggaaaggtgggccagaatggggggattgtctcagatatacccggattatgtgcgtccattgtatccgtcaatcctcctctagatatttctctggatgtgtcaacaatgaggaatgttgcttgctatatgagccatagttcaactccaaatgtctgggttcagtttgttctgcatgatcacaacaatttgatgttcccacaccttatgctatttgccatggaaaacatccctcccatgagagagctcagccttgattatggtgtagctgatgagtggacaggcaaactctctatatgtaactga

SEQ ID NO: 221 - DNA, 7901 bp, Glycine max
agatttcaatataataggagtttcacattttttttctctacttaatttaaatattttttgtcaattttattgaattccacttaacaaaactcaaatttgaattgaacaacagaagaaaaaaaatgttttgtattttaataaagtgaaaatattttatccattctttttctcagacactttttcttctttcgtccaaacacgtcagatgtacagagaaaaggtacgaggcttccctattgaaagttggaatggtacggaacgcagaatattctatactaccaaaaccggaaagtattgctttttactggatttggaataatataaaaaggaaaaacacatcatatatttatataaccatccattcatgataggtgaatttgaagagaaagaagacagataaaaaaaattatgaaagggaaaattgataaattttataaataataacatgatgctaaaatgagatataaaaataaataaaacgtatgtagtaatacatgattattattataaaattataaaaagaggtgtaggaatacagaacacatggcttgatggcacaatggagaggaagtggagaatcacgtctgcattctgcagcgccgcttacgcagcacgaatgactgatcgcatagttggtcattcagtgtttttcacgcgcctttcttggaatttggatgttactcgcgcgctgtgaccaaaaaacttctcaaggacgtaaatatcttttgacagcatgtgggaaaaacaaaagttctgcgttacaacttttttccttaaaaaattatcatttattgtactaatatttattatgttttggcctaaacatcttttgacacatgtaatatatttttgctcagtttattattcaaaaacaattttttattactcctaaatttttaaaattttacttttgatgtttatagttaatttttatccatcaaatgataatgtaataaaactaactgaggatttcatcataatcataataatattacatgttaacaaaatatcatatcattattttttttatacagataaaacttacgtagtattacatgattattattataaaataaaaaaaaatataaacacaacacaagaggttatagcaacccatggctaatttttattccaaaaatatttttaattaatagtaatttgtcactttctattgagtggtaatcttcaatactaatttttattgcatgagttgttaaaaatttaattttaattaaaaataatgttaaaactaactaaactattattgctcctaaattttgtttattttgtgattaaaaattaagacaatctttcttaatatgtgagactaatttcataggacagattctgcttgtcataggaccgatttcactccaccacctccttatttattggttactccttaatgtcggtttggctttgccatcgggcaaaagaaaattcccaccaattataaaatgtaatgctgattttaaggcatactatgcaataaccaaatttaaaaactagtaatattgtactgtaccactcttaaatagagatacgcaccttattattgttaattcaattgaagttactgacacaagtaatcattgatgttacgttcgaactcgaaaatttcgctgtaaattttcttacaagtatttatcttaagcctttaatgcgctcacctcaattcatttctacaaacggcgtatttatccataaaaacaaaataggagcaagaaaaaaattagattctaattttaaaattaatttttttaaaaaagataattattttctcttgatattttccttattttttcaccacactctacccagaaagggagtgcacgatattcagtaatcacccactctcactcattcgtaaagttttttctggattctactcatttgtatttgtatagtttactaccaactgcaaataaaaaaaagaaaaagatgacgacctttcttccattcgaaactgttaccttcgctgcaataccagcaatagtacgttgcctctccccgctcacgccaacaacacttcgtaataccaaacaaacattcccttcaatttctctttctctctcaaaaaatgtctcctcgcggtggctccaagcagcaaccagattcacgccgtcaagcgccaccgtccgcggcggcggcggtgccttctcctcccggaagaggacgcggccgtggacgcggagaatcctccgttcccgcgccttctctggtgaatgcaccatctgctcctcctccggcttccaccatcggcgttccgtccggcgccgcgccttttcgtgctgcgttgccacctccggcggtggaatctctcacttccgcggtcgaaaagcaacttacaatgcaaccttcggcgccgtcgtcgtcgaaggcggtgaggttcaaggaacggccagggttcggtcttgctggggagaaaatcaaagttcgagcgaatcattttcaagtccaagtcgccgaacaagatctatttcattatgacgttcgtaaactaaacctaactcatgcattttattcttaacgatttcatcgttttattgtttttagtttgttctgttttgattttctggttaaacgttagtgttgtttgtttgattttttacgtgtgcgattgagaagaaacacctagataatggttctgagagagtgtttattgtatgattaggtctctatcaatcctgagattacttcgaagaaggtttctagagatgttatgactttgcttgtgcaagcgcatcgtgaaaagattctcggaaatcgcataccagcctacgatgggggaaagagtcttttcaccgctggatccttgcccttcgaatctaaggattttgtgatcgtgctaaaagacgacgatgaaccaggctcgtcgtcttcttcctctcctactaggtgcttttttttaaagcgtgtctttgatatttttgtcctcgtcatcattattattattattattattatttgatcaatcgctggttattttttgtttctcttaggaaaaaacgtgaacgcgagtatagagtcaccatcaggcttgcttccagaactgacattcaccacctcagtcagtttctcaggcgccgtcagttggattgtccttatgagactatccaggctcttgatgttgttctgcgtgctacaccgtctgaaaggtagggtatatgctatttttaatattattgatgcttgttgtttggttggtttgattttgatttgttgttttctgtgtcttactgacttttttttctttctttttttttttgtaaaatgtaggttcgttgttgtgggaagatcgttcttctcaccttctttggggaaacctggatcgcttggtagcggaacggagtactggaggggctattaccagagccttcgcccaactcagatgggcctgtctcttaacattagttggttttacttctcttattgttaattgttgtttgttaatacatctttgagtaccttgaataatgctgtctttgtcaactgattatacttgtgttgcagatgtgtcggcgagggctttttatgagcctattcctgtgattgatttcattgaaagtcattttagggccaatccttccaggcctttgcctgatcaggatcgaatcaaggtatttgtgttagattttatgttgttgattgttcatatttaggatacattttgcttatgcatgcctgctaattagttctgtgaaaatgaacaagggttggttggataagtaaatgagcgaactagcttttctatctttcagcttaagagagtactgagaggagtgaaggtagaagtgactcatggaaagaatcttagacgttacaagatcactggagtcacaaaagaacaactcagaaagttaatgtgagcaagttatgctattgcttccattttaattgttgtttttcctatttagattctcaaggtggaggaaaaaacattcacatgggagtaaaatgaatagtgttttttttctctggtctgaaattgaattgtcgcccttctttcctttatcataaattaattagttcatttctatatggcaaaaagtcttctctgttattatacttgatacttgattgcatgtaaaatgcacaggctcgtaatttgattaatctatttattggatgtgttattgtttggtatctttaaggtttactcttgatgacaatagaacaaaaagctcagttgttcaatattttcatgagaaatacaatattgtgttgaagcatacgcttcttcctgctcttcaagctggtagtgacattaaaccaatttttctgcctatggaggtttatctctgccccactcttgctatttatatttatgataaacatcaactagttatttttgcctaagccctgattacgactcgttgttttctattgtagctttgtcaaattgtggctggacaaagatatacaaagagattgaatgaggagcaagtaactaatcttttaagggcatcttgtcagcgtcctcgtgatagagaaaactctatcagacaggtaccttttgtaaagtagtattaatgcacgaatgtatgttgtgtatttgtcttgagactaacattttgctatttgacaggtggtgaggcaaagtaatttcagcacagacaaatttgtgagtcactttggaattcaagtgagggaggatccagcattgcttgatgctcgagttcttcctgcaccaatggtatacatatgattttccttgacataatttgacaagttttattttataacatctaatttttttttgttactgcagctaaaatatcatgacacaggtagagaatcaagtgttgaacccaaaatgggccaatggaatatgattgataaggtgaatctttgaatgtacttttttgtgttgatagaaactaaacaaatgttttaaaaatactgctgtggcctctttgaatgacttaggctattgaagagtatgatttttcttagataaatgatacttgtgtgttctttttatgaaactaagtaatctaataatgatttttatgtggcattcaggttcattcttaaaatatatgttaaaagttattttatctttgtttaagttgtcaatgttctagtgaagggatctgtcatatttatgttagatatgggtagtgtgctatataatgtagtgaatataggaaattataatttattttcaattacagtattgtaaatcacttagttttattatataataatttgtttacagcagaacaaagatttagtcccttgttatattttgtagaaaatgtttaatgctggtgttgtggaacattggacttgcctcaacttttctggaaaaataaacagagagtttccaagtgcattttgtcataagttggccagaatgtgtagtaacaagggcatggtatgatgctagcttgtgtcatttgttagtgtggttatcttatggctgcattgttgagaaatttctttctgtttggaatttataccagcgttttaattcaaagcctttactgcccataacatctgctcaaagtagtcaaatagagagtgctcttgtaaatttgcataagcagtctattacaagactagcaaaccaaggaagactccaattgttgatcataattttgccagatttcgaggggtcctatggtaagtgtcttctatgttcaaactgaacactctaatttgattttatcatgttaaattgttcttgttttggcagaaaaaataaagcgtatttgtgaaactgagctaggaatagtgtctcagtgttgtcagccgaggcatgtttgccagatgaagccacaatatcttgaaaatgtggccctcaagataaatgtgaaggttgaagttatccaataataactctttgtaaactttttggttgctttttgaagttagccaataaataactctttgtttcagtaatttttttggtttcttttaaatattaaacctgtcaatgtttatataggttggtggcagtaacacagtattgaatgatgcaattgctagaataattcctcgtgtgtctgacagacctacattaatcttgggtgcggatgtaacacatccacagccaggggaagattctagtccttctattgctgcagtaacttctctttccagccctatttgcagttttttttattgggtgccatttttattctgtttaattgttgaatgttggtataggtagttgcatctatggattggccttatgtaacaaggtacagaggagttgtttctgctcagactcaccgtgaagaaatcatccaagatctttataatacatgtgaagatcctgtgaaggggaaggtgcattcgggaattatcaggtcctggggacaggggattgatgttgtattgccacttgtaatagaggaatccaattgattttcttgcctctttttcagggagttacttcgcgctttccgtttgtctactaatcagaagccagagaggattatattctacaggttggattttttttaaacttaaatttatatatttttctttttatttacatatttaatataataattgtttttcaatttcaatttgtgctcaacagggatggagtaagtgagggccaattcagccaggttttgctgtacgagatggatgcaatacggcgggtatgaaaaactgctttactgctcttcttgttcatgatatattttccatcttcacgaatgttgtgtgttttatgttttcttgtttcaggcttgtgcttcactacaagaaggctatttaccccgtgttacttttgtggtggtccaaaaacgacaccacacaaggttatttcctgtagatcatggaagtcatgatcagacaaataaaagtggaaatataatgccaggtttttcatctcttgtatttgtatttggcggtattgcatttcacacgtccacccctctctcctccttaaatttattgatttagtgtactttattgttaaagggactgtcgtagacacacacatatgccaccctcgggagtttgatttttacctcaacagtcatgctggaatgcaagtaatacagtactctaagatggattaacttcattatgctattttattgttccaagggcatttgacaggttctctattttgactgtactattttttttttcagggaactagtcgaccaacacattatcatgtgctgttcgatgaaaacaacttcactgctgacgggttgcaaatgtttactaataatttgtgttatacgtaattctccttccacactgctgttttttgctattattattactctactactattatcaatctctagaaatatgtattttaatttttcaggtatgcaaggtgtactcgatcagtctcaataggtttgacacttaacatttttttattccacatatatcttgattatacatttcatccggagttgattttgtttgcagttccacctgtgtattatgcacatttggctgccttcagggctcgctgttacattgaagttgcaacatcagattctggttctgcaagtggaggccgggctgctaactgtgaggttagattgccttcggttaaggaaaatgtgaaagatgtgatgtttttctgttaagcctgtgagatgcttttgtgaagatggggggatattgatatgaggttatgtatgattttgggctttatagagctactttataaacattttgctatcttttttttttttttttaatttgttgctgctacattcaaagttcagttaatatacaaagttcagttagctttcggttcgaatatatcttggcctcattcctagcatcagtagagttgtagctctcacctgaatacttgaatggttttgttgagacacaattggagcaatttttgcagcctggattatggatgtggatttagtcttaatatagtgatgcatttgaagtttcag

SEQ ID NO: 222 - DNA, 7822 bp, Glycine max
agtattagcttttataaaatatacaatttcatgttaaaaaacaaaatatttaagtttttataaatttaaaagaataaattggataaaaataggattaatttattttattttatcttttataattttttatattctttttatacaaaaatttattttgtgaagtaacatttatttttctatggagcaaaacactaattatttagtatatttaagtaaaaagatttacttagtgaaacaattgatgacaatatagatccatccatgattacattgattcttgagtgtcttaatactagtttggctttttttttttttactgttggttccacttcatcttctagcaaaataaaatgttcgccaattattaaatgtaatgctaattttaaggcataagtagcaataaccaaattttatactactactcttaaatagagaaacacaccttatttaaattttcattaattaaatagttaatgttaatcattggaattccaaaattgtataaattttcttccagtaataatttatttctgaaaggtacatttatagctaaccccatattcataacattttactagtatttttttagtaatttcaacctatccaatattatacctatatttttagtgtgctaattttggagagagattttttattcaaaaattactttataattaaggaatctaaatacattagtaattttggagtaatttttttttacaacaatcactaattaaattaattttaaataatattaatttttaaaaacaatcatcatcaaagttaatctttttatgtataatgttccatattttcaaagataattagtatatttttaattatttttatactaaataataaggaaagagtattaatattattattatttagcacatttaatattttagaatatttataatcattaatggtaatagatttacaaaactcataattaaaaaaaaatcatttttttatttatcacattaaatgcccagcaattacttgttattttcattaccgtcaataaattcgttttctttctaacattctgaaagactactttatttattactcatgtgtttatataggataaaaacaaaatactagtagttagaagaaaaaaattctaaatttttaattttacaagtaattttttatcttttatttctttttttttgaaaagataatttattcccatacacttttatcaaaatacagcatatacataaatattactaccattttgaataattataattataatcattcaataattttttttattttatcatattactattattttattattatcttatcatatattccttctattttcaccacactactcaagatggagtgcaggataatcagtaatcaccacttatttgaaaactactaattgcaaataaaaaaatacaaaaaagaaaaaaaaaaggacaacttttaaaattcatttacctgttggtcttctttttctcctttcattgcaagttacattggctgttggtcttctttttctacttataaggtcactactctctccccactcacgcataccacacttccttccctcctagtcaaaccaacaaatattctttctctcaaatcctctttcttactctaaaatgtctcgtcgcggtggctctaaacaacaaccagattcacgccatccagcaccaccgtctgcggcgccttctcccgccggaagaggacgcggccgtggccgcggagaattctcctcagttcccgctccttctccggtgaatgcaccatccgctcctcctccggcttccaccatcggcgttccttccggcgccgcacctgttcgtgccgcgtctccgtctccggcggcagaatctctcacttccgctgtcgaaaagcaacttacattgcaaccgtcggcgccttcgtcgacgaaggcggtgaggttcagtgaacggccagggttcggtcttgtagggaagaaaatcaaagttcgagcgaatcatttccaagtcaaagtcgctgaacaagatctatttcattatgacgttcgtaatctcaaccaccgaactcatgcatttcattctaacgatctcatcattttattttgactttgattttctggtttgaatgttagtgtagtattgtttgttttgacttttttaccggtgcgattgagaagaaacactgagataatgtttctgaaagagtttattgtatgatcaggtctctatcaatccggagattaattcgaagaaggtttgcagagatgttatgactctgcttgttcaagcgcaccgtgaaaagtttcttggaaatcgcataccggcctacgatgggcgaaagagtcttttcaccgccggacccttgcccttcgaatcgaaggattttgtgatcgtgctgaaggatgaagatgaaccaggctcgtcttcttccgcgcctgctaggtgttttattttttaaaacctgtcattaatgtttatgtttttcttgtcgttagctattattagtggtaataataatatttgattgattgctggttatttgtttctcttggaattagaaaaaaacgtgaacgcgagtttagggtcaccatcaggtttgcttccaggactgaccttcaccatctcgggcagtttctcaggcgtcgtcagttggattgtccttatgaaactattcaggctcttgatgttgttctgcgtgctactccatctgaaaggttgggtttatgcttcttttttttttattcatgcgtggtcgttgtttggttcgttcgattctgatttgatttgtggttttcggtgttttactgacttttgttgttgctgttgtcaaatgtaggttcgatgtggtgggaagatcgtttttctcgccttttttggggaaacctggaacgcttggtagcggaacggagtattggaggggctattaccagagccttcgtccaactcagatgggcctgtctctaaatattggttggcttttttacttctctaaatatattttgatttctgtttatatatgtttaattgttaatacttctttgagtgctttgaataatgctgtctttgtccactgaatcatacttgtgttgcagatgtgtcagcaagggcgttttatgaagctattcctgtgattgatttcattcaaatccattttaggctcaatccttccaagcctctgcctgatcaggatcgaatcaaggtatttgtattgggctaccttttgcttatgcatgcctgctaatgagttccgtgaaaatgaacaagggggttgtataagaaaatgaacaatctatgtactgtagattatctggtttatccttttgtaaaggttttcattataattttttctctattgccattcagaaactgtatgcaaccattaatgggaatcatcatgtctttcttttttgctttctaatttgcagcttaagagagcattgagaggaatcaaggtagaagttaatcacggaaagaatcttagacgttacaagatcactggagtcacaaaagaaccactcagagagttaatgtgagcaagttatgctattgtttcccttctttcctttatcataaattaattcttttttaaatggcaaaaaggcttttgcacattagttttgtttggttcgtttcttgaattaataaatttaaaaattcttttctgttgttatacttgacttgattgcatgtaaaatgctcaggatcataatttgattaatctaactattggattttgttctttggtatcttttaggtttactcttgatgacaaaagaacaaaaagctcagttgttcaatattttcatgagaaatacaatattgtgttgaagcatacacatcttcctgctcttcaagctggcagtgacagtaaaccaatttttttgcctgttgaggtttgtctctattccactttatctttttatatttataataattgtaaacagcaactagttgtttttgtttagacttgaatatgattatttatttttattttttattgcagctttgtcaaattgttgctggacagagatatacaaagagattgaatgaggagcaagtaactaatcttttaagggcaacttgtcagcgtcctcatgatagagaaaactctatcaaacaggtaccttcgtaaagtattaatgtactaatgtatgttatgtatttgtctcatgaccaacattttgccatttgacaggttgtgaagcaaagtaatttcagcacagacaaatttgtgtgtcactttggaattcaagtgaaggaggaaccagcattgcttgatgctcgggttttgcctcccccaatggtatacatattattatgcttgaaataatttgacaatttttatttataatatctaaatgtcttttgttactgcagctaaaatatcatggcacaggtagagaatcatgtgttcaacccagaacaggtcaatggaatatgattgataaggtgaatctttgaatgcatttttttgtttttaaataaactaatacaaacgttttaaaaatactgcagtggcctctttgaatgaccaagtctattgaagagtattatttatcttagaaaatgtggtacttgtgtgttcttattatgttgctaagtaatctaataatgatttttatgtgacattcatgttcaatcttaaaatttatgttaagttattttatcatttgtattgtcaatgttcaggtgaatggacctgtcatatatatgatagatatgggtggtgtaatataatgtagtaaaaacagtgaattattagaattaaattaatttttaattagagtattgtaggccacttagttctattatataattaattatttgtttgcagcagaacaaagatttagtcccttgttatattttgtagaaaatggttaatggtggcgctgtgcagcattggacttgcctcaacttttctggaaaaacaaaccgaggtttggcagcttcattttgtcaagagttggccaaaatgtgtaataacaagggcatggtaagctgttagtatgagccatttgttagtgtgttattttatggttacattattgataattttcttttttgtttggattttatgccagcgttttaacttggatcctttgctgcccataacatctgttcatagtagtcaagtagagagtgctcttgggaatgtgcataagcaggctattgcaaaactagcaaacgaaggaagactcgaattattgatcataattttgcctgatttgaagggatcctatggttagtgccttctatattcaaactgaacaccctaatttgattttatcatgttaaatctctcgttttggcagggaaaataaagcgtatttgtgaaactgagttagggatagtatctcagtgttgtcttccgaggcatgtttaccagatgaagccacaatatcttgaaaatgtggccctcaagataaatgtgaaggttgaagttatccaataaataactttgttttggtattttttttttgttttcttttaaatattaaacctgtcattgtttatataggttggtggcagtaacacagtattgaatgatgcatttactagaagaattcctcacgtgtctgacttaccaacaataatcttgggtgcagatgtaacacatccacagccaggggaagattatagtccttctattgctgcagtaatttcccttttcagcactatttgcagtttttttgattgggtaccatttttaatttgtttaattgttgaatgttggtataggtagttgcatcaatggattggccttatgtaacaaagtacagaggagttgtttctgctcaaactcaccgtgaagaaatcatccaagatctttataatacacatgaagatcctgtgaggggaaagacacattcgggaattatcaggtactggggacacgggattgatgtggtatttctgctcagactcaccgtgaagaaatcatccaattgcttttcttgcctctgttttttcagggaattacttcgtgctttccgtttatcaactaagactaagccagagaggattatattctacaggttggatttggttttaactgaattgttctttttattttacattttaatttaaaatttatttttcaattgctcaacagagatggagtaagtgagggccaattcagccaggttttgctgtacgagatggatgcaatacgacgcgtatgaagaactgccttactgctcttcttgttcaggatttatttattttccatgttcatgaatattgctttgatatttcttgttttaggcttgtgcctcactacaagaagactatatgccccgtgttacttttgtggtggtccagaaaagacaccacacaaggttatttcctgcagaacacggaagtcgtgatcagacagataaaagtggaaatatattgccaggttttgtatctctcttgtatttggctgtattgcatttcacatgccccccaccccatctaaaattattaattttgtgtactttattgttaaagggactgtcgtggacactcaaatatgccaccctcgggagtttgatttttacctcaacagtcatgctggaatacaagtaatacagtactctaagatggatcaactttagtatgctattttattcttcctaaggcatttgacaggttctctattttgattctgctatttatgtttttgcagggaactagtcgaccaacacattatcatgtgctgttcgatgaaataacttcactgctgacgagttgcaaatgcttacaaataacttgacttatacgtaattctccttctgcactgctgttttttgctattattatcactaattgccattattatttctctactactattatcaatctaaaaaataagtattttattttcaggtatgcaaggtgtactcgatcagtctcaataggtttcacactcaaatttttttctattccatatatgatcgtgcacatattatcataatttcattcggagtttattctatttttgcagttccgcctgcatattatgcacatttggctgccttcagggctcgctattacatggaaggtgaaacatcagattctggttctgcaagtggaggccggactgctaactttgaggttaaattgccttcggttaaggaaaatgtgaaagatgtgatgttcttctgttgaaggctgtggtatgcttttgtgaagatgggtttgcttttatgagatgctttttgtgaagattggggtggtgggggtattgatatgagattaagtttgtttttgggctttatagttttttataaacattttgctatctttttcttaattttagttgctgctacatgcaaagttcagttatatacaaagttcagttagcttttcggtccaaatatcttggcgtcgttcctagtatcattagagttgcaattttttgcaggctggatgacggatgggaatttaatctttactataatcatgcatttgaagtttcagatagtttacaacttaaacaacattttagcgaagaattgtaaggaataagcggtaaacagagcgttgtgggtagaaaagttgagcaataggaaattatggtcaacttgtaggaaaggcaatgttccgtcagcttgttatattaatttatttaaatagtaattattagttatgttataattataaaatgaagtttaaagttgtagttctaataaaaaaataatatatgatgtagacgatgaaggacaaggtgacaaaaatgcaaacgcgttcaacttttaagactacatttaatcttctttaaatagaagatgatattgatttgtacttttgttatgatcgtcatttggctatttaattggtacacttgt

SEQ ID NO: 223 - DNA, 10496 bp, Glycine max
tatgatatcaattaataaaatttatatgatatcaatttgattaattaaaattatatatataaaagaatttggaactccttcactcagggtcactgcatatccaatggagggttagtgagtgttgttgacttcacattgacgatcctttttttttcctgtctgtttgcttccaatttctcataccttcaatcttcaatcttgggttagtctcagtttcttcattcttttgctcattttttcacatggtgggtgttcatgatcacttcatcatgtttatacccacagaaaatttatctttcacgtctggtttattgttaccgtttgatgtaatgaacaaagaaaactacttattggggttgctagtatggaagaattctgtgtctttctttgacaaagatgctgcctttctgtcaagtttgcctctttttttgtttacgattatactttttttttaatttcatgtgtgatttcttgttattgtttgatgcattgggcaaagaaaatcacttaatggttgctggtgtggaagaattctgtctttctttgacagagatgttgcatttctgtcaagtttgcatttttattttgttttttttatgatcatatctttttcttttttttttgtattttagaagattggagaacagcattgattgagttttaccacacgatcgtagagcttctgatatttttcgaagaggtgagcacatatgaatatttttatgtctaacaattactttgttgggcaggtttttacgaactaaatgggtttttctttccatggtttctttgactaggacgtctttttgggaagaaaatgtaaacgtaaatcacattttgggtggaaggaagagtgagatatcagaataaaaaaaaaaagagagagacggtagagagataaaagtggtagatgtgatagttgtcgtatgattatcaaaatccatcttcttcatggtctcgtgttttgtttatgaattttatcagaagttatttttgttagaggtgttaggaatttttacctttttaagggtcagtttggaaatagagtagaactgagccggggggggggggggggggagaagggtgtgtgtgaaaagttcttggatcatttattttgtaattcacaaaagtaaagaaaaaaaaaatccatcgattagttttgttattaagactgaactcaaaatttatcaattttacatttataccgtgtacaaaaaaggtttaattgatttctatcttcctttgaatttacttctttgtccaaatggctgacagcaaagggttcttgcaatgtttgttgatcctatatagcttgtttgttagtttttaaccaacttttttatgattgaatccacatcacgaactacaactagggctctattgctgcttcttattttgaaaaatgaggtagcataatttactagatatcaagaagaaatgtaatgctaaggtttgacagttttgtgtataccatagactttgtttaatcttctttttgtgtaatttctgtagctttaaattctttgaattttactcctttatacttattgatagcagctggaggacaattaaagttgctgacattgtaatccatcgattatgtagttcctgagataagtggaagctgcctttacatatttttatgaatgaaccatctgtattttgaatctgaatattttcctgaatttatgatctaactgacatgttacattcaaagcaaaggtttctagaaaatgcaggctaaaggttgaacaagttcttgacatctttttttattttcttctttatttttagttcttttgggcaatcagtttatgcaagggaaaattcattttctcttgtggaacattttcccttgaatgttatttaatgtgaaacaaatgaaatagtattaggtattatgatgctaggctacaatcttctattgacaataatttctcaatgttttatcccagctgccacaaccttcctacttatataaataattggaggtgggactcttagcatagattactatgtaactagaattagttttgttggttaatctctatgtagccagagttaatgagttagttactcttgtaactaaccatataaccaactgatataactaactttgtaagctgattcattctatgcaattcattgcttccttcatctctttttctctctaacttcctctgcaagctttgcattcattcattcatggcagacatgaaatttatgagggacttcgataagtagtgctgagttgctaagagttgttttctcttttttctcttttgttttttttatgtctagacataatctaggcttgacaaaaaaggaaggtccagaaatttgttgagaggtattatgcattcttcaaatgaatcaaattgttaaaatacttttaggaaattcagtagaagtatacaattatggtatgtttggaaaaccattggaatgcacttttaagtccgttcacactttccaagagacaaaacatagatgctagattttgtttctccaggtgaaggttggtttccgttgtgatgactgtgaaacagacccactagtatttatctatgtagattctattttgtatctaaagttgtctgtccctgcaaatttgtgttacaattatttcaactgtttgatatatttgctgcttttgaaagatataagggataactactattcttctggcaccataaatatgttttgttatatcaatgtgcctacaaagtttttctgaatatggtttgaccatatggacgctttacatatttaagtatgaaaaggaaaaggttcagttacttttaggaaacttacttgaggacaaaaaagaatgcaatataatatctatgtagattccatatggtttctaaaactgttgctacgccgcaaataaatcttgcacttgttttcttccttttagggatgttgccattttcaaaagacactatgaatctttttaagttttgctgactatggtttgactataaggacctgttgcatatttaagttttacatgcttaacattcagtgtaaagtgaataaattttgaagttgaacctttccactttcctgttgcgagtatgctggatttctatgttgttcattagttcaaaacactttccagtttctatgagtagaatatttagattgttatctgcagtaagaaatgaatatgtggaacacagttatttctcaatatttggttaaaactaagcctacactgtgaacttatgtttagtcgtttagacttcagtgatatttctatcattaagaagtgattaacatgttgcaaatgtagcgaacataaatttaacaaatttggtggatatgctcagcgtataatgtgtatatttaccaggataatgttcgtgaacttcaatctgctttaattatcacaaattgttgtatctgcttgttaatataaattgatatattttaattacttgctgtggaattataatttttccacatctgtattatttcctttttataatttttttcttcttttatccaggaaaggcaaaagagttagcatttaggatgggaaaaacaattgagttgtatggattccctacatctgtgaatgtgtctgatgtaaagacatttgtagagcagtatactggtgaaggaactgtgttcgccattaaattaagacatggaaaaggtcgggttccaagagcatttgcaattattcaattcaccaccgcaaattctgctacatctatgatgtccagagctaacaacattttgagaacattgcggtatgggacctcctatttaaaagctcgggaaatggaaagagatattgtgccaaggccaagggtgtttttgcatagtttggatgatgtgaaactgtcttttggctgtcagatctcaaagggaagattctctgttttatggaaaaagcaggatgttattgtaaattttgggagtggaatgagaaagatgcatttcttattttcccacaacaatgtgcaatacaaacttgagctttcatatgagaacatttggaagattgagctgcatcggccacggaatgagactacacgttatctgttgattcaggttcttaaatttgatttctgaatgaaattaatgaacatgttaaacttccaattggagttgaatcatgacaaatacatagcttggctttgaatccaggagtttgcaattggagtatggcaatattaaatattaagtattaacttgtaagttttgctaagcttgtggcctgtcctgtcgttggactgggtttcatttaccaaaaatgaaaatgctaccaaactgacaattgcagaggctaccaattaaattatatgcctaagcatcctggtgaaaccagaactcagttactaaaaaaacaaaatatacaacaacaaagcatatagtgcagtcttggttatctgttgaatgaactatattgaatgttttgcatgtgttttctttttaacttatcatgttatatctggttttggattgttttcagtaggcatctactcttttagtttagaagagtttttcctttatttctatggcctagattaaatttatctttggaatttatttttttattaaactgtgttggtttactatagaattttcatacaaaaactaagataatatttttaggtttgttgttcaagatgataaggaaaggtggttttaatgtttagaaatggttctgcaattaaaatcaaagtttattgaacttggagcatttatggctactacattaaataatatatagaagaagaaatacatttatggccactacatttcacactacatcttgaaaattagctgttctgcaattttatatgtaattagttgttttcttaatcataagtttctgaatcttctcctacattttgtcttcatgtatgttttctttcagctagtaaacgtaagattatctccgaaatcaaagtagttattttattgtctctcaaattttcaattatgatatttgttacctttcatgttgagcaagttgtcctaattgaaattattccatattatatcttctgcaataatgggtttaagaaattttgttttgtgctaaataagttacagtctattacttatcagagataaaattttatgcaaattaaaaatttactgcattagcttttactgaaaggcaacgttttcatctttaatatatgaactcttatcatcgaattttatgatcgtcttttttctataatcgtattttactatgattgctgcaatggacatatgctgaatcttattcatttcgcttcaattgtcagttacttggtgctccccgggtttttgagaacgatgtacctacatcaacaaatatctttgatgatcctttgttcaacttcttcaaagatgcccctgatgagcaatggatccgagcaattgatttcactccagaaagtcgtattgggcagtcctccgccatatgtctggagcttcctaatggccgacaacttccaaatttcagggaaaactttgcttattatgaggaaagtgagaggcaatacactttacagacaggagttcccttttctcaaaattggggtcttgtccccattgttgctcctcctctaggtgttaaaatatcatatgacatcttgtttaaagtcaattcattggttcaacatgcatgtcttgcaggacctgcacttgatggtgacttctatcgcttggttgatccacgtagaatgccccgtgaatttattgaatatgctttagaaaagatttactattcaaaggaattttgttatgaacccacaaagtggctgactgatcagtacaaaacataccttgagtcaaaaaatcatcctcggtcacctgcaatatccttggatacagggttggtatacgttcgcagggttcagatcacgccttgcaaagtatacttttgtggtccagagatgaatgtctcaaatcgtgttctccgtcatttccgtgaacatattgataactttctacgtgtttcatttgttgatgaagaattggataaactgttttcaactgatttatcatcacgttcacagaacaagaaaactgagatatacaccagaattctttccatccttaagaatggcatagttgttggtgataagaagtttgaatttctagcattctcatcaagtcagttgcgggaaaactctctctggatgtttgctcctacagaaactggatgtactgctgcttacataaggaaatggatgggaaattttagccagattaggaatgttgctaaatatgctgctaggctggggcaatcttttggttcatctactgaaactctaagtgtccatagggatgaagttgaaattattcctgatgtgaagaagcttacatatgatggaaacgaatatgtcttctctgatggaattgggaaaatatctcttgaatttgcccagaaagtggctaaaaaatgtggttatgattgcactccatctgcctttcagattcgatatggtgggtacaaaggagttgtggctgttgaccctaaatcatgctacaagttatcactgaggaagagcatgcggaagtatgattcagataacacaaagttagatgttttggcccgtagtaagtttcagccatgttatctgaatcggcagttaatttctctcttatccactcttggtatcaaggatgatgtttttgagaaaaaacaaagagaaactgttaatcaactgaacactatactaacagattcattaaaggctcaggaagttctggacttaatgtctgctggagagatcactaatgttctgaaggagatgctcatttgtggatacaagcctaatgaagaaccattcctttcaatgatgcttcaaacatttagggcatcaaaacttttggaattgcgacttaaatctaggatctttattccaaaaggaagagcaatgatgggatgtctagatgaaactagaaccctagaatatggtcaagtatttgttcagttctctaacaataggctgcagaatctatctgatgattttttttcatatgatttgccaaagaattatatggttaaaggtaaggtagttgtagcaaaaaacccctgcttgcacccaggtgatgtgcgtgttttacaagctgtggatgtgccagatttgtaccacatggtggactgtgttgttttccctcaaaaaggaccaaggtaaatatgcttcttaaatatttctatttttatgcatgttcaacactattttatagagtgatgtaacatttaaaagttttatccaataaaaaaattagtctctgaaattgaaataaatgaaactggtgaaataatggttacttagctactgtctacattgcttttgtatgtttatgggtgttaataatatgtatgtgataggtacctcttttatatatcttgaagactgggactagaacttagaatttactggaattaaaaggatttagagaaggaacagaaattaaagataacccaagcttgagagaggcagaggctttaaaaatcttaattcaatctttgcatctttgttccgaacactttcctctcactaacactcctgtctccactgccaggtgtgtctaggaagatacaagaaaataccttcgcataaacctttcaatttatttttcctctgatagactctagaaataggagactagccattagtgtgcttaatggatacatgactttactgcctaatatggatgacttttccatattgaaaataattctaaataaatatgatgtgctgtgttgctgctacttgatgatttggatagaagtatggtacttgatagaacattatggcggaagttgatccatgtagccgaccccacctagtgggataaggcgttgttgttgttgttgttgttgtgttgctgctacttcaaaccaaagatgcatccatattcaaaaaaattgttttattttcttctttttttctggactaggtgtcaatttctttgtttcatggagcattgctattttaccctagatggtggcaccttttagtctgtcaagatactaatatctatattttgttactctgtaaagttaatttttcttaggttttctttcatactagaaaatcggctgaatgtataaactgctaggcaatttcagtttattagtttcctgtaatatcatcctttttttttctattggcaatgttacttaagcaactatgagtatgaaatcacacatacaattacatcttatctaaatagagttctgaaaaatatttccatccattaatgtaatgctctgacttctgcctgcacttggcataatacttgttttgtaagttttgttccctgtgaaatgtccagagaattagattgagttccagagaatttgcaagtacctaatattgttttgcaagttttgttgtcatttataatgttattttgcgaagatttctcctggaaaattgaaatgttaatttttctggtagtcaaatgatttataattttcttttaacagacttttttacaccagtcagcagaaaatagactggtgttgatgttgataaactcacctagataaggcttttgttgtttttgtgttatctactgacaccagtaactaattttttatatcagacctcatccaaatgagtgttcgggaagtgatctggatggagatatctactttgtttgttgggaccatgaattgattccttctcgcccaattgatccaatggactatactgctcctgcaactgtggaattggatcatgatgtgatgatcgaggtattgtttttagagcttggctaacataggcactctttcatgtattctttgcatttgtctttggttttataattttgtgtttccactgaaaaatatctttgcagttgtttttgcattctttgttgttgctttgattatgttgccattttgtcatatctatatctttggttttgttaaaatgttgaatggatttccatattccattgttttcccttccacccatgcaaatactgtaatggatgcttacttgttagaatgccttatgtgctagattcataactccatcatctggctagaacagacttattttaaccgtcattgtttgtcttttactacactcccatgtttatattagtaaccacacatttttatccccaaaatttttcaccccttttcctaaaactatcttcatgtctatggacccccacatctttatcttcaatgattccttttctatattcctctattgaaattcaaagaattgtttgtttttgaggtgtcattgttatttaaagtaaccactctaacatgcctctatatttagtaatgactaatgcaatataaaattaattgtatttgttagaccccctttttcttcttgtatttgttttattctgcagaatgatattttagagaatgtttgtgacatgctttccttatgcaggaggttgaggagtattttgccaattacatagtcaatgacagtctgggaataattgccaatgcacacactgtctttgcagataaagaacatttgaaagcaatgtctgatcaatgtgttaagcttgcaaggttgttttcaacagcagttgactttcctaaaactggtgttccagctgttatacctcctgaacttcatgtcaaagaatatcctgacttcatggagaagcctgacaaacccacatacaaatcgcataacgtgataggaaagctctttagggaagtgaaagaaatatcaacaagtgccggctcaattacatccttcacaaagttggttgcgagagactcttacgaccatgaaatggaagttgatggcttcatggattatgttgatgatgctttctatcacaaaaccaattatgactacaagttgggaaatctgatggactactatgggatcaaaactgaagctgaaatcctcggtgggaatattatgaaaatgtcaaaatctttcaacaaaaggagggatgcagaagcaatcaatatggctgtgaggtccctaaggaaagaggccagggcctggttcaatgaaaacagcagtggtgatgtagattcagggagtagtgatgtgtatgcaaaagcttctgcttggtaccatgttacttatcatccaagttactggggttgctataatgaaggcatgaatagggatcattatctaagtttctcatggtgtgtttaccctcttcttgtccaaatcaagaaagagaaactcagcattagaaggtcctctttggaatacagtttcagtgggttgcgtttgagttgacaactttggactttgcactccctattttccagttggatttctgagccaggcagcttgtttatatttttatagtaactatgcatgtatgttctatggtaatgtcgctatataacatgtatgagtgaatatatacatattctatcaaggaatgagggtgtgcacttccattcccttgctttttttaaaattatatataaatattttgaatgtgtagattttgtctttctctaattttttatatttgaacatcttattcttaattttttatttccttcataataa

SEQ ID NO: 224 - DNA, 10496 bp, Glycine max; identical to SEQ ID NO: 223

SEQ ID NO: 225 - DNA, 10496 bp, Glycine max; identical to SEQ ID NO: 223

SEQ ID NO: 226 - DNA, 23580 bp, Glycine max
cttctaaaaaaaacatatgaagactaattttctagccttattggaagacgcgcattcaatgcaagtaaaataataacatttcaattgataatataaaaaataatccaaaattttatggaagcttaattataattaataatgaccattgaccagtcataattaattttcttgactgtctattcacaatcacaacctaacgttacattgtcaatttcacaacataatttttttagttgaattaactactaaaactttcactaaaaaatgataaaattatgagaaataggtgatgtattggtgtaaaaatattttataaaattattttatcataattcattatgtagaaaaaatttgttgacttttataataattacattcaaaattatataaataatgatttgtgtttggttagcaatataaaataacttcatattatcatcaccattaaaaactaaatttatttaatcaaatattataattgtgataaatcatttaagaaaaattacatgcgtttatatgtggtattttttttatataaaaactaataacaaataataatttattgtcaggtttaaagtttaagctttaatacctttatcttgagtttactctggtagcttgagctaatgtgatcatcttctttatgacaaggtccattcatttactaaagtaaataagacgattcaataagctaataagataataatatttgcttttcaattattccctaattactgataaaaaaaaactattccataactgataaggaaattaatcgagtaaagattgattttttttaaaaaaacatattttttaaagtgattataagacattaaattccccatcatttatatataataatacaattcaaatttattccttttattattggataaaaatatttgtctcacggtatacaaacccaatgctatatacatacacacaaaaactaatcttttggtagagataagaaaaatttgatagatgaaaataaaataaacaagtatttttcaatcataaaaaataaaaaataaataataaatgagtgagaataaatgagaaatagaataaaacttaaaagtgtttgattgaagataaaaaagaagagatgttgagagatataagtaaaaatacgtaaaataaagtataactaaatcccacacattttaaaatatttttactttattcacatcttatcaaataaatcaaactatttttcttattttttggtctaccaaacaaagtttaatgatataatgtgttttaatttatggtgaaagatacctaaaataaatgattgttgaataaaaaattacaaattctcatttgtttaaaaaaaatacatcatgaggatgtgtgtcgtttaaaccatacaaacccatataaattttatttctacataaaaagtaaatataaaatttatttataaaaaaccattttgtttggtaataaatactagttacaaaaaacgacacggaggggagttgggaagtgaagtgattcgaaaacgtgcgtggaaagaaaacaaagaacaaagacctttatgcgagaaaaaaaagataatcaatgttgggtcacacacaatcattctactggtcagtcttagtgagcgagcgtgttcactaaggtaactctttatcactcttttcttcgctgactccattatcaacgttttgaacaaaactctctctcttgttattattattcttctttttctcttttcactctcctttgtttgtcctttgaacccacccgtgaaccctccttcaaccgtcatcgttttgatcacatacacccactcttaaaccttcaaactctcttcgccttgggtaatgccggacggagaatcctccgtcgtcgtcgccggcggccaagcttccatggaaccctccttaagcgtctccaatcaactgcagtccctgagtctttcccaagacaaaaaccatgatgactcagtcaagaaagatccccggaaaattgcaagaaagtaagtaactttcgctacccctttgttctttcgattattttcttcactgagtcgcgtttatttttcaaatgggtgtgtggggtttggctttttattttttattttttattttgatttattattattttttactcgtggctgtggtcgttatcgctcggtggggtttgctgttgtagtgagttaattattttttgtttggcttttgagaattggagttcaagaaaaagcctgtttcaagattctacttaaaatgtgactactgaattgaattgcattagcaagctctgttgtgtgtgcaagattgtacttcttgcttctgttaacttttcaactgagtgtttttttaatttctatgctttattccagaaaatgtttgtgtagttcaagaaaatgttcccaatttatggtgatcagatgtctgaattgtgatgtttaatgtgcttatccttttgatttctcacttgtcttctggaactccaataatcttgtgaatgttttgatctttttgaaggtatcagttggagttatgcaaaaaagctatggaggaaaatataattgtgtatttagggacagggtgtgggaagacccacattgctgtgcttcttatgtatgggatgggtcatttgattcggaaaccgcagaagaacatatgtgtctttcttgcccctactgtggctttagtccatcaggtgagctgctgtacatattgttgtgttcaatgttgtacaaagtattgtttttggaagtacaatatttttttttctggaaaaattagaaatctaatggaataaatatctttttttcccccttttatttttgggtgctctgtactttggtcatttcaggttgggtaatttggtcttgcaggtgtacaatccgtaaggcctgtgagaatgactttctgggataaataggcctagcaaggaagtattcttttgtattataactgaacatgaaatttgtaatgagagtttttttcctttatatctttgattgtaatcattgcaattgggtcaatctcaatttcttgccaatctttttgaataaaacattgcttgaatctaattagaaaacttagtgatctacttgttatgtgaatcaagcatggttgttttatgtgtgaatctgatgaattgatctgttcttgtgtttaataatctcccaccaaactttagtgttaactgattttactatgttggtcaattccatcatatgttttctgaagcctattttttatttatctatagcaagcaaaggttatagcagactctactaattttaaggttgggacatactgtggaagttccaagcgcttgaaacgtcatcaagactgggagcaggagattggacaatatgaggtgataatgctagttaaatcatgttgaaattaattatgtttttgtctaaaattattttattgtttatccatacatgttactgttacagcatttttatgtaaaagatgttgaaagaaagttggtttcatcactgaaattttatttaggcaaacaattcaaattagctcctgctattttgaaatcttaaaatctgcttacttaaattttaatccaatggaatttgttgcttctaaaattgctctttgcgatcttgttttttccccttcaggttcttgttatgaccccacaaatattacttcataacttatctcattgcttcatcacaatggagatgattgcacttttgatatttgatgaatgccatcatgctcaagtcaaaagcaaccatgcttatgcagttatcatgaaagtatgatgtactctcactcaactttaaacattcacaatggagctacacaattttccacataaaatctttccatttccatagcctttatttttgacaatatttaatttggcattttttcaggtcttctacaaaagtaattcctcaaaggttccccgtatatttggcatgactgcttcccctgttgtaggaaaaggtaaaataatgcttatcttcaaaaagttgagtactaacaagagcctagatatttgcctgcctcaattaccttttgatactgtcaagtacacacagggtcaaggtatggaagggaggggaaaaaagagaatatagacactgaaaatatactgttatacccttatcgtaatggaggagataagagataaaataaaatcatgggacaacttagtttgtacaatccaaaaattataaaccactttcttttccctctaaacgcccctaaatatcggatgtgagacaaaaatagaagggaagggagctccctcatttccctccaaccaaacaaattgtgctagatgtacgaatttgttggaagaaattataaagtggttgtttgtgaaagcttttattgagaaaaataattgcttgcttttcaaaagttctctctgaaaggggtaatgtaaaagctttttttttactctgaataagctatttcaaacactctttgaaacagttaattctatcaaaaaaaggttcaaggtggggggtgggggaagagaatttgtcacacagaagaaggtcaatgggttgtgtggtctattaatccatttttatacatggatggaataaagtatgaaagatctggacttaagtaatcagtttgttaagttcaccaaaaggcttaccctgccattaacaagcaaatttctttttttaatatagtttgttatgatatattatgcaaggcactattgttgtgcctaggtaaaatgtgtaaatggtatggtgcacctttatatgtgtatacacattctctttatcagaatgaaaagatcttaaatttcagcaaagaggctgaaagagactgactgtataggatgtggtccgcatatagttggactggaaaccatggttaactttgaaaggttaaaatgtgtcaagaaaaagaaaatcatatgatgtgagggatctttttcttgagtatgggacagggggtgaaagggacagactaaggtcactgacattttatataaaattttcaattattgacaagaatttttttaatggaaattttaactggccactttagttttcaatactttgaccttcgtttcattttttttctaggactaggtccatctgatcctgcaaaatatttttgaaaatataaatgtttttttttttttttatatcccactttagtctgttcatcgagagtgttaccctataatttgcctacattgttggtaatatatcctttctttcctttatatattttatgcatatttcaattagcataattgctgaatactgatagtgtagtttattccaaatatgtaaaatcctcttcataatttatgaatttgctagttctttcaattttcaggtgcttctagtgaagcaaatctagcaaaaagcatcaatagtcttgaacatatacttgatgctaaggtagggtccatttagtacaatatatgtcaaaattcttaaatttgtgaacatttgttgtttgtgtaaaaggtattgtgtcaaacttttcctgtgcaagaaagcaattgttctttccattaactattgactagaaaccattgatataatggttgaagtaatgtattggtcaagtgtttgcatgggctaaggtttgtggaaatgtagtatttgagctccatagaaagatattggttatgaactctgttaagattatgttttgatattattcatgatattatatttattattagaatattcaattttctattaattagtaattgattgatcttgtaatcaatattgattcccttttccatattataaatagcatgaggtgcggtctacattgacacacaacattacactaaaacactgttatatggtattagagcttaggttattcttgacagagatccactatccctggtggatctctctgctttgcccgtcttctagcgaccttgtttctgcattccagtgctctgacgaaacttctctccttctttgatgatatgtttttgaatttctggcaacttctcctgtcacagctgtcggccgctgccatctggccacctttttgactggcgaacccacgatttggaacgcccattgtcgatctatccaacaccacccaccgtgcctccattagaaaaccgacaccctgccgacatgccagttctttgcgcaaccaaacaagttctgtttttggtgcgtcggagctctgattaggccatgcttccggtgttgtggtcgccctcccagaacgacgccacccctgcagttttgcatcaattagagcattttttattttatattttatgcccattgtttttcctttttgtgcagccctctttgcggtgattagtattgcgtggctgcggattttgtacaattatggaagatgttgcagattttgtacaattatggaaactgcggattccatccaaagctgcagtttttgtttggaggttacttcgagacagattgcctactaaagcaaacttaaataggcggcaggtggaaatacaggaccaaacttgcccattctgcagaagcacagtggaggatacaccacacctatttttccaatgcagcaaaatcatacctctttggtgggaaaccacgtcctgggtgaacatctccactgtttttccactgcaccaaaggcaacattttgcccaacatatgattgatggggtcaaaggaatttgtgttagtaggtggagggtctggtgggtggcacttacatggtctgtgtggcagatgagaaataacattatattctcaaatgggatcttcaatggaaacaaactgatggaggatgctatatttttgtttttgacatggctaagaaactatgagaaggattttgtaactaattataatcaatggtcatctaaccttatagaggcttttgctgttagataaggatagagctatagggtcttcatacatgtatatttctttttccagtttggttcccttcgagactgccctagtctgcccttgggaaccatcttactggtctctttgtatcggtacctctggtactaagtttcttatataaaattatatctttgttgataaaaaaaaaaagtattgcgtggctgctatgttgcccattgttgaagatcatcacaccatccacatccgcaaccaactcaaaacaccgccgcagcgacccttcgcatggccctggcatgtgaagttcacacacacgacgtgtgacgcatctttggctagcggcacattgatcttctctcccttcgcctcaaggcatctccaatggatctttttttttttttttttcgcgggtgaacagtgcccattgtcatcgtcgaagaccgccacactgtccacgtgcgcaaccaactcaaaacagcgccgcgtgcgaccccatgtagggcccctgtcccgtgaagttcacacacacgacacgtctttagcgaactgcctttagtttctatcgggttgaccacatttgtaacaagctcgattcatatgacatatgcttaagcttgagggggagtgttaagattatgttttgatatttttcctgatattatatttattattagaatatttgattttctattaatcaataattgattgatcttgtaatcaatgttgattcctttttccatattataaataacatgaggcgtagcatctctgattgttgacttctcggagcctcacacactacaacacttctcacagtgacagttcactcaacttccttgttagtcagaatccttcaccggtcataaccctccgtaggtagtccttttcgagaccttgacaatttgctttggttgctttcaggatcaataattgaccccacaaatcaacacgagacttttcatcgtgttttgtcctcacttacaagcttaactgtggagttcttaagtgatgagctatcgaaaagtagatgcatcttgatggtataggtagtatcaattaattcttttaaatcactctctgattataaataacatgaggtgtaacatccttgattgttgacttttcggagcctcacacactacaacacttctcatggtgacaattcacacaacttccttgttagtcagaatcctctaccggtcataaccctccgtaggtagctctttccgagaccttgacaatctgtttcggctgctttcaggatcaatgattgaccccacaaatcaacacaagacttttcatcttgttttgtcctcacttacaagcttaactgtggagttcttaagtgatgagctacggaaaagtagatgcatcttgatggtataggtagtatcaattaattcttttaaatcatccttaactatgtagtcctatatccacacaacctctagaatccctctcattctattgtgatttgtccagggtgttacatgcctaccatcttatgcctggttcgtccttgaaccacaccgtaccggaagagatatctgctctaataccatctgtaacacccctgattgtcgacttctcggccgctcacacactacgacacttcacacaatttctttgttgatcaaaaccctccataggtagtcctttccttgtgtggtctacattgacacacaacattacagtaaaacactgttataaactcttctgcattccttatatttaccttgtatgcaaagtgcattgttcttgtggaatgtggatagtacctagttgtgctgcttgttagatactgggcatggttttactaatctctagtgatttgaatctcatttgtaggtatactctgttgaagacaaggaattgcaatcttttgtgaccactcctgtgattaatatatatcattatgtttcaactgcaagtggggaaactagcttgtacctgaaaattgaggagattaaacgccaggtgcacttttgctatgggttttatgttttaagacaattagataaataaggtttactgatccctgtgcaattttatttgaatagtgcatagcaaaccttggtaggagtatagaagatcaccagaaaaggatgaatgcaaagaaacttctgaaccggatgcatgataatgtgattttcggtctgcagaatcttggcatttggggagcattgcaagtaaaactcttgtagtggattataagttttagttctataatcatttgactagaaatatattagtacaacacaataatgtttttagcagaatctataaataataatacagagaatttttatttttttttgtaatttgttccattttgtaagtcctcctacaggacctgcacacccaaagaaggaaaaacccaggaagaaaaataagcctagaataggctgtggaatttcttggttataatgttaagcttacataaattagacacagtagcaaacactctgcattgattcttgaagatgaatggtttagattggtgttttgtttcttaaagatgatgtcttggtagttggtaccaattcagtttttgctagtgatgtagatgtgatatttgaagataagggaatattatttggaaatcatttagacaagtcttctgaatacatcatttccttgggttttggtgtatttctaatttttcttttacgttttgttatagatctctgggcatctctgttttttctttttaatttttaattttgtccattcctgtggttttccatcatgtttcttgttttattgatatcgggaaatgattttataggttagaagggctgtcattgtcactatcttgatttttattctgtatccttttctaatatgtgttcaccttccaaggctagtcatattcttctgagtggtgatcgttctgagaggcatgagttagtggaggctgaaggaaattcaagtgatgactctctgtgtgataaatatcttgctcaggctgctgaactgtttacttcacaatgcatgataggtattttgacattgcctgatgttcttttaatcatgccacttctgttactaggttttctggctattatgtgcttccattttgcttgatgttaggctaacatttgtctagcaatgaatctgtctttttcattactgttaatttttacgatatgtttgaaatagtgtccttgtaggatagatgcttcatttatattgcaactaaacatactttttttgtaggcgacagggtaactgatttatcttctgtggaaatattaaaagagccatttttctcagcaaagcttttacgactcattgggatattatccaactttaggttgacaaaactatgctgtttaaaccattccttaaatacatgttttcatatatagcacatgtctcatcgatatttggttatgaaactaatatatttgggcaaattctgattacatgttccaacttcaggttgcaaaagaacatgaaatgtataatttttgtgaatagaattgtgacagcaagatccctgtcatacattctacagaagctcaagcttctaagacaatggaggagtgatttcctagtaggagtccatgctggactgaagagtatgtcacgaaagaccatgaacatcattgttgataagtttcgctctggagaggtattactattggatttctcattaatttttaaatacgttattgtgagaactgaaaagcctgctatatgctagttattggttcaataaatgaattaaactatactcctgtgtatgtgtctataagttgcttattctcatagaagattctgtgattttatctgatttgcaatagatgtattgagggaatgtaaaatgtctcttactttgctaaactatgaaatagctgggagctactggagagttttgtaaaaaatattttacctaacttctcttcatgttctttcaagcattattggtgttaaggtggtgaagggcatgtaacagaggataaagataaatgtgattatggcttaaatatgtatatatttcctagcttgacagagagttgagtgctagtttttttttatttttaaattggctaaatcaaatatattaatcagggcaccagaagtgccaatttaaagatacatcagtaatggtgcccaccaaatatcacccaccaatttaaagagttgagtgctagtaatgtcctacatggctcatgctgttaacagttgaatctactggttgcaaccaaagtgggtgaagaaggacttgacattcagacgtgttgcctcgtcatacgatttgatcttccagaaactgttgccagctttatacagtcaagaggtcgtgcacgtatgcctcagtcagaatatgcatttttggtggacaggtactcctactttctaatagatttcagaagtaatttaagaaaattcatccatttggttacctttgaaatcatcttgttgttgcagtggcaataagaaggaacttgacataattgatggctttgagaaagatgaataccgaatgaatatggaaattacttttcgaacatccaaggagacatacataatccctgaggaaagaatattcagagttgattcgtctggtgcttctgttagttctggatatagtatctcattgcttcaccagtattgttcaaagcttccacatgatgagtatgggcttataactgggccattttgattcaaattatatactcaaccaactagttccatgtaaataaagtacaaatcttgtgttttaaaatgtaataatctatctttacaggtactttgaccccaagccatgtttttattacttagatgattcaggggggatttcctgccatataacattgccttccaatgcaccaataaaccaaattttaggtacaccacagttgtctatggaggcttccaaaagagatgcttgcctgaaagcaatagaagaactgtataatttaggcactttaagtgattgtctcttgccaaaacaagatgatgcagagccagaggcgcaggtttcaggctcttctgatgaagatgaatgtgaaggtcaaactttagttgctttctgataagccattactttcattgcctttcactgggttgccaaaaatttactgtataaattgtattttgtaataaactgttgagcatatttacttgtcaattattaaggagagtgagtaatccagcatgttgccgtgctgatcattttcagaccttttaaattctacataatcccttgttggtaattatttttgtaacatacctgtttatggatttagtgttaatcccactgtcagtgtataaacttctacaccatcatccaatcatgtgttgccagatatgtggaagtttttttctcctctcacgtagttattgtcacaaacctttgtcatctcaacttatgtctctagggatgtaactatatcatatgttgtgttgtactatatttattttcctttttttgcagatgccatatcaagaggagaattacatgagatgctagttccttctgcctttggacagtcatggataaatgaggataacatcgtccgtctcaactcttactacataaaattttgtccctatccagaggatagggtctacaaagagtttggtcttttcatcatggttcggcttccaatggaggctgagaaattggaacttgatctccatcttgctcatggtcgatctgtgatgacaaaatttgtcccatttggagttgtagaatttgacaaagatgaggtaaatgatgtttgtgttttattttattttaagaattttaagttaatgcttggagtttcccatcctgcagattaagatggcagagaattttcaagaaatgttcctcaaaattattcttgatagattagaattcgtttctgagtttgtagacttgggtatgggtgctgaatctcacacaggcacatcaaccttctaccttttgcttccagttgtattgcaagaatatggaaatgccatgaaagtagactggaagactgtgaagagatgcctttgttcaccaattttcaggcatccagctgatactatggataaaaaagttttccctttagatattcacctgcaacttgccaatggttacagaagtgtaagagatgtcgagaatagtttagtgtatgccccacataagaagaacttttattttgtcacgaatgttaactaccaaaagaatggatatagtcctcataatgattcaggcacttcaagctatgtggattacttcattgaaaagtaggtatctgtttattattatgggttcatccttgtgttattttggttttgcatcctaattcttctatgttgatgaaggcattcatatttatgggggcttttttaaaattgctgattaactgattgaattggatatatgagaatgtgtatccatacaagttggaatatcatatattgtgcttataatatttgacaaaaatatgcatgcttgaatgtcaggttttccattcacctcaaatgtccagaacaaccacttctacatgttaaaccagtctccaatttgcacaacctgctacacaaccgaaagcatgaggatgcaggtattgtattggatatgttatttttagcattagagtctgacaggagttgtctttatgaaaaagaaaaatagagccaaagctccttacaaccagaaaatattttgaaaaccttggaatgtaaaacagaaactctaggaataaatgtgactgaaaaagagactccacaaagaaaatgtcagccttatggagaactccacttaaatcacgttctaccaaaattgtccctatgctccttcccactataacgatcccccctttatcatttttcacccattcagttaggattctctactattctctttgttcctactcagcatactcatcattcctctcatcttctcccccttgtaccataactaactactcttttggcccattgtccataatctgagctcccctagctgtttcttcatgagtaaacacaagatatgggctacagagcttaattaactaagacatgagaatttggttttcattacctaaactttttactagctagtagaatgacagaaacatgccagaaagatatgtggtagggtgggctcactgctattgatgtgcagcgaggaaggatttgctgctgagaaatggacaatgatatacagatatactatccaaaaattagttcttaagatcgatcctaattgattcttccatatatacatgatatgctaccataaataatctagatattctaatttctaacaatctgtttcctgtgagcatttctttatgattttgtgttagcaatttaaaaagtgtaatgtgcattgactactttcaaatttgtatcttgattttggatttattttgtattctgataatttttcagaatcttatctaaatgtttgtaacttttgaatgtcaatgacagaaccacaggagctggacgaatacttaatttatttgcctcctgagctttgtgaactaaaaataataggtttttcgaaggatattggcagttccatatctttgctaccttcaattatgcaccgtcttggaaacttgctggtggctattgaactaaagcacaggctatcttcttcctttccagaggcagctgaaattagtgcccttagagtaagggcttattaaattcaatgtattatttacattattttctagtagtgtattctttttcacatctaaccattgcagtgcttatatggtacagatgaattttgtttatagcaactaactattgtgaacaaattactaggttttagaagctctcactactgagaagtgtcaggagcgcttttcccttgaaagacttgaagtgcttggtgatgcttttcttaaatttgctgttgcacgtcatttttttctcatgcatgacagccttcatgaaggagaccttacaaaaaggcgctccaacgctgtgaataattccaatctgtttaagttggctatcaagcgcaatttgcaggtagagttataccaacacatccctgcttcatttcctaagtaagaaaatattattattattattgttattcatagtttttctgttagtttagggtttccgcagctgccacatttcatttcaaaacgaaatcacccgctgatgccttcaaagaatgttaatccctcattcagagcagaaggaaaaaagatatacactggaaataattttaataaatagctgattatatatatatatatatatatagagagagagagagagagagagagagggagggagggagggatcaacttatactaagagtaactcttttagagtagcactccatcctcaccattcattttcttggaatctaatggttttatcagttagattccaagaaaatgaatggtgagaatgaggagtaactctaaaagagttactcttggtgtaagttgatctctcatatatatatatatagacacacacactaaaattgtagtggcaatgaaaaacatatagtgcaggatttgagtgtgtctttaatttctagcccaaccctatcattttaggcgatagacacaggactctgtaccagggaaaccccattccctgcactgggacctactactgtgtctcgaaattgtcgagagctaaaatgaaaggttcaaatcctatttataaaattgattcgttcatttgacgtagggtttcctggatgatggtggataagttattttctatcacatactcctaataattaactacctccaatcgattaacagatccttcctaactaacttggatctcagttcccatcaaaataacacttggataacataaatccaaacccagtacaattcctaactgaggattaaagatactggagtttcccctagaactgaatagtagaaattaactgaaccatttagtaaggcttattaccttgataacattttttatctagatatcaggctttataatgggctaatgtatctattttaggtcattgtatatatattaggttgtattattttattctagtctggcccattcagcccattggccatgatgtatatataattctatcttgtaatctttctttttttatcaatagaaaaacactttctctcttcattttcgcagtgcatatttttatttcctgacttgagtcttatctctatctccttgctccctcttgcaggtctatatatgcgatcagacatttgatcccactcagttttatgcattaggccgtccttgcccaagactttgtagcaatgaaaccaaagaaagcatacacttctgtttaaattctgttaaggaacaaggaaaagtaactgaaacccaatgtaacaaaaatcatcattggttacataggaaaacaattgctgatgtggttgaagctctggttggagcatttctagttgacagtggctttaaagctgcaattgcttttctttcatggattggcattcaagttgattttgaagcttcacaagtggttgatatttgcatagcaagtgctagttatttacctctttcttctgaagtagacattccttctcttgaaggtaagctaggacatcacttttttcataagggcctgcttctccaggcatttgtacatccttcttacaataagcttggaggaggctgttatcaggcaagtgtaacttttcttttccctcccaatgttctgacttcatataagaattattttctttactttatagctctatgaattctagtgagacatttgatctttaatttttgaaatgtgataattctttgcagcgattggagtttcttggagatgctgtcttggattatttgattacttcatatgtattctcagcttatcccaaactaaagcctggtcaattgacagatttgagatcattgtctgttaacaacaaggcatttgcttgtctagcggtagatcgcagttttgataaatttcttttatgtgattcaagtggcctgtctgaggcaataaaaaagtatgttgactacattagaagacctgtatcagataacagcattaaagaagggccaaaatgtcccaaggtagatagtatgacctttatataaagttgctacacctggttgttgttgttgttattatgcatttacccatctaagatgaagttcctaaagcataatgtctgtattcatttcaaagtttgctttgggtattttacttggaataatgctactcccgcacgcgtaacctcacatctgtaaagtttccattattttatcatagctgccccctcaccccccaatttcattttttgaacacctacactttgattcagccatctatgcttgatttaaggtaatgtacacccactgtcccacaagatgtgtatcaagcattattcttttacttggatatgacaagagcaaataaatggaaactgaaagagaacccaagctcttgtgcaggcagaagacacacaaaacccatccaaatgattgtcaatatttttacgaaaaaacacaaaagcccagtacatgttgggcgggtagccctcacatggaccatatggcatcacagaaataagacagtatttgagaaccagaccttcatcacaagtaaagtgctggatgatgcacttctcctactatggtcatggctgagggccatggagaaagattttacactgcactacaatcagtggtcctctcagctgagagaaacctttgggtaaataggacaggagggtagttgctaggattctctgtagtagacgtatgtctggtgtaatcctaggtttgggcttagctggtccttaatatgaaccttaggaaagtattagagtccagctgtgtataccttcaacatatgtattttcagtacccctggtactctgcatataatataattatctatttttgctgagccaaaaaaaaaaaactgaacaaatttattattatattgagataagatgacaaatttactttctgctctatgatttctgttatggacatgagtaactcttctaggaacattaggagtctttttattgtccaattcaagcagctcataagttaattaagtttctgatatgtgcgcattgctttgttattttgcatcaaaaggtataacttgacatcatttgttgcttcaggcactgggtgacttagtggaatcttgtgttggtgccatccttcttgattcagggttcaatttgaacaaagtttggaagattatgacttcgttcttggactcaatcatgaaattctcatcaagcttgcagctcagtcctgttagggatttgcgagaactttgccaatctcataatatggagttggagtttctgccagtgccctcaaaattgactaaaaggttttcagttgaagctaaagtgagtgggaatggtgtatgtgaaacagcttcagcaactggtcaaaataaaaaagaggcttgcagaattgcttcactgctacttttttcaaagttcaaggtaaagcaattatgtttagttttattttttccatccttattttctcaactcaacaccttagaattagcatttctttattgtacagtgacaccacaggtgagtatattacttttgtgattcatgtaaacaagggtaataatcattttttaactttctgctaatgtggtgaaatcagttgtgcttataatctttaaatttccaaattctctagttaaggaaacaagtgttctagttttaagatgttccttgtttcttcatttggagatacttttgatctagttcagaataatgcaagagttgttggagctattgatagtaggaactcacacacaatggaacaatttataaagaggaagagagaagatttaggctttgcacaaaagatgcccacacatgcacactatgtctctgttattcacacctttctattttataacaactaataaagttagttagatataactaacttttataaccaaaaactaactattaaaaattacaattaaattatttaaattgcttcacaacattccccctcaatttaaacactctactacaccttagtcaaaacatcagcagttggtaaatctgttggacaatgcactgcttcgatcagtcctgaattcacctgctctcagaaaatgaaactttgcttctatgtgtttgcttcttccatgtgagactgggtttttggccaagttgatgacagacttgttgtctattaggagcttcaactctgatttctttcagcagtgagttaagccaaataactaggcatgcaacatatgccccagctatatattctgcttcacaagaggacaatactaccactgactgtttcttgacaccagaaaacttaaagatataaccagtggtacaccaatcagagtctgaatggccaatcagttctccctcttcctgttttgcttcattagtgaacaatactccaaagttttgagttcccttcaagtaccttagtactctcttagcagctgtcatatgaacttgcttaggtttatgcataaacctattgatcaaaccaactgcatagcatatatcaggcctgctattgcaaagatatctcaaggagccaacaagttgtttgaacagtgttgaatccactgcttcaccttcataactgcttacccatttagggttggtctctgctggtgtagcagttggattgcagtttgccatattaaactatttcaatacatcagcagtgtacttcctctgctgcatcatgatccctttttctgtagttatgaactctatccctaggaagttggtcaatttccgtaggtctgtcatctcaaattcaaatttcatcaacactttaaacctttcaatctcagttgagtcattccaagtcactagtagatcatcaacatagagacaaatgatcactagacttgagttctttcctgacttcacatagactccatattcaacagagcatttagcatactcatgctcaataaaaaatgagtcaatcctcttatttcagcatctgggtgcttgctttaagccgtacaaagccttattcaacttgtagacatacttctctttccctttttcctcaaaaccagggggttgtgttacaaatacttcttcaccaagtgggccatttagaaatgctgactttacatcaagatggtaaagggaccaattgtaacattgaatcttccttttatcgaatcccttctttccatctttgctgttggagaatcttgcagtacctttttgagaggtttctactctatcttcactcttgaatttctcctggtttgaattccaattgcacttatggaattttccctttcctttcttccatttctttttgtcactgctacctttcttggaggtttgggcctgcagagcttgttttgtaggtttcacacttcctctttcgatcaacctcagttcttgagcttgcaattcttcaattttcatgctttcaacatctttggactcttcgataacaactacaatgtgttcaaaacttggaatcaaggtcctcatgatcttctcacctcaactcttcatctgatcggcaagattcaatactctagtgaagtaatctgcaattctttcgctagcttccatttgctgtaattcctattgtcttctcagagattgaagtctcacctttctcaccttatctccacttatgtaacactttgcaaggatgtcccatgcctcctttgctgaagatgatgcttgaatcttctcaaaaatgttggaaactacacactgatggatcaagaacagtactttcccatcccttctgattgcttctttgtgctctgctatttgtgattcagtggaacctgcacctggttctttaatttcagtttcaacattttcaagcacattttaaaatctaaacaagactctcatctgcgctacccattgatcccaattcttaccatcaagtattggaaggtttcctgaaacaccattgttgcctgccattgtttctccttgttgtgatctttacttttctttcacagctacacgaatttacacttgaacctaggctctagataccaatttgttggagctattggtagcaggaactcacacacaatggaacaagttatggagaagaagagagaagatttaggctttttgcacaaaagatgcacactatgtctatgtcattcaccccattctattttataacaactaataaagttagttagatataactaacttttataacagaaaagtaactactaacaattacaattaaattgtttaaattggttcacaacaatagtacctctttttccataaatcagaagcatggtagtaacatcatattttttatgatgtggagttcttgtaagttgaattgctatactagatttggctcccttagtccaacagtttatggacaaatttcattataaattcattttcctttatattttccgtagagttgtctagtgcattatgtttgctttcttcagccaagttctgctctttatataagcccattagcccattcttgtgccaaaacacaattgtagttttttagtttttcaacagtcattttataggagctttattttaagataaataaataaaagggatgagagtggttcatatttactcgcatcagcatattactaatactgggaactagcccttaaatctgatatctccttgattttttctttgacatcatccctgtagagagaaatctgtatttgtgttatatcagtggcaagcactgtcaaaagaggtcttgttattaacaaggaaaagtgcaagtatctgtctagtaccaattattcaagctgcactatagctatatgcaataacaatcatcgtagaaattaagaactaacattaatatcccaacattcctcagtgaatttcttcttcaacatgcataattaaacacaaattccctaagcctagtcccgtattgttgttatataaaacatttggatagatgcattttatcttccctagctacaactccaggaactatattgtttgaattaacggtcatgggtgtggatgtgcaggctcaaggctggaaagcaaagtcaaaaactttggaagaagttctggaatcaacttctaaaatggaaccaaaacttattggctatgatgagactcccattgatgtaacagataccaataaacacatagtggttaatgcagacccatacaacaagtctaacccagaaattcgccctatgcaagagacagatgaaatatgctctccatgtgtgaaacctttcggccaacggcttcaatcttctgctaagggaaagcttagtcaaatatttgaaaatcgtgattgcagcagtgacttgtcagggacaggtagtataaaaatcatagtattttcattgattcggtgtctctgttaatcctaaacattgtttcatattttttgtacaaaggaacggcaagatcacgattgtatgaattatgtgcttcttattgttggaaacctccttcatttgaatgctgcaaggcagagggacctgaccacctgaaacagtgagtaactctatttttttgtttatttgatctttttggtaacatacacatctctacccagatttttatttttaatctttaatattccagtgtttagcaatatttttagcaatttagcctgtgatgtaactgggattagacattttccatctataactttcagactttcagtatcatcagcaactagttttgaataccttattattgatttttgggacattaaaaatgaaatgaaattttaaacatccttactaccaggtttcagctttggaatttcgctcaagatcttcatttcatcctctgaaattccaaagttgacaatagaagttcaaaactagctaccaatgatgatgagaatcacaactaagaaaagaaaaatatccctaaaaacttgtatatattaacatggactaaagtataacaacaagcattaaattttgtagaatggaggctgagcaaaaaaaaaaagaaaaatttgtagaatggaggggtgccctttaaggcctatgtattttaaacatctccatgaaagaaggggttgattttctcattcaaatcagttgcattttctgaatttttgacactggtgatgaatggatgatgataattatagttgaaatttgtaatctttttcatcaacatttagtatatatacaaaacttggttcgcttgcattccccgtcttgtttttttaacgactcttggctcgttcatttcagggtacatagaacttttggtgccttttttttaaaattttttttttcttgacatcagggattctatgttgacaccgccatttctgattattgttccatttttagattcacttgcaaggtgaccttagagatagaagaggcccagaatttgattttagagtttgttggggaacctctttcaaagaagaaagatgcagcagagagtgcggcagagggtgcattttggtatctacaacatgaaggttacttgcctagtagtggtaattgacatattgtagaacaattatcatgtcacataaatcccaaggcaattggtgtaggcaatgtcttgattattgagggtgtcgaatgtgttgttataggtaatcatataatctagaaggcaataatagtacaggtttagtaactcagggccagggagggttccctaatggtaaatctattgtaaaggtattattcatgtatgtattattgtagtgtcaaagttacatctaacattgtatgtaaaccatccctcgattataacagtgaattttctatttactacgtttgaaatgtaaatataagctcgcgagacatttgaccattatta

SEQ ID NO: 227 - DNA, 36332 bp, Glycine max
ataattttcctaagccttgtaatcttttgttaatcacttttaagacatcaaaactagtttaatgtactgttgtaagatataaagtttaggtgtagccactatcttaacttgaacttaatttttaataagtttggtagctcaaattttttactagctcatgaatctttgcaaatgcttccaaatcttgatcattttgtctggtacaaggtcattttagcacttgcaagtcatggacagagttccaaatacaaggggtcctcttttaaaaaagtttaggacattaaaacttatgtatttttttgtgtgtgtcttagatgttttataggttaaaaaagtacagaaaataataaaaggttgagaaaagtttaccaaaaagcttgaaacatgtgccttagtgtaaaagaaccgttgtgagtagcaatggatgtctacattcaaatttttaccattttggtaataaattttagactttgaataaaaagaaaaaaaagtgtgtttagcaattttggtgaaataatttaatttaatataaattaatgtgctaatgatcaaactagaatgttactaacatgtgattacttcacggtatttcagtaagctgtagaagccttatcaaaggcgtgcattcaacattaggtaaaattataacatttcaatcaacaatataaaatatagtaatccaacatcttaaggaagtttaactataattcttaatgaccagtcattattaatttcatcatatacttgactatctattcccaatcacaagctaatgttacattgtctatttcataacatagtctaagttttagttgaattaactactaagttttcactaaaaaaatacataaatttatgataaaataggtggtacattaaaaatgttaaaatatgttataacatcatttaattttaatttattatgcatgaaaaatttgttaacttttattataattatcttaaaaattatataaaataatttataattgattcacaatgtaaataattttatattatcaatgtaacatattaaattcttaatctatttaatcaaaacttataattatgaaaaaatcatttaaatagaaattacatgaaatcaaggtgttgccattgtggtgctcccaatagtatatacatacacaaaatctaatctttattttctctttgatagacataaaaaagtttgattgatgataataaaatagatgagtgagaataaataagaaataaaataaaattttaaaatatttgattgaagataaataaagaaaaaacgagtaaaaacaaataaaaataatacaactaagtcccacaatttttaaaaatgttttcaccctattcatatcttaccaaacaaacaaacttatttcgatttctctccctctttcctatgtttcatctatcaaaaatcaaacaaaggctaaggataatataattttttttatgtcctgatatataaattttatttctacataaaaaaaaaatataaaattgatttctaaaaagccattttgtttggaaaatactagtaacaaaaaacgacatgggggagtgttgggaatgaagtgatgcgaaaacgtgcgtggaaacaaaacaaagaacaaagactttcagtcattcagtctttagtgagcgtgttcactaaggtaactcttcactctcttctccgttgactccataatcaacgttttggttgggaacagaagtgaatgaagtgactacaaacaaagctctctctctgttattattattattattcattttctcttttcacactcctttgtcctttgaacccacccgtgaactctccaaccgtcgtcgttttgatttcacccactctcatacctccaaactctcttttcctcggctaatgccggacggagaatcctctgccgtcgccggcggccaagtttccatggaaccctctttaagcctctccgatcaactacagtccctgagtctttcccaagtaaaaaatcatgatgactcggtcaagaaagatccccggaagattgcaagaaggtaagtaacttttgctacccctttgttcttttgattattttcttcactgagtcacgtttatttttcaaatgggtgggtggagtttggctttttttattttatttttttattgttattttttgcacgtgggcttggtcattattgcttggcgttgtttgctgttgtagttagttagttattttttttgtttggcttttgagaattggagttgaagaaaacgcctgtttcaagattctgcttaaaatgtgactagttgaattgcactagcaagctttgttgtgtatgcaagattgtacttcttgcgtctgtgaaattttcaaccgagtgttttgttatttatatgttttattccagaaaatgtttttgtagttcaagaaaatgttcctaatttatggtgatcagatgtctgaaatgtgatgccgactatgcttatcttttttattcttcacttgtcttctggaactccaataatcttatgaatgttttggtcctttaaaggtatcagttggagttgtgcaaaaaagctatggaggaaaatataattgtgtatttagggacagggtgtgggaagacccacattgctgtgcttcttatgcatgagatgggtgatttgattcggaaaccacagaagaacatatgtgtctttcttgctcccactgtggctttagtccatcaggtgagctgctgtacatattgttgcattcaatgttgttattgtacaaaagtatttttttgggaagtacaatattttttttttctgggcaaattagaaatataatggaacaaatatctttttcctcccttttatttttgggtgctctgtactttggccatttcaggttgggtaattttgtgttgcaggtttacagtctgtaaggccagtgagaatggctttctgggataaataggcctagcaaggaagtattctgttgtattataactgaacatgaaaattttaatgacagatgacctttatacctttgattataatcattgcaattgggtcagtctcaatttcccgccaatctttttgaataaaacatttcttgaatctagaattagagatcttagtgatctacttgttatgtcaagcatggttgttttatgtgtgaatctgatgaattaatttgttctcgtgtttaataatgtcccaccaaactttagttttaactgatttcactatgttggtcaattccatcatgtgttttctgaagcctattttttatttatctatagcaagcaaaggttatagcagactctactgattttaaggttgggacatactgtggaagttccaagcgcttgaaacatcatcaagactgggagcaggagatgggacaatatgaggtgataatgctagttaaatcatgttgaaattaattatgtttttctctaaattattttattttatatccagacttgttactgttacagaaattttaagtaaaagctgttgaaagaaagttggtttcatcactgaaatttaatttggcaaaaaattcaaattagctcctgctgttttgaaatcttaaaatctgcttacttaaattttaattccatgttgttttttgcttctaaaatttctgtgttcttgtttttttcccttcaggttcttgttatgaccccacaaatattacatcataacttatcccattgcttcatcacaatggagatgattgcacttttgatatttgacgaatgtcatcatgctcaagtcaaaagcaaccatgcttatgcagtaatcatgaaagtatgttgcactcttgctcaactttaaagattcaaaatggagctacacaattttccacataaatttttccattttcatagcttttatttttgacaatctttaatttggcattttttcaggtcttctacaaaagtaattccacaaaggttccccgtatatttggcatgactgcttcccctgttgtaggaaaaggtaaaataatgcttatcttaaaaaaattgagtactaacaagagccaagatatttgccttcctcaattatcttccccttgttggtagcagttataatgtggatgtttgtgaaagcttttattgagaaaaataattgcttgtttttcaaaagttctcttggaaagggataaagtaaattttttttttttttactccaaataagctatttcaaacactcgttctatcaaaaaaaggttcaaggtgggagtgggggaagggaatttgtcacacagaagaaggtcaatgggttgtgtggtctattaatccatttttgtacatggatggaaaaaagtatgaaagatctggacttaagaagtcagtttgttaagttcaccaaaagacttaccctaccattaacaagcaatttttttttatatagtttgttgtgatatatcatgcaaggcactattgttgtgcctaggtagaatgtgtaaatgatatggtgtacctttatatgtgtatacattctctttatcagaataaaaagatcttaaatttcagcaaaggggctgaaagagactgactgtataggatgtggtccacatatagtttgactggaaaccattggttaactttgaaaggttcaaatgtgtcaagaaaaagaaaatcttgtgatgtgagggacctttttcttgaatatgggacagggagtgaagggacaaaccaaggtcacagacatttaatataaatttttcaattattgacaagaattttttttaatgaaaattttaacatgtcattttagttttcaatactttgacctttgtttaatttttttttctctaggactaggtccatctaatcctgcgaaatattattgaaataatatacacgtgtgtgcagttttgatggttggctttctgtttatacatatatgtacatatttttttattttgtatttgaaaaatattaactgttacctgctttacttttgggaatgttgatgttccatcatataaatgttttgttgttcttatatcccatttctgtctgttcttcaagagtgttaccctaaaatttgcctacattgttaataatatattctttctttcctttttatattttatgcatatttctattagcataattgctgaatactgatagtgtagtttattccaaatatgtaaaaccctcttcataatttctgaatttgctggttctttcaattttcaggtgcttctagtgaagcaaatttagcaaaaagcatcaacagtcttgaacatatacttgatgccaaggtacagtttatttagtacaatatgtcaaaattcttaaatttgtgaacaatatctgttgtttgtgtaaaagattttttgtcaaacttttgctgtcctttcctgtgcaagaaagcaaatgttcttcccattagctattgactagaaaccattgatataatggttgcagctgtgtattggttgagctccatataaagatatttgtgtctgaactcttctgaattccttatgtttaccttatatgcgaactgcatggttcttgtggatagttacctagttgttctgcttgttagatgctgggcatggttactaatctgtaatgatttgaatctcatttgtaggtatactctgttgaagacaaggaattgcaatcttttgtgaccactcctgtgattaatatatatcattatgtttcaactgcaagtggggaaactagcttgcacttgaaaattgaggagattaaacgccaggtgcacttttgctatgggttttaagatgattagataaataaggtttactgatccctgtgtaattttatttgaatagtgcatagcaacccttggtaggagtatagaagatcaccagaaacggatgaatacaaagaaacttctgaaccggatgcatgataatgtgattttcggtctgcagaatcttggcatttggggagcattgcaagtaagactcttgtagtgtattataagttttagttctctaatcatttgactagaaatatattaatataagtcaataatgtttttagcagaatctataaataataatacagagaaaatttttgttgttatttgttccattttgttggtcctcctacggggcccgcacacccaaagaagaaaaaacctaggaagaaaaataagcctagaataggctgtggaatttcttggttataatgttaagcttacataaattagacacagtagcagacactctacatcgattcatgaagatgaatggtttagaatggtgttttgtttcttgaagatgatgtcttggtagttggtaccaattcagtttttgctagtgaggtagatgggatatttgaagataaggggatgttatttggaattcatttagacaagtcttctgaatacatgttttccttgggttttggtgtatttatattttttcttgtgttttgttatatatctctgacatctctgttttttctttttaatttttattttgtccattcctgtggttttccatcatgcttcttgttttattgatatcgggaaatgattttataggttagaaggactgtcactgtcactatcttggtttttattctttttccttttctaatatatgtgttcaccttccaaggctagtcatattcttctgagtggtgatcattctgagaggcatgaattagtggaggcagatggaaattcaagtgatgactctctgtgtgataaatatcttgctcaggctgctgaactatttacttcacaatgcatgataggtattttgacattatctgatattcttttaatcatgccactgctgttactaggttttctggctgttatgtgcttccattttgcttgatgtgttaggctaacatttgtctagcaatgaatcagtctttttcattattgttaatttttatgatatgtttaaaacagagttcttgtaggatagatgcttcatttatattgcaactaaacatactttttttgtaggcgacagggtaactgatttatcttctgtggaaatattaaaagagccatttttctcagcaaagcttttacgactcattgggatactatccaactttaggttggcaaaactatgctgtttaaaccactcctttaatacatgttttcatatagcacaagtctcgttgatatttggttatgaaactaatatatttgggcaaattctgattacatgttccaactcaggttgcaaaagaacatgaaatgtataatttttgtgaatagaattgtgacagcaagatccctgtcatacatactacagaagctcaagcttctaagacaatggaggagtgattttctagtaggagtccatgctggactgaagagtatgtcacgaaagaccatgaacatcattgttgataaatttcgttctggagaggtattactattggatttctcattaatttttaaatgaattaaactatactcctgtatatgtgtgtataagttgctaattctcatagaagattctctgattttacctgattggcaatagatatattgagggaatgtaaaatgtctcttacattgcaaaactatgaaatagctgggacctactggagagttttgtaaaaaatattttacctaacttctcttcatgttctttaaatatgtatatatttcctagcttgttagagagttgatcgctagtaatgtgcctgcatggtcatgctgttaacagttgaatctactggttgcaaccaaagtgggtgaagaaggacttgacattcagacatgttgtctcgtcatacgatttgatcttccagaaactgttgccagcttcatacagtcaagaggtcgtgcacgtatgcctcagtcagaatatgcatttttggtggacaggtactactttctaatagatttcagaagtaatttaagcaaatccatccatttggttagttttgtaatcatcttgttgttgcagtggcaataagaaggaaattgacgtaattgatggtttcaaggaagatgaataccgaatgaatatggaagttacttttcgaacatccaaggagacatacatcatccctgaggaaagaatattcagaattgattcgtctggtgcttctgttagttctggatatagtatctcattgcttcaccaatattgttcaaagcttccacacgatgagtatgagcttatttaaactagaccattttgatccaaattatatactctgtgagattatgtcttgatattattcctgctgttgtatttattattagaatattctttttcctgttaattagtaattgattgatcttgtaatcaatactgattcatgtttcatattataaataacatgaggtgtggtctacattgccacttccattagtttcttcgtaggaggggaatgaatatcctctcacacaagattttcacataatcgtatcatatgaaaaaattgtctttcttaattttcacatagactaatatagattttgataatatccctcctattcaatgtatatgaagatagagaaataggtacagagagagagagatgagtagagagagaaacaatggggggggggtgagtgtcaggagtggcggtgaggcaagagtgagaggtacagcgagcttccatgcggacccacaacggacatcagcacacaaggatggacagcaacaaggttacagtcgagaaaattggcgggacaagagtgacatatcaacattctacttcacacgatttacagaggacatcacagagaaggaactatggtatcatttcaagaggtggggtgatgtgaaacaagaacgggaggagatttggatttgcaagattcaaaggagtggaggatgcgcacggtttagcaaagaaaatggaccagatggtcattggcggtctgaaactgtacgtgaacgtacccaagtatgggagagacacgaggaggatggcaccggcacaacccaaaacgcagtggcactaacttggaccatttggaagcatcgaaatggggtggtttttgctaatcaaactttcgaaggaagtaaagtgatggaagatgcgatttttctactatggacatggcttaaacttttggagaagggtttcaccctgcatttcaatcattggtcctctcatctcacagcagcgttttgtaattagggaaaaaaggtagttgtaatattataagtatttgtgctgtgtagtagtgtctttcctcagggtcagctggttcttattgcatgtatcttggcattctgaaccagctattaattcaatcctcttatgtatctatagtacctctggtactcatttttataaatgatacttacttttgctgagcaaaaaaaaaaaaatgttagatggaatctgttttcagacgattgcttggatgtcttggagccagtgctgcactcctaagcatatgggaggattggggatcagagatattcaaagtctcaacaaggctttgctgttcaaatggaagtggatgatgttccaccaaccagaccagctttggactagaatcctgaactctaagtataatggctggaggggattggagcatggtcctagaaagcagtatttctctacttggtgggctgacttaagggccatctctcaacatcagaatgtgatcaatgctgataatcaaattaggtggaagctggggagaggcgacaaattcctgttttgggaagatccttggggcgatgaaggagttcctctcaaggaccaattccctgaattattcactatttcttcccaaagggatttaagagtggcagaggtgggatcttggactgagagtaggtgggtctggaatatggtttggagaagacacttgtttgataacgaggtgcagctagcctctaaattcattgatcacatccatcaaatcagattaattaacaatctcaatgacacctggatttggagagctgaatccactggggttttcacatctaaatctggttatcaagttattaaagctgatagggatgatgaaggtcagtacctgggattcaagaaactctgggagattaaactccctcctaaagccctctcctttgtttggaggttactatgggatagacttcccacgaaggacaacttgattaagaggcaaattcaggtggataatgatttatgccccttctgtcatagtcaacctgaaactgcatcccacttatttttcacttgtggcaaaactatgcctatatggtgggaattcctatcttggataaaggaagaaaaggtgtttcactgcagacctttggataattttctccagcacttctcctcagcagtttcaaaggatgctaacataagaaggacaatgtggtggatagcagttacaagctcaatttggaggctcagaaatgatataattttccagaatcaaacctttgatatcactagactgacagatagcactctgttcctcttatggacctggttgaggggttgggaaaggaatttccagattccttattatagttggtcttcaaatatatctatagcttttagttaaagcttctgttagtagggatttcatctgtgtagggtgttgtatctcctgaattttcaggacccttttctgtattatgtagtacctctagtacttgttattacatattacatattatcttcgctttccaaaaaaaaaagacaattaaccaacaacagaaagaaatgctgatggggaggttttgggaggaggaagtaaaagaggccatgtgggactgtgggagtgagaaaagtccaggtccagatggtctcaatttcaagttcatcaagaaattttgggtcaccatcaagcccgatgtccttcgatttttggatgaattctatgttaaggaatgcttcccaaagggatgcaatgcatcctttatagcattaatcccaaagatggctgatccacaaggattgaatgattatagacctatttcactcataggctgtgtctacaagatcgtgagtaaggttctggccaacagattgaagaaagtgatggcttccattatagatgaacgccagtctgcatttataggtggtaggcacctgttgcacaatgtcattatagcaaatgaagtggtggaggaagctaagaggagtcataaaccatgccttgtgttcaaagttgattatgaaaaggcatacgattcagtctcatggaaatttttgaaatacatgatgagaaggatggagttttgtcccaaatggatacaatggattaaggggtgtttatcatctgcctctgtttcgattttggtgaatgggagtccctcggctgaatttacccctcaaagaggccttaggcaaggcaatccactagtgccccttctttttaatattgttgctgagggtctaaatggtttgatgagacaagctgtggagaaaaacatatttagagggtatccagtgggtagccacagagtgagcatcagcctgttacaatacgcggatgacaattttttttggggaggcatcaatggagaacactaaggcaatcaaatcaattttgaggacctttgaacttgtttcaggcctcaaaattaattttgcaaagagcaactttggtgcaattggtatgccggaatcgtggaagcaaaatgaagctgatttcttgaattgtaatctgctgtccattccttttgtgtacttggggatccccattggggataacccgaggagatgtcagttgtgggatcctataattaaaaagtgtaagaagaaattagctaagtgcaagcagagacatatcctttggggggagagttacactcatacattcagtcctaacatctatacctatttattttctttcatttttcaggattcctagaagggtggtggaaagattggtgcgtattcagcgaagattcctttggggtggtggacctgaacacaacaagattgcttaggtcaaatgggaaactgtgtgtctcccaaaagacaaaggggggctaagaattaaggacatcaacagcttcaaccttgcattgctggccaaatggaaatggagcttgttccaaaatcacacaggcctatgggctagagtgttggagtcgaagtatggtgggtggaggggtttagatgaagcatcacgtgattctaatgagtccatatggtggagggatctgaaattggcactccaccatccgcaaactaagaatgcttttcataatggtttggtgtggaagttggggtgtggcgaccgaatcaagttttgggaggatggatggcttcatgatgggacaacattacttgccaaataccctaggctatatcttaattcctgtcaacagcaacattcagcaaatgggagctcataccgacacaggttgggaatgggaccttaaatggaggaggcatttgtttgacagtgaggtatctatggctggcagttttctgggtgaggtggcaggcatacaggttcagattaattgcagggatgattgggtctggttaagtcaccaatattcagcaaaatcagcctatgatatgctgaggggggatatagtacagggagatgatgttgtagattttgtggaattgtggaagctaaggatcccaaccagaattgcagtttttgtatggaggttacttcgagatagattgccaactaaagttaatctgtgcaggcggcaggtggcaattaatgaatcaagctgcccattctgtgggagcgcggaggaggacgcggcgcattttttctttcactgcagtaaaattttacctctttggtgggaatctatgtcttgggtgagcgtatctagtgtatttccacagcacccaaggcatcattttgcccaacatatgactgccggggtggaaggaattcgggcaactagatggaggtcttggtgggcggctcttacatggttatatggcagctgaggaacaacattatattctcaagtgggactttcaacggaaacaaactgatggaggactccctatttctactttggacgtggctcagaaactatgagaaagattctatatctcactacaatcagtggtcatctaaccttagagaggcttttgtttttagacaaggaaagcagtcatagtgtattgataattgtataaccaagctgtctaatgtggttcccagcaagactgctgtcaagtgtctagtctggcttgggaaccatttatctggatttttgttgtaatcacggtacctctggtactcagattcatttctcatatatatatatatatatatatatatatatatatttatttatttatctttgctgaccaaaaaaaatagtaaaacactgttatatactcaaccaactagttccatgtaaataaagtacaaatcttgtgttttaaaatgtaataatctatctttacaggtactttgaccccaagccaagttttcattacttagatgattcagggggaatttcctgccacataacattgccttccaatgcaccaataaaccaaattttgggtacaccacagttatctatggaggcttccaaaagagaagcttgcctgaaagcaatagaagaactgtataatttgggcgctttaagtgattgtctcttgccaaaacaagatgatgcagagcctgaggtgcaggtttcaggctcttctgatgaagatgaatgtgaaggtcaaacttcagttgctttctgataagccattactttcattgtctttcactgggttgccaaaaattactgttcaaattgtattttgcaataaactgttgagcatatttacttgtcaataactatattaaggagagcgactattccagcatgttgccatgctgatcattttcagacctttcaaatactacataatccattgttggtaattatttttgtaacatacctgtctatggatttagtgttaatcccattgtcagtgtataaacttctacaccatcattcaatcatgtgttgccagatcattagaaggttttttctcctctcatgtagttattgtctcaaactcttttgtgatgatacaataacacatgattggaagagagtgtaaaagttttactccaaaatgaatcaaatcaaaattttcttatgtgttgataatctttaatgggaagctttttatttgttttcagatgtagtaccgttactatgttgattactatcaacttatgtctctagggatgcgactatatcatatgttgtgttgtactatatttattttccttttttagcagatgccatatcaagaggaaaattacatgagatgctagttccttctgcctttggacagtcatggataaatgaggataacattgtccgtctcaactcttactacataaaattttgtccctatccagaggacagggtctacaaagagtttggtctattcatgatgacctgtcttccgatggaggctgagaaattggaacttgatctccatcttgctcatggtcgatctgtgatgacaatgtttgtcccatttggagttgtagaatttaacaaagatgaggtaagtggtgtgtgtatgtgtgtgctttattttattttaagaattttgttaattaatgcttggagttttccatcctgcagattaagatggcagagaattttcaagaaatgttcctcaaaattattcttgatagattagaattcatttccgagtttgtagacttgggtatgagtgctgaatctcactcaggcacatcaaccttctaccttttgcttccagttgtattgcaagaatatggaaatgccatggaagtagattggaagatagtgaagagatgcctttgttcaccaattttcaggcatccagctgatactatggataaaaaagttttccctttagatattcacctgcaacttgccaatggttacagaagtgtaagaaatgtcgagaatagtttagtgtatgccccacataagaagaacttttattttgtcacgaatgttaactatgaaaagaatggatatagtcctcataatgattcaggcacttcaagctatgtggattacttcattgaaaagtaggtatctgtttattattatgggttcattcttgtgttattttggttttgcatccctaattcttctatgtcgatgaaggcatttatatttatgggggcttttgtaaaattgctgattaactgatggaattggatatctgagaatgttggaatatcatatattgtgcttataatatttgacaaaaatatgcatgcttgaatgccaggttttccattcacctcaaatgtccgaagcaaccacttctgcatgtgaaaccggtctccaatttgcacaacctgttacacaacagaaagcgtgaggatgcaggtattgtattggatatgttatttttagcgttagagtctgacaggaacagtgttgattaaaaagaaaaatagagccaaagctccttacaaccagaaaatattttgaaagccttggaatgtaaaacagcaactccaggaataaatgtgactgaaaaagagactccacaaagaaaatctcagccttaggaatggagaaccccacttaaaccatgttctaccaaaattgtccctatgttccttcccactatcacgatcccccttagtcattttgcgcccattcagttaggattctctactattctctttgtttcagctcagcatactcatcattcctttcatctccccccttggaccataactaactcctcttttgccccattatccataatctgaggcccccttgatgtttcttcttgagtaaacacaagatatgggcaatagagcttaatcaactaagacatgagaatttagtttttgttacctaaaaccttttacgagctagtggaatgacaaaaacatgctaggaagagatgtggtagggtgggctaatgcgtaaaatatgttaggttcgcacaagaacaagtgtaccctacgcaataataacagtggactcgaaggtccgaatatcaaccccaaagaaccaattgtattcccaattagttaagtttattaaattaataatagagatgattgaaaagaggatttaaatattttcatgattttagtttttataagaaaacaaataaacaaatataaagatagtattagtgtattaagtaagttttactttgtgatttagttaagggggagtatgaggctcttcttaacaataaaacatgggatcttattcctcttcccaaagacagacaaagcgtgggttgtaggtgggtcttcagaattaagtgggctgtaagtgggtcttcagaattaaggagaatgctgatgggactattaacaggttcaaggctaggttagtggctaaaggatttcatcaggttgttggttgtgactttaatgaagccttttctcctgtgataaaacctgttacaatcaggctaattatccctcttgctctcactaataaatgggatttgttccagctagatgtcaacaatgcctttttaaatggccatcttgaacagactatctacatgcaggaaccacaaggcttcgaaagttcagataaaaccttggtttgcaagctacaaaaagctttgtatggcctcaaacaagctccaagacagtggttggataggctcaaaggaactcttttacagcttgggtttgtggccagcaagtgcgatccttcgttgtctgtttattaagacaaagggcacattatctacattcttgtttatgtagatgatattattattactggtacctccaatgtagtaattcagcaactcaccactaagctgcattccaatttttctcttaaacaattgggaaaacttgactattttcttggtattgaaatcaaatcactggctgatgggactattctatggactcaaagcaaatatacaagagatttgcttcagaaaaccaaaatggcataagcacaacctatttcttcccctatgattgctaattgcaagttaaccaaagctgactcggatttattcggtgatccatctctctatcgatctgttgttggtgctcttcaatacacaaccattacaaaacctgagttaagctatgttgtgaacaaggtctatcagttcatggctaatcatatggactctcactggacaactgttaaatgcattctaaggcacctcaaaggctctattcatcatggtctgcatttgaaggctgctccttccttagaggtggcagacctggtggattgctttgacatggtgtatttggcagcataggaataggatggtcttccaaaatgaaagtttcaacagtcataaagtgatggagcatgctctattttattgctgaacctggcttaaaaatctggagaaaggatttgatatcctgtttcacttatggttcagtaacattagggatagttttttgtgttgaggggggatagtttatataatacaagttaggctggatgggtacctagcggttagctagatctttggtttcctaattcaagttggttagcatgtattaggtcactacagttctgcaccttgcaagtgctaggatgtatatacaactatactgcttgtactatttttaatattctatataatatatatatacttttgctgataaaaaaaaaggctgctcttcctctcagccttttactatcaaagccctgtgtgatgctgattgggcctcggatctagatgatagaaggtctacctttggtgcagtgatttattttggtcctaatttggtctcatagtggtccaagaaacaacaaattgtggctagatcttccactaaagttgaatacaggagctcgactcaagccacgactgaagttacatggattcaaactctcttaacaaagttattgttctttttcagaccccagagatttactatgacaaccaaagtgcagctatatcactcataatctagtttttcattcccggactaagcacatgaaaattgacatctttttttgtcaaggagaaagtcttagctaaagagctcaaagtgtatcatattcctgctatagatcaatgggctgattccctcactaagcctttatcaccaactcgatttctttttcttaggtccaaactcaatgttgttgatttctgattctcaaccccattgagtttaaggggagggggggggggggtattagtgtattaagtaagttttactttgtgtaaccagaagacttaatagaaaggccttggccattaccaatgtatatttggtctggccttcaaatggaccaagctgctacatgttttgagactctccagttacgtagaacgatgcacccgaatcaggtatccaagtagtagagttaggatcttgatttttagaattaaccagcattgcactaggttaggagtctttgtgagaattagttccctgattttgttctgaaccgaaggtgtttgatgaattgctttgaaatactggttccatcagagtgagagacgcatttggctcaaaatcagaatcatagcgaaaatgacacatcgttgctgtgtgaccaaatttgaagcaaacttggcactgaaaatttgcataacgaccggggcctttaccgccaccacggcgacctccattgccgcagtcagaatcattgcctccatgactgtagcctccgccgtgattgaagccaccacgatttccaaaataattggatcaattttgtgaattgaaattattcgaggatgaattgtaagaatttgaagatgaattgtaaccttgagcaacattaatcgaaggtgaattagcaaagcgcttctgaaactttttcatgtatgtctcatgtgcgagcaacagtgccactacttctctaatcggaagtgattccaacttacttttgatcattgagatcactggaccgtactcctctggtaggccttcaagaatcacgtcaaggtgttcacgcagaaaaataggatctccacacgatccaagcgcaccgactatgcatttgatgcgcaaaagaaactcacacattgttttctgttcagacattgtagttctgagttctattcgaagtatcctagctttcgcacgtgtttgcttttgaaaatactcatggatctgctcccaaagctgatatgaatgaacgcatctgataattcgagatatgattgaaacttaaagagtcgattggagccacgacaagagaatctgatcttattgttcccaattggtgtatgctggattttcatttccagcttcacaatctgcctctgtgagaaagcgcatcgggatctaaggacttgccacgaaacgctgaagtctatgagccttgatgacagattctacttgttgcctccatagcagggagttagaatcatctaacttctgagaaatcggatgaaaagaaggttcggaagcaaaattctgatttgtcaccatggatagaccttaagctctggataccatcatagagtttgagagagagaaaaagaagaaagatgaaagatattattattgatttagaaagaaaaggtcagttacaaattaattttgtttctctatttatggagaaaacaaatatggttacacataacttgactaaggcagttaactaaccaaagttagttactgctctaatagaaataattgttctaacagaatcacaagtgttctaactgaatcataattgctctaacagaataacaactgctctaactgaatcacaaagtaaaacttacttaataccctaatagagaggtttaagtaacgataagaatgatcaggagttatgactgactgataccaattttctcttaatcctagtcttaatgaaattcccccagttaattatcgattttcaaaatcaactaaaacctatgatcaagattagaagatgtttttttgccttaaatcaataccccaatgatcatggatctatcaatttaatccaaatgattaaatcaattttagggatgattaattaaagattaactaatctattggaattacccaaatagtttggatcatgcaatttggtataaaacattatctaccaattacatgcagaagatcattactatgcaatcgattgagtattaaaatgacccgttccaaataaacattaaaatgaggaagataattaattaacataaaacaatgaagaatttcatttagattaaggagaggagtacaaatggatagctacatcattactctcgaactaaggggactacccatttatgatcagagcaaaactaaagaaatcttagagagagagaaaacatcactaacaaaattgaggtgaagtgagatattattcaacccaaacagaaaccgagtataatacagtttatatagcagttacgatactgtaactgtcaactaacttgagttagttagtgcaactgctgaacagttgtcctaactaattgtcaactaacatagctgtaactgcctaactaatgtaaaccaactatagttagactaacagagtaacataactgtgtaacagcatgactaaatgaaaagaaagagttacactgagtaagtatactcctataaaaactagcaattctatatagagtaaacatagacatacctataggcaggaacaatgatcacgagatccgttctaacggtgttgtccacactcttcagctttcaaaaaccctcaaggttctctcaaattcgtaaaaagataagaataaaattgaatgcctttatttataagtcagagacctctatatatagcttcctaaagataaatacacgaaaatgtgcattacgaccatggtgaatccacctcaccacaaccgtcgtcgaaagtaacactgaagccttgggttatggattgactacgactctcttggttgaccaccgccgtggtgaggtcactcgttatcaaatccttgatgctattctgaaagggctgttatcatttgactatagctgtgttgatgaccatggccgtggtgaatggatcacatccattatcaagtgcagagtcttcaaatcttcataaatttgtgtaatttctaactctttcactcaattgagtgattgtacttttgcaatacaaaactagtatccaaatgtgagttttactaaaaaaaatgcatacaaaatgacacaaaaaatcacataaaataccacccataaagttggtttatcatgggcttactgctattgacgtgcaatgaggaaggatttgctgctgagaagtggacaatgatatacattacagatatacaatccaaaattagttcttaagattgatcctaattgattcttccatatatacatgatatgctaccataaataatctagatattataattttgatttctgacaatttgtgtcctgtgagcatttctttatgattttgtgttagcaatttaaaaagtgtactgtgcattgactactttcaaatttgtatcttgattttgaatttatcttgtattctgatcatttttcagaatcttatctaatgtatgtaacttttgaatgtcaatgacagaaccacaggagctggacgaatacttaatttatttgcctcctgagctttgtgaactaaaagtaataggtttttcgaaggatattggcagttccatatctttgctgccctcaattatgcatcgtcttggaaacttgctggtggctattgaactaaagcacatgctatcttcttcctttccagaagcagctgaaattagtgccattagagtaaggccttattaaattcaatgtattatttacattattttcaagtagtgtattcttattcacatctaaccattgcagtgcttatatgggacagatgaatcttgtatacagctactaacaattgtgaacaaattactaggttttagaggctctcaccactgagaagtgtcaggagcgcttttcccttgaaagacttgaagtgcttggtgatgctttccttaaatttgctgttgcacgtcatttttttctcatgcatgacagccttcatgaaggagaccttacaaaaaggcgttccaatgctgtaaataattccaatttgtttaagttggctattaagcgcaatttgcaggtagagttatactagcacatccctgcttcatttactaagaaagtataattattcttatttattgattttctgttagactagggtttccacagcccccacattccatttcaaaacaaaatcacctgttgatgctttcttagaacgttgatctctcattaagaccatgagaaaaaaagatatacgtgggaaataattttaataaatacctaattaattaatatatatactaaaattatattggcaatgaaaaacatatagtgccggatttgagtctgtctttaatttctagctcacccacccttatcgttttaggagatagatagacacaggactctaccaggaatcccccatttcctgctctgggacctactactgtgtctcaaaattgttgagccaaaatgagaggttcaaatcctatttatgaagttaattcatgcatttgatgtaaggtttcctggatggattaaatggtggataagttcttttctatcacataaactcctaataattaactacctacaatcctttaacagatccttcctgactaacttggatctcagttcccatcaaaataacacttggataacataaatccaaaccctatacaattcctaaccgaggattaaagatactggagttttccctagaactgaataatagaaattaactgaaccatttagtagggcttattaccttgataagatttttctatcaatatcaggctttagaatgggttaatgtatatattttaggtctttgtatatatattaggttgtgttattttattctagtctggctcattcaacccataggccatgattatatattattctatcttgtaatcttttattttttatcaatagcaaaacactttctctcttcattttcacagtgcatatttttatttactgacttgagtcttatctctatctcctcgctccctcttgcaggtctatatatgcgatcagacatttgatcccactcagttttatgcattgggccgtccttgcccaagagtttgtagcaatgaaaccgaagaaagcatacacttttgtttaaattctgttatgcaacaaggaaaagcaactgaaacccgatgtagcaaaaatcatcattggttacataggaaaacaattgctgatgtggttgaagctctggttggagcattcctagttgacagtggctttaaagctgcaattgcctttctttcatggattggcatacaagttgattttgaagcttcacaagtggttgatatctgcatagcaagtgctagctattcccctctttcttctgaagtagacattccttctcttgaaggtaagctaggacatcacttttttcataaaggcctgcttctccaggcatttgtacatccttcttacaataagcttggaggaggctgttatcaggcaagtgtaacttttcttttccctcccagtgttctgacttcatataagaattatttcctttactttatagatctatgaatcctagtgagacatttgatctttaatttttaaaatgtgataattctttgcagcgattggagtttcttggagatgctgtcttggattatttgattacttcatatctattctcagcttatcccaaactaaagcctggtcaattgacagatttgagatcattgtctgttaacaacaaggcatttgcttgtctagcggtagatcgcagttttgataattttcttttatgtgattcaagtggcctgtctgaggcaataaaaaagtatgtggactatgttagaagacctgtgtcagataatggcattaaagaagggccaaaatgtcccaaggtagatagtatgacctttatataaagttgctacacctggttgttgttgttgttgttatgcatttactcatctaagatgaagttcctaaagcattatgtctgtattcatttcaaagtttgctttaggtattttacttggaataatgctactcccacacacgacacctcacatctgtaaagtttccattatttgatcatagctcacctacactttgattctgccatctatgcttgatgtaaattgatgtgcacccactgtcccacaagatgtgtaccaagcattattcttttacttggaaatgacaagagcaaataaatggaatactaaaagagaacccaagcccttgtgtaggaagaagacacagaaaacccatccaaatgattgccaatatttttgcaaaaaagcacaaaataagccagtacatgttgggtgggaaagcctgacgcgtgacagtcaactgaacaaattatttattatattgagataagatgacaaatttaccttctgctctatgatttgtgttatggacatgagtaactcttctaggaacattacgagtcttttgtttgtccaattcaagcagctcataagttaattaagtttctgataggtgtgcattgctttgttattttgcatcaaaaggtatatggggtataaattgacatcattggtttcttcaggcactgggtgacttagtggaatcttgtgttggtgccatccttcttgattcagggttcaatttgaacaaagtttggaagattatgacttcattcttggacccaatcatgaaattctcatcaagcttgcagctcagtcctgttagggatttgcgagaactttgccaatctcataatttggagttggagtttctgccagtgccctcaaaattgactaaaaggttttcagttgaagctaaagtgagtgggaatggtgtatgtgaaacagcttcagcaactggccaaaataaaaaagaggcttgcagaattgcttcacagctactttttttaaagttcaaggtaaagcaatcatgttaagttttattttttccatccttattttctcaactcaacaccttaggattagcatttctttattgtacggtgacaccacaggtgagtatattacttttgtgattcatgtaaacaagggtaataatcatattttaactttttctgctgatgtggtgaaatcagttgtgcttatattccttaaatttctaaatactctagttgttaatgaaacaagtgttctagtttaagatgttccttgtttcttcatttggagctacttttgatcaagttcagaataatgcaatagtacctctttttcccgaaatgagaagcttggtagtaacgtcatattttttttactgtggagttcttgtaagttgaattgctatactagatagattggctcacttagtccaacagattatggacaaatttcattattatatattcattttcctttatattttccgtagagctgtctagtgtattatgtttgctttcttctgccaagttctattctttatataactttagtttgggccaatcgaaaatagtactacctccaatcctatatataagaaacaactgtctaatttatcaagatcagtaaacgtggttagattggttaacttgtcataaattttaattttattccaaaatggtacattaaatgatttaagagataattattttttaaaagataatttttcaacctatgagtataccttgcgttaagaagagagtgagagaagcaaagctattttgaatatgtctttctgggttttatcttccacccagtcaaaatgattacatggataataaataactattcttgttttcaagagaacaattaaaatatcacaattttctaagatacattgaacccaactaactattaactaagctacttgaaaggaaattatcattaaatgctcctcttttcaacactccccccaagctggagaatagattttatccattcccagcttgtataatattctatcaaaatttggagtgtgcaatcctttagtgagaatatctacaagttgaccttgtgaaggcacatatggagtgcaaatcaaaccactatccaacttttccttgataaaatgtctatccacttcaatgtgttttattcgatcatgttgtacaagattatgggctatgctaattgctgacttattatcactgtagagcttcataggtccgtcccatttaatcttcgagtcttctaagatgatttttaaccaaagcaattcacaaataccttgtgccatagcccaaaattcagcttcagctctagattgtgctacaacatcttgttttttactctccaagttaccaagtttcctcctagaaaggtacaatatttggaagtggatttactatcagctattgatccttcattgttagcattcgtataagcttcaagtattgtattcccatttcttttgtacaaaattcctcttcctggtggtgtcccctcaaggtaatgaagaattctataggtaacttgtaagtgaacttctcttggacaatgcataaattggctcaccaaactaacagcaaaagtaatatcaggccttgggtgagacaagtaaatcaattttccaactagacgttgatacatctccttatccgcttctgcaatgtcatcttcattacccaatttaaggtttgaatccatgggagtacttagagatttacaagctgtcatgcatgtctccttcggctaatctgtgacatatttttgttggaatatgaaaatacctttcttggagtgggacacttcaattcccgaaaaatatttcagcctcccaagagttttcatctcaaactcctttgctagatgctgacttaagagtagttgttccttccaatcatcactagtaacaatgatatcatccacaaatactaacaatacagtcactccccctgaggttgagtgtttgatgaataaagtgcggtctccttggctttgtttgtatcctaaggctgtcatgaccttagtgaatctcccaaaccatgtctgaggggattgtttcaacccatataaagtctttcttgactggaaaatagaattggcagcatcttcatatccaggtggaacctccatatagatttcctcctcaagctccccttgcaagaaaacattctttacatcaaactgttgtaatttccagccataatttgcagcaagagataatattactcgaactgtattcatctttgcaacaggagcaaaagtctctgagtaatctatcccataggtttgtgtgaaatccttagcgaccaatctcgccttgtacctctcaatcgacccatctaccctatattttattatatacacccacttgcaacccactggtttctttcctattggcaaagaaaccaactcccatgtcttgttcttctgcaatgcctccatttctgtatccatggcctgcttccaatttttatcaggtaatgcctcaaaaacattagtgggaattgagatagagtttaggtttgcaagaaaggttttataggttggagagattttatgaaatgaattgtaatttgagagaggatagaaaggctttttggtacatgttctggttccttttctaaaggcaatgggaagataaaggtcgtcattatgttctgaaatttccatttcatttggagaagctaaaatattatcattcaagattggaaaatcaaagttagttacctgatctaaaggagttggattggcctcttgggcaagttttgatttagaaatggcctttgatcttcttgtgtaaaccagattcttcccaaaccttgtatcattttcaagtctggtgggtgcatccttgttggattcattttgggctaatgtttcttgcttaggtttttgtgtaagatcacaattccttgtcctggaatacacaacaatggtcataaaaaacaataatacaagatatgtcatttgtatgtttctgaacagagacaagatttgtggacaattttgggacatgcaaaacattttttaggttttgaagggatttatttggatgtttcctataccggctatagttacaagagtgccatcaacaataattattttcttattgctaggacatggagaataggtggagaagatcatatggtcagtggctctagaatctaaaacccaaagggatggaaggattttttagacattaatttcaaatgaaagaggaagtatacctgaatatgccaatgtacaagtacttgatggtttttcaaggttgctaaaaaaggctctcattctttctatttttcaagcagcaggaaaaattattggaaaactgagtcgccggaattctaacagtcgctggaaaagtctccggaattttggcagttatcggaaaagtttgacagcttcaagagcccagtcaaacttgctaaataaccaaccctttttgtgcagaagcagagcacccctagatcaggagctctgatattattcgagaaaatgagagaaagaaagagagaaaacgagagagaaaggaaaatgatattattgtgatctgaaaagttagttagaattagttacaacagaggtatatatagacctctgaccctctgaactatcactaacagactctgacttcctaatactagtgaggtgttgttagcaaaagctaatagaccttacaaacatataatctgatgtctaacactagaggggtgctgttagcaaaagctaacggcccttacaatcattctataaaactgttttcacagttatacaagtacttactctaataccccccccccccccccccctcaaactcaaggagaagagttttgagaagaaacactcttcacattgaatttgtccctgagaacttcaaatcttgctgcagaaagaggcttggtcagtacatcagcccactggtccagagctggaatatgcacaatggaaagttgcttggccagaatcttttctcttacgaagaagacatcaattttcatgtgttttgtacgaatgtgaaacacaggattgtgagcaataggcacggttctctgattatcacaaaagattataggagtagtgaatggaacttgaaactctgttaggagagcatgaatccatgttaacttagtggaagtttgagttaaaatgcgatactcagcttcaatactagacctgacagcgaccttttgtttgcgagaccaccaagatattaagtttggaccaagaaatatggcagcccctgaggtggaacgcctgtcatccacattggatgcccagtcagcatcacaacagaacacgcgaagagccaagggcttggtaacagaagtaggctaaagaagtagtccatgaaacaaagtacccttgagatacctcaagattcttttcagcaccgcctagtgagagtttagagatgcagccataaattgacaaactttattgacaacaaagttgatttcaggcctagtaagagtagcatattgtaagacaccaactatagacctgtatagagttgaatcatgaaagatatcaacaccatgtcgagataacttgcaattagagaccatgggggaagaaatagaataagctttagttatgtgagttttgtggagtaaatcatgaatatatttactccgagtcatcaatatggagttattgggtagatacttgatctctagacccaaaaaataatccaaatgaccaagttgcttgagagagaatgcaatgtgtagtttggttgtgagctgctgaattagagaagcagtgctacccgtgatgatgatatcgtccacatatagactaaaagatagacaatatgcatttgttgctcgtagatgaaaagggaagaatcacatttgctcccaacaaatccaaactgcagcagagtaaatttcagtctatcaaaccattgccttggggcctatttcaagccatagagagctttgttgaacttgcagactagggacctatctgtaacttcaaaaccaaggggttgtgtcataaatacagattcttcaagaagcccatttagaaaagtcttattcgcatcaagctgaaacaacttccacccatgtgacagagcaagggtgagaacaatatgaatggtgacaggcttgaccacaggagaaatgaaaatcaaagccatgaatttgatgaaatcccttgactaccaaccttgctttgaacctattgatggaaccatcaacattttcctttactttgaaaatccacttacacccaatagcttgtccattggaaggtaagggtcccaagttttgtttttcaacaaagcaccatactcttgttgcatggcagcaagccaatctggatttttcaaggcttgtttcacagttttgggttcagaatgggtaagaaataaaaaaggatgtagtctaggattgtgaattccagacttgaaccttatttgcataaagtgtgtattatctggtatagaattaggtgctgaaacagactcagaagaggatgcactaggggtactggattttgaagtttgaggatgaacagaggtaggctcagaggaagtggatgatggacaaggcacagaaaaagaggttgtgggggaatgagttggaataggggaaaaaccaaagggaacaagaggtatagaaggagaatgaaagggagacaattgagaggattgaggggtaggaataacacaaggtggagataggttgggattaaggctgaagtaggaatcaagattcttaatggggttagaagatgaaggaaacatgtcagaataagggaaccttaattcattaaacagaacatctttggaaatattgattctgccaaatgaagacaaacatttgtaacctttgtgggaggaggaataccccaaaaataaacactcctgagatcgaaaatttagtttgtgtgtatggtaaggcctcaacaaggaaaacaggcacaaccaaaggttttaaggaaatgaaaatcaggatccttgttaaaaagagtaacaaaaggaatgacaaagttgagggaagcagtgggaactatgttaattagatagacaacagtagtaaaggcataatcccaaaattgtaagggtaaagaagcatgatgcaacaatgtaaggcccaaatcaactatatgtctgtgctttctttcaatcacaccattttgatgatgagtgtggggacaaatgagtctgtgggagatgtcataggaggttaagagagtagagaaaagtttgtattcacccccaatcaaattgaatactcttgattttgcagttcaaccatagatttggaagcttgaaaaacagaaagagtttcagccttaaactttgataggaaatattcaggtgtacttggcaaaagcatcaataaaggagacataatatttataaccagcatatgaagtcaaatgagaaggtccccacaaatctgtgaaaataagctccaaaggagagtaaacagaaacaaaagtgtgagatggtaatctatgagatttttccatacagcaggaagaccaaaaacctaagaaatttttatttgatggagaaattttacaatgattgaagacaagtttcattacatgaccattagggtgacctaatctaacatggtagaggctagcagtactagaagaagaaacaacataattagaaactacactagagttattattaacagtagcagttggatagacaagtcagtatctgaaattgaggttgaggtagacaacaatagaggagagttgtcttgaagcttgagattatgaaatgagtaaagaccatcagtaccaacaactccttgaagaaggactttattggtctcctgagatttcacaagaacaagtgaggatgaaattcaaagaaaacaaagttatctttagcaaattgactcacacttaacaaattttttgaaattgaaggaacatgtaataacttgtgaagtttaaatgttatgtgagcatcattggaggacacaaaagaagaggaaccaacactggagatactcaaaccttcaccattgcctatgaaaatttgatcaggtctatcaaagtgagtgaattggttgatattctgtgattcaccagtcacatgaaagctggctccaaagtctggaatccaggtagagccatcaggaccattcccacaagaggaggaatttgtgagcatagcactgggttgattggaggttggaacaacagccttggaattaggactaatccaggtattggaagttctgattgaaccagtggagttgggaattggttgaagtgtggtaggatcaaagaaggtgagtgattcatgaggctaaaaactcatattagacctaaagtggcaaacattggcaatgtgtccatacataaggcaaatttaacactgaaagttggcaaatcgaccaccatcacgacctctgtcggagccaccaccaccacgttcgacaccgcgatctggaaaatcaccacgacaaccgccacgaccatacgaacttcgagaaccagcaggatcaccggatttataagaattttggtgcgaatagccttgagtgtaattcaaggacggagaacttagcaccttgttagacttttggcaagcgtaccaatgttgttgcaggttacagatttataaaaagagattgtctccacaaggagatgagttactcaattccgccgaataaaagtaaacagttcaatagttatgtacaaatttaatcgagatatcatggatttgtctaactaatgaaaaataattgacgtaacagaatgacggaaataacagaatttagtgcgtcagaaatacgtaaaattatggaaacaataataatgaatctaattaatttaagaaaaatgtaggattggatttcatcgttctaataagattaacatatatgaatcattttctaacattactaatgaatacattaaattatcccaaatcaatccctcacactcatgaatcctaagaatatttactgaatatcgatccctctcactcaagagtcctaaaaatatttaccaaatattgatccctcgcatatgaagtaaataacccagcattacaatcataatctcgtgctatttgcaatcaaaacgtaatgctctattcctagcaatgtaacgtaaagataaattcattaagttcaaattctaagtattttccggtcaaacttaaaatccaattttatgaaattagtgatcaaatagaatcaagcattacgaacaaaatgaaattaccaataatgagtagaaaagattcatacatatataaaatatcaaaaaagatacataagggtacgaagattacatccaatcttttggagaaactagctgatcattgcgtagagcacaagatcaacaagagaaatgacgccagcaagttcatcatcatagcctttaattttacgcaaatactcatagattgatttaccgtcaagcaaaaccgcgcgcatcgcaattcgaagctgtcgagcatgagatttcttatgaagattgaagtactcatgaatcatctcccaaacttgataggagtgattcgagtcaagaatgcgcgatagaacgggtttcgagagagtagattaaagcaaaacaaggagcgtttggtcctaaacttcccaagcttcataatcaagattcatgcaatcaacaatgcgatcatccttcgtgagataacaaggcagaacgacgggattgacgatgaaacactacaatttatgcgacttgataaccggttctacatgttgccagtggagatagtttgagtcatcaagcttcttggtgatagagtttggaacgactgagaaacgagattcaaaggagcggaagctatggatgcacggatctggaacttcagaaggaacaataactacaaaaaaatggctctagataccatattcgagaaagaaagagagaaaactagagagaaaggaaactggtattattgtgatctaaaaacttaattagagttagttacaacaaaggtatatatagacttctgaccctctgaactaacactaacagactctgacttcctaatactagtgaggtgctgttagcaaaagctaacggcccttacaaacatataatctgttgtctaacactagaggggtgctgttagctaacagcccttacaattattctagaaaactattttcacagttatacaagtacatactctaatagataccatgttaagaagagaatgagagaagcaaaactattttgaatatgtctttttgggttttatcttccacccagcagattgatttatttataatcagaatgattacatggataataaataactaattctgttttcaagagaacaattaaaatatcacaacttcctaagatacattaaacccaactaactattaactaagctacttgaaaggaaattatcattaaatgctcctctttccaacaccttgttttgttgatagttcataaatgcacccactttcatgggaaaatgagtatatatcattgatagacctcacagttaattaggagtaaaaaggaaatttaacaataaagtagttttatgtttcttataattaagaccaagaaaatgttgtcttttgttacttatatagaggatcggaggtagtatcttttaaaacccattctcgtgccaaaacacaattgtagttttttagtttttcaaccgtcattttataagagctttcttttaaaataaataaataaataaaagggatgaaagtggttcatattcacccgcatcagcatattactaatactgggaactagcccttaaatatgatatctccttgatttttttctttgacatcatccctgtagagagaaatctgtatttgtgttatatcagtggcaaggcactgtacagagaggtcttgttattaacaaggaagagtgcaagtatctgtctagtacaattattgaagctgtagtatagctatatgcaatgacaattaatgcagaacttaagaactaacattaatatctcaattctcaacattccttggtgaatttcttcttcaacatgcataattaaacacaaattccctaagcctagtactgtattgttgtacaaaacacttggctagatgcattttatcttccctagctacaactccaggaactatattgtttgaatttaacagtcatgggtgtggatgtgcaggctcaaggttggaaagctaagtcaaaaaccctggaagaagttctggaatcaacttctaaaatggaaccaaaacttattggctatgatgaaactcccattgatgtaacagataccaatactgccaagcacatagtggttaatgctgacccgtacaacaactctaacccagaaatttgccctatgcaactgacagatgaaatatgctctccatgtgtgaaacctttcggccaacggcttcaatcttctgctaagggaaagcttagtcaaatatttgaaaatcgtgattgtggcagtgactcgtctgggacaggtagtataaaaatcatagtatttttgtcgatactgcgtctctgttaatcctgaatattgtttcatattttttgtacaaaggaacagcaagatcacgattgtatgaattatgtgctgcgtattgctggaaacctccttcatttgaatgctgcaagaaagagggaccagaccacctgaaacagtgagttactttaaaaataaaatgaagttttaaacatccgtactatcaggtttcagctttggaatttcactcaggatcttcatttcatcctctgaaaatccaaagttaacaatagaagttcaaaactagctatcaatgataatgagaatcacagccaaaagaaaagaaaaatatccctaaaaacttgtttatattaacatggactaaagtataaacaacaaacattcaaattttgtagactggagtggtgtccttaaagggctgtgtaatttaagcatctccatgaaaaaacgggtggattttctcattcaaatcaattacatttctgaatttttgacactggtgatgaatggatgatgataattatagttgaaatttgtaatctttttcatcaatatttagtatatatataaaacttggttcacttgcattccgtgtgttgttttcttaacgactctaggttccttcgtttcagggtacatagaactttcacttgcatttgtttattgttccatttttagatttacttgcaaggtgaccttagagatagaagaggcccagaatttgattttagagtttgttggggaacctctgtcaaagaagaaagatgcagcagagagtgcggcagagggtgcattatggtatctacaacatgaaggtttcttgcctagtattggtaattgacatattgcacaacaattatcatgtcacataaatctgaggcaatgtcttagggtgtcatttgaaatttctggatgcaccctcattgttattgataatcatataaatctagaagacaataatagataatacaggtttagtaacccagggccagagggttccctaatggtaatctattgtaaagcattatttatgtatgtattattgtagtgtcaaagttacatttatttgtaatgaccctcgattgtaacagtgaattttctatttactacgtttgaaatataaatataagctcccgaaacatttgaatggtaa

SEQ ID NO: 228 - DNA, 36332 bp, Glycine max; identical to SEQ ID NO: 227

SEQ ID NO: 229 - DNA, 36247 bp, Glycine max
ttaggtgtagccactatcttaacttgaacttaatttttaataagtttggtagctcaaattttttactagctcatgaatctttgcaaatgcttccaaatcttgatcattttgtctggtacaaggtcattttagcacttgcaagtcatggacagagttccaaatacaaggggtcctcttttaaaaaagtttaggacattaaaacttatgtatttttttgtgtgtgtcttagatgttttataggttaaaaaagtacagaaaataataaaaggttgagaaaagtttaccaaaaagcttgaaacatgtgccttagtgtaaaagaaccgttgtgagtagcaatggatgtctacattcaaatttttaccattttggtaataaattttagactttgaataaaaagaaaaaaaagtgtgtttagcaattttggtgaaataatttaatttaatataaattaatgtgctaatgatcaaactagaatgttactaacatgtgattacttcacggtatttcagtaagctgtagaagccttatcaaaggcgtgcattcaacattaggtaaaattataacatttcaatcaacaatataaaatatagtaatccaacatcttaaggaagtttaactataattcttaatgaccagtcattattaatttcatcatatacttgactatctattcccaatcacaagctaatgttacattgtctatttcataacatagtctaagttttagttgaattaactactaagttttcactaaaaaaatacataaatttatgataaaataggtggtacattaaaaatgttaaaatatgttataacatcatttaattttaatttattatgcatgaaaaatttgttaacttttattataattatcttaaaaattatataaaataatttataattgattcacaatgtaaataattttatattatcaatgtaacatattaaattcttaatctatttaatcaaaacttataattatgaaaaaatcatttaaatagaaattacatgaaatcaaggtgttgccattgtggtgctcccaatagtatatacatacacaaaatctaatctttattttctctttgatagacataaaaaagtttgattgatgataataaaatagatgagtgagaataaataagaaataaaataaaattttaaaatatttgattgaagataaataaagaaaaaacgagtaaaaacaaataaaaataatacaactaagtcccacaatttttaaaaatgttttcaccctattcatatcttaccaaacaaacaaacttatttcgatttctctccctctttcctatgtttcatctatcaaaaatcaaacaaaggctaaggataatataattttttttatgtcctgatatataaattttatttctacataaaaaaaaaatataaaattgatttctaaaaagccattttgtttggaaaatactagtaacaaaaaacgacatgggggagtgttgggaatgaagtgatgcgaaaacgtgcgtggaaacaaaacaaagaacaaagactttcagtcattcagtctttagtgagcgtgttcactaaggtaactcttcactctcttctccgttgactccataatcaacgttttggttgggaacagaagtgaatgaagtgactacaaacaaagctctctctctgttattattattattattcattttctcttttcacactcctttgtcctttgaacccacccgtgaactctccaaccgtcgtcgttttgatttcacccactctcatacctccaaactctcttttcctcggctaatgccggacggagaatcctctgccgtcgccggcggccaagtttccatggaaccctctttaagcctctccgatcaactacagtccctgagtctttcccaagtaaaaaatcatgatgactcggtcaagaaagatccccggaagattgcaagaaggtaagtaacttttgctacccctttgttcttttgattattttcttcactgagtcacgtttatttttcaaatgggtgggtggagtttggctttttttattttatttttttattgttattttttgcacgtgggcttggtcattattgcttggcgttgtttgctgttgtagttagttagttattttttttgtttggcttttgagaattggagttgaagaaaacgcctgtttcaagattctgcttaaaatgtgactagttgaattgcactagcaagctttgttgtgtatgcaagattgtacttcttgcgtctgtgaaattttcaaccgagtgttttgttatttatatgttttattccagaaaatgtttttgtagttcaagaaaatgttcctaatttatggtgatcagatgtctgaaatgtgatgccgactatgcttatcttttttattcttcacttgtcttctggaactccaataatcttatgaatgttttggtcctttaaaggtatcagttggagttgtgcaaaaaagctatggaggaaaatataattgtgtatttagggacagggtgtgggaagacccacattgctgtgcttcttatgcatgagatgggtgatttgattcggaaaccacagaagaacatatgtgtctttcttgctcccactgtggctttagtccatcaggtgagctgctgtacatattgttgcattcaatgttgttattgtacaaaagtatttttttgggaagtacaatattttttttttctgggcaaattagaaatataatggaacaaatatctttttcctcccttttatttttgggtgctctgtactttggccatttcaggttgggtaattttgtgttgcaggtttacagtctgtaaggccagtgagaatggctttctgggataaataggcctagcaaggaagtattctgttgtattataactgaacatgaaaattttaatgacagatgacctttatacctttgattataatcattgcaattgggtcagtctcaatttcccgccaatctttttgaataaaacatttcttgaatctagaattagagatcttagtgatctacttgttatgtcaagcatggttgttttatgtgtgaatctgatgaattaatttgttctcgtgtttaataatgtcccaccaaactttagttttaactgatttcactatgttggtcaattccatcatgtgttttctgaagcctattttttatttatctatagcaagcaaaggttatagcagactctactgattttaaggttgggacatactgtggaagttccaagcgcttgaaacatcatcaagactgggagcaggagatgggacaatatgaggtgataatgctagttaaatcatgttgaaattaattatgtttttctctaaattattttattttatatccagacttgttactgttacagaaattttaagtaaaagctgttgaaagaaagttggtttcatcactgaaatttaatttggcaaaaaattcaaattagctcctgctgttttgaaatcttaaaatctgcttacttaaattttaattccatgttgttttttgcttctaaaatttctgtgttcttgtttttttcccttcaggttcttgttatgaccccacaaatattacatcataacttatcccattgcttcatcacaatggagatgattgcacttttgatatttgacgaatgtcatcatgctcaagtcaaaagcaaccatgcttatgcagtaatcatgaaagtatgttgcactcttgctcaactttaaagattcaaaatggagctacacaattttccacataaatttttccattttcatagcttttatttttgacaatctttaatttggcattttttcaggtcttctacaaaagtaattccacaaaggttccccgtatatttggcatgactgcttcccctgttgtaggaaaaggtaaaataatgcttatcttaaaaaaattgagtactaacaagagccaagatatttgccttcctcaattatcttccccttgttggtagcagttataatgtggatgtttgtgaaagcttttattgagaaaaataattgcttgtttttcaaaagttctcttggaaagggataaagtaaattttttttttttttactccaaataagctatttcaaacactcgttctatcaaaaaaaggttcaaggtgggagtgggggaagggaatttgtcacacagaagaaggtcaatgggttgtgtggtctattaatccatttttgtacatggatggaaaaaagtatgaaagatctggacttaagaagtcagtttgttaagttcaccaaaagacttaccctaccattaacaagcaatttttttttatatagtttgttgtgatatatcatgcaaggcactattgttgtgcctaggtagaatgtgtaaatgatatggtgtacctttatatgtgtatacattctctttatcagaataaaaagatcttaaatttcagcaaaggggctgaaagagactgactgtataggatgtggtccacatatagtttgactggaaaccattggttaactttgaaaggttcaaatgtgtcaagaaaaagaaaatcttgtgatgtgagggacctttttcttgaatatgggacagggagtgaagggacaaaccaaggtcacagacatttaatataaatttttcaattattgacaagaattttttttaatgaaaattttaacatgtcattttagttttcaatactttgacctttgtttaatttttttttctctaggactaggtccatctaatcctgcgaaatattattgaaataatatacacgtgtgtgcagttttgatggttggctttctgtttatacatatatgtacatatttttttattttgtatttgaaaaatattaactgttacctgctttacttttgggaatgttgatgttccatcatataaatgttttgttgttcttatatcccatttctgtctgttcttcaagagtgttaccctaaaatttgcctacattgttaataatatattctttctttcctttttatattttatgcatatttctattagcataattgctgaatactgatagtgtagtttattccaaatatgtaaaaccctcttcataatttctgaatttgctggttctttcaattttcaggtgcttctagtgaagcaaatttagcaaaaagcatcaacagtcttgaacatatacttgatgccaaggtacagtttatttagtacaatatgtcaaaattcttaaatttgtgaacaatatctgttgtttgtgtaaaagattttttgtcaaacttttgctgtcctttcctgtgcaagaaagcaaatgttcttcccattagctattgactagaaaccattgatataatggttgcagctgtgtattggttgagctccatataaagatatttgtgtctgaactcttctgaattccttatgtttaccttatatgcgaactgcatggttcttgtggatagttacctagttgttctgcttgttagatgctgggcatggttactaatctgtaatgatttgaatctcatttgtaggtatactctgttgaagacaaggaattgcaatcttttgtgaccactcctgtgattaatatatatcattatgtttcaactgcaagtggggaaactagcttgcacttgaaaattgaggagattaaacgccaggtgcacttttgctatgggttttaagatgattagataaataaggtttactgatccctgtgtaattttatttgaatagtgcatagcaacccttggtaggagtatagaagatcaccagaaacggatgaatacaaagaaacttctgaaccggatgcatgataatgtgattttcggtctgcagaatcttggcatttggggagcattgcaagtaagactcttgtagtgtattataagttttagttctctaatcatttgactagaaatatattaatataagtcaataatgtttttagcagaatctataaataataatacagagaaaatttttgttgttatttgttccattttgttggtcctcctacggggcccgcacacccaaagaagaaaaaacctaggaagaaaaataagcctagaataggctgtggaatttcttggttataatgttaagcttacataaattagacacagtagcagacactctacatcgattcatgaagatgaatggtttagaatggtgttttgtttcttgaagatgatgtcttggtagttggtaccaattcagtttttgctagtgaggtagatgggatatttgaagataaggggatgttatttggaattcatttagacaagtcttctgaatacatgttttccttgggttttggtgtatttatattttttcttgtgttttgttatatatctctgacatctctgttttttctttttaatttttattttgtccattcctgtggttttccatcatgcttcttgttttattgatatcgggaaatgattttataggttagaaggactgtcactgtcactatcttggtttttattctttttccttttctaatatatgtgttcaccttccaaggctagtcatattcttctgagtggtgatcattctgagaggcatgaattagtggaggcagatggaaattcaagtgatgactctctgtgtgataaatatcttgctcaggctgctgaactatttacttcacaatgcatgataggtattttgacattatctgatattcttttaatcatgccactgctgttactaggttttctggctgttatgtgcttccattttgcttgatgtgttaggctaacatttgtctagcaatgaatcagtctttttcattattgttaatttttatgatatgtttaaaacagagttcttgtaggatagatgcttcatttatattgcaactaaacatactttttttgtaggcgacagggtaactgatttatcttctgtggaaatattaaaagagccatttttctcagcaaagcttttacgactcattgggatactatccaactttaggttggcaaaactatgctgtttaaaccactcctttaatacatgttttcatatagcacaagtctcgttgatatttggttatgaaactaatatatttgggcaaattctgattacatgttccaactcaggttgcaaaagaacatgaaatgtataatttttgtgaatagaattgtgacagcaagatccctgtcatacatactacagaagctcaagcttctaagacaatggaggagtgattttctagtaggagtccatgctggactgaagagtatgtcacgaaagaccatgaacatcattgttgataaatttcgttctggagaggtattactattggatttctcattaatttttaaatgaattaaactatactcctgtatatgtgtgtataagttgctaattctcatagaagattctctgattttacctgattggcaatagatatattgagggaatgtaaaatgtctcttacattgcaaaactatgaaatagctgggacctactggagagttttgtaaaaaatattttacctaacttctcttcatgttctttaaatatgtatatatttcctagcttgttagagagttgatcgctagtaatgtgcctgcatggtcatgctgttaacagttgaatctactggttgcaaccaaagtgggtgaagaaggacttgacattcagacatgttgtctcgtcatacgatttgatcttccagaaactgttgccagcttcatacagtcaagaggtcgtgcacgtatgcctcagtcagaatatgcatttttggtggacaggtactactttctaatagatttcagaagtaatttaagcaaatccatccatttggttagttttgtaatcatcttgttgttgcagtggcaataagaaggaaattgacgtaattgatggtttcaaggaagatgaataccgaatgaatatggaagttacttttcgaacatccaaggagacatacatcatccctgaggaaagaatattcagaattgattcgtctggtgcttctgttagttctggatatagtatctcattgcttcaccaatattgttcaaagcttccacacgatgagtatgagcttatttaaactagaccattttgatccaaattatatactctgtgagattatgtcttgatattattcctgctgttgtatttattattagaatattctttttcctgttaattagtaattgattgatcttgtaatcaatactgattcatgtttcatattataaataacatgaggtgtggtctacattgccacttccattagtttcttcgtaggaggggaatgaatatcctctcacacaagattttcacataatcgtatcatatgaaaaaattgtctttcttaattttcacatagactaatatagattttgataatatccctcctattcaatgtatatgaagatagagaaataggtacagagagagagagatgagtagagagagaaacaatggggggggggtgagtgtcaggagtggcggtgaggcaagagtgagaggtacagcgagcttccatgcggacccacaacggacatcagcacacaaggatggacagcaacaaggttacagtcgagaaaattggcgggacaagagtgacatatcaacattctacttcacacgatttacagaggacatcacagagaaggaactatggtatcatttcaagaggtggggtgatgtgaaacaagaacgggaggagatttggatttgcaagattcaaaggagtggaggatgcgcacggtttagcaaagaaaatggaccagatggtcattggcggtctgaaactgtacgtgaacgtacccaagtatgggagagacacgaggaggatggcaccggcacaacccaaaacgcagtggcactaacttggaccatttggaagcatcgaaatggggtggtttttgctaatcaaactttcgaaggaagtaaagtgatggaagatgcgatttttctactatggacatggcttaaacttttggagaagggtttcaccctgcatttcaatcattggtcctctcatctcacagcagcgttttgtaattagggaaaaaaggtagttgtaatattataagtatttgtgctgtgtagtagtgtctttcctcagggtcagctggttcttattgcatgtatcttggcattctgaaccagctattaattcaatcctcttatgtatctatagtacctctggtactcatttttataaatgatacttacttttgctgagcaaaaaaaaaaaaatgttagatggaatctgttttcagacgattgcttggatgtcttggagccagtgctgcactcctaagcatatgggaggattggggatcagagatattcaaagtctcaacaaggctttgctgttcaaatggaagtggatgatgttccaccaaccagaccagctttggactagaatcctgaactctaagtataatggctggaggggattggagcatggtcctagaaagcagtatttctctacttggtgggctgacttaagggccatctctcaacatcagaatgtgatcaatgctgataatcaaattaggtggaagctggggagaggcgacaaattcctgttttgggaagatccttggggcgatgaaggagttcctctcaaggaccaattccctgaattattcactatttcttcccaaagggatttaagagtggcagaggtgggatcttggactgagagtaggtgggtctggaatatggtttggagaagacacttgtttgataacgaggtgcagctagcctctaaattcattgatcacatccatcaaatcagattaattaacaatctcaatgacacctggatttggagagctgaatccactggggttttcacatctaaatctggttatcaagttattaaagctgatagggatgatgaaggtcagtacctgggattcaagaaactctgggagattaaactccctcctaaagccctctcctttgtttggaggttactatgggatagacttcccacgaaggacaacttgattaagaggcaaattcaggtggataatgatttatgccccttctgtcatagtcaacctgaaactgcatcccacttatttttcacttgtggcaaaactatgcctatatggtgggaattcctatcttggataaaggaagaaaaggtgtttcactgcagacctttggataattttctccagcacttctcctcagcagtttcaaaggatgctaacataagaaggacaatgtggtggatagcagttacaagctcaatttggaggctcagaaatgatataattttccagaatcaaacctttgatatcactagactgacagatagcactctgttcctcttatggacctggttgaggggttgggaaaggaatttccagattccttattatagttggtcttcaaatatatctatagcttttagttaaagcttctgttagtagggatttcatctgtgtagggtgttgtatctcctgaattttcaggacccttttctgtattatgtagtacctctagtacttgttattacatattacatattatcttcgctttccaaaaaaaaaagacaattaaccaacaacagaaagaaatgctgatggggaggttttgggaggaggaagtaaaagaggccatgtgggactgtgggagtgagaaaagtccaggtccagatggtctcaatttcaagttcatcaagaaattttgggtcaccatcaagcccgatgtccttcgatttttggatgaattctatgttaaggaatgcttcccaaagggatgcaatgcatcctttatagcattaatcccaaagatggctgatccacaaggattgaatgattatagacctatttcactcataggctgtgtctacaagatcgtgagtaaggttctggccaacagattgaagaaagtgatggcttccattatagatgaacgccagtctgcatttataggtggtaggcacctgttgcacaatgtcattatagcaaatgaagtggtggaggaagctaagaggagtcataaaccatgccttgtgttcaaagttgattatgaaaaggcatacgattcagtctcatggaaatttttgaaatacatgatgagaaggatggagttttgtcccaaatggatacaatggattaaggggtgtttatcatctgcctctgtttcgattttggtgaatgggagtccctcggctgaatttacccctcaaagaggccttaggcaaggcaatccactagtgccccttctttttaatattgttgctgagggtctaaatggtttgatgagacaagctgtggagaaaaacatatttagagggtatccagtgggtagccacagagtgagcatcagcctgttacaatacgcggatgacaattttttttggggaggcatcaatggagaacactaaggcaatcaaatcaattttgaggacctttgaacttgtttcaggcctcaaaattaattttgcaaagagcaactttggtgcaattggtatgccggaatcgtggaagcaaaatgaagctgatttcttgaattgtaatctgctgtccattccttttgtgtacttggggatccccattggggataacccgaggagatgtcagttgtgggatcctataattaaaaagtgtaagaagaaattagctaagtgcaagcagagacatatcctttggggggagagttacactcatacattcagtcctaacatctatacctatttattttctttcatttttcaggattcctagaagggtggtggaaagattggtgcgtattcagcgaagattcctttggggtggtggacctgaacacaacaagattgcttaggtcaaatgggaaactgtgtgtctcccaaaagacaaaggggggctaagaattaaggacatcaacagcttcaaccttgcattgctggccaaatggaaatggagcttgttccaaaatcacacaggcctatgggctagagtgttggagtcgaagtatggtgggtggaggggtttagatgaagcatcacgtgattctaatgagtccatatggtggagggatctgaaattggcactccaccatccgcaaactaagaatgcttttcataatggtttggtgtggaagttggggtgtggcgaccgaatcaagttttgggaggatggatggcttcatgatgggacaacattacttgccaaataccctaggctatatcttaattcctgtcaacagcaacattcagcaaatgggagctcataccgacacaggttgggaatgggaccttaaatggaggaggcatttgtttgacagtgaggtatctatggctggcagttttctgggtgaggtggcaggcatacaggttcagattaattgcagggatgattgggtctggttaagtcaccaatattcagcaaaatcagcctatgatatgctgaggggggatatagtacagggagatgatgttgtagattttgtggaattgtggaagctaaggatcccaaccagaattgcagtttttgtatggaggttacttcgagatagattgccaactaaagttaatctgtgcaggcggcaggtggcaattaatgaatcaagctgcccattctgtgggagcgcggaggaggacgcggcgcattttttctttcactgcagtaaaattttacctctttggtgggaatctatgtcttgggtgagcgtatctagtgtatttccacagcacccaaggcatcattttgcccaacatatgactgccggggtggaaggaattcgggcaactagatggaggtcttggtgggcggctcttacatggttatatggcagctgaggaacaacattatattctcaagtgggactttcaacggaaacaaactgatggaggactccctatttctactttggacgtggctcagaaactatgagaaagattctatatctcactacaatcagtggtcatctaaccttagagaggcttttgtttttagacaaggaaagcagtcatagtgtattgataattgtataaccaagctgtctaatgtggttcccagcaagactgctgtcaagtgtctagtctggcttgggaaccatttatctggatttttgttgtaatcacggtacctctggtactcagattcatttctcatatatatatatatatatatatatatatatatatttatttatttatctttgctgaccaaaaaaaatagtaaaacactgttatatactcaaccaactagttccatgtaaataaagtacaaatcttgtgttttaaaatgtaataatctatctttacaggtactttgaccccaagccaagttttcattacttagatgattcagggggaatttcctgccacataacattgccttccaatgcaccaataaaccaaattttgggtacaccacagttatctatggaggcttccaaaagagaagcttgcctgaaagcaatagaagaactgtataatttgggcgctttaagtgattgtctcttgccaaaacaagatgatgcagagcctgaggtgcaggtttcaggctcttctgatgaagatgaatgtgaaggtcaaacttcagttgctttctgataagccattactttcattgtctttcactgggttgccaaaaattactgttcaaattgtattttgcaataaactgttgagcatatttacttgtcaataactatattaaggagagcgactattccagcatgttgccatgctgatcattttcagacctttcaaatactacataatccattgttggtaattatttttgtaacatacctgtctatggatttagtgttaatcccattgtcagtgtataaacttctacaccatcattcaatcatgtgttgccagatcattagaaggttttttctcctctcatgtagttattgtctcaaactcttttgtgatgatacaataacacatgattggaagagagtgtaaaagttttactccaaaatgaatcaaatcaaaattttcttatgtgttgataatctttaatgggaagctttttatttgttttcagatgtagtaccgttactatgttgattactatcaacttatgtctctagggatgcgactatatcatatgttgtgttgtactatatttattttccttttttagcagatgccatatcaagaggaaaattacatgagatgctagttccttctgcctttggacagtcatggataaatgaggataacattgtccgtctcaactcttactacataaaattttgtccctatccagaggacagggtctacaaagagtttggtctattcatgatgacctgtcttccgatggaggctgagaaattggaacttgatctccatcttgctcatggtcgatctgtgatgacaatgtttgtcccatttggagttgtagaatttaacaaagatgaggtaagtggtgtgtgtatgtgtgtgctttattttattttaagaattttgttaattaatgcttggagttttccatcctgcagattaagatggcagagaattttcaagaaatgttcctcaaaattattcttgatagattagaattcatttccgagtttgtagacttgggtatgagtgctgaatctcactcaggcacatcaaccttctaccttttgcttccagttgtattgcaagaatatggaaatgccatggaagtagattggaagatagtgaagagatgcctttgttcaccaattttcaggcatccagctgatactatggataaaaaagttttccctttagatattcacctgcaacttgccaatggttacagaagtgtaagaaatgtcgagaatagtttagtgtatgccccacataagaagaacttttattttgtcacgaatgttaactatgaaaagaatggatatagtcctcataatgattcaggcacttcaagctatgtggattacttcattgaaaagtaggtatctgtttattattatgggttcattcttgtgttattttggttttgcatccctaattcttctatgtcgatgaaggcatttatatttatgggggcttttgtaaaattgctgattaactgatggaattggatatctgagaatgttggaatatcatatattgtgcttataatatttgacaaaaatatgcatgcttgaatgccaggttttccattcacctcaaatgtccgaagcaaccacttctgcatgtgaaaccggtctccaatttgcacaacctgttacacaacagaaagcgtgaggatgcaggtattgtattggatatgttatttttagcgttagagtctgacaggaacagtgttgattaaaaagaaaaatagagccaaagctccttacaaccagaaaatattttgaaagccttggaatgtaaaacagcaactccaggaataaatgtgactgaaaaagagactccacaaagaaaatctcagccttaggaatggagaaccccacttaaaccatgttctaccaaaattgtccctatgttccttcccactatcacgatcccccttagtcattttgcgcccattcagttaggattctctactattctctttgtttcagctcagcatactcatcattcctttcatctccccccttggaccataactaactcctcttttgccccattatccataatctgaggcccccttgatgtttcttcttgagtaaacacaagatatgggcaatagagcttaatcaactaagacatgagaatttagtttttgttacctaaaaccttttacgagctagtggaatgacaaaaacatgctaggaagagatgtggtagggtgggctaatgcgtaaaatatgttaggttcgcacaagaacaagtgtaccctacgcaataataacagtggactcgaaggtccgaatatcaaccccaaagaaccaattgtattcccaattagttaagtttattaaattaataatagagatgattgaaaagaggatttaaatattttcatgattttagtttttataagaaaacaaataaacaaatataaagatagtattagtgtattaagtaagttttactttgtgatttagttaagggggagtatgaggctcttcttaacaataaaacatgggatcttattcctcttcccaaagacagacaaagcgtgggttgtaggtgggtcttcagaattaagtgggctgtaagtgggtcttcagaattaaggagaatgctgatgggactattaacaggttcaaggctaggttagtggctaaaggatttcatcaggttgttggttgtgactttaatgaagccttttctcctgtgataaaacctgttacaatcaggctaattatccctcttgctctcactaataaatgggatttgttccagctagatgtcaacaatgcctttttaaatggccatcttgaacagactatctacatgcaggaaccacaaggcttcgaaagttcagataaaaccttggtttgcaagctacaaaaagctttgtatggcctcaaacaagctccaagacagtggttggataggctcaaaggaactcttttacagcttgggtttgtggccagcaagtgcgatccttcgttgtctgtttattaagacaaagggcacattatctacattcttgtttatgtagatgatattattattactggtacctccaatgtagtaattcagcaactcaccactaagctgcattccaatttttctcttaaacaattgggaaaacttgactattttcttggtattgaaatcaaatcactggctgatgggactattctatggactcaaagcaaatatacaagagatttgcttcagaaaaccaaaatggcataagcacaacctatttcttcccctatgattgctaattgcaagttaaccaaagctgactcggatttattcggtgatccatctctctatcgatctgttgttggtgctcttcaatacacaaccattacaaaacctgagttaagctatgttgtgaacaaggtctatcagttcatggctaatcatatggactctcactggacaactgttaaatgcattctaaggcacctcaaaggctctattcatcatggtctgcatttgaaggctgctccttccttagaggtggcagacctggtggattgctttgacatggtgtatttggcagcataggaataggatggtcttccaaaatgaaagtttcaacagtcataaagtgatggagcatgctctattttattgctgaacctggcttaaaaatctggagaaaggatttgatatcctgtttcacttatggttcagtaacattagggatagttttttgtgttgaggggggatagtttatataatacaagttaggctggatgggtacctagcggttagctagatctttggtttcctaattcaagttggttagcatgtattaggtcactacagttctgcaccttgcaagtgctaggatgtatatacaactatactgcttgtactatttttaatattctatataatatatatatacttttgctgataaaaaaaaaggctgctcttcctctcagccttttactatcaaagccctgtgtgatgctgattgggcctcggatctagatgatagaaggtctacctttggtgcagtgatttattttggtcctaatttggtctcatagtggtccaagaaacaacaaattgtggctagatcttccactaaagttgaatacaggagctcgactcaagccacgactgaagttacatggattcaaactctcttaacaaagttattgttctttttcagaccccagagatttactatgacaaccaaagtgcagctatatcactcataatctagtttttcattcccggactaagcacatgaaaattgacatctttttttgtcaaggagaaagtcttagctaaagagctcaaagtgtatcatattcctgctatagatcaatgggctgattccctcactaagcctttatcaccaactcgatttctttttcttaggtccaaactcaatgttgttgatttctgattctcaaccccattgagtttaaggggagggggggggggggtattagtgtattaagtaagttttactttgtgtaaccagaagacttaatagaaaggccttggccattaccaatgtatatttggtctggccttcaaatggaccaagctgctacatgttttgagactctccagttacgtagaacgatgcacccgaatcaggtatccaagtagtagagttaggatcttgatttttagaattaaccagcattgcactaggttaggagtctttgtgagaattagttccctgattttgttctgaaccgaaggtgtttgatgaattgctttgaaatactggttccatcagagtgagagacgcatttggctcaaaatcagaatcatagcgaaaatgacacatcgttgctgtgtgaccaaatttgaagcaaacttggcactgaaaatttgcataacgaccggggcctttaccgccaccacggcgacctccattgccgcagtcagaatcattgcctccatgactgtagcctccgccgtgattgaagccaccacgatttccaaaataattggatcaattttgtgaattgaaattattcgaggatgaattgtaagaatttgaagatgaattgtaaccttgagcaacattaatcgaaggtgaattagcaaagcgcttctgaaactttttcatgtatgtctcatgtgcgagcaacagtgccactacttctctaatcggaagtgattccaacttacttttgatcattgagatcactggaccgtactcctctggtaggccttcaagaatcacgtcaaggtgttcacgcagaaaaataggatctccacacgatccaagcgcaccgactatgcatttgatgcgcaaaagaaactcacacattgttttctgttcagacattgtagttctgagttctattcgaagtatcctagctttcgcacgtgtttgcttttgaaaatactcatggatctgctcccaaagctgatatgaatgaacgcatctgataattcgagatatgattgaaacttaaagagtcgattggagccacgacaagagaatctgatcttattgttcccaattggtgtatgctggattttcatttccagcttcacaatctgcctctgtgagaaagcgcatcgggatctaaggacttgccacgaaacgctgaagtctatgagccttgatgacagattctacttgttgcctccatagcagggagttagaatcatctaacttctgagaaatcggatgaaaagaaggttcggaagcaaaattctgatttgtcaccatggatagaccttaagctctggataccatcatagagtttgagagagagaaaaagaagaaagatgaaagatattattattgatttagaaagaaaaggtcagttacaaattaattttgtttctctatttatggagaaaacaaatatggttacacataacttgactaaggcagttaactaaccaaagttagttactgctctaatagaaataattgttctaacagaatcacaagtgttctaactgaatcataattgctctaacagaataacaactgctctaactgaatcacaaagtaaaacttacttaataccctaatagagaggtttaagtaacgataagaatgatcaggagttatgactgactgataccaattttctcttaatcctagtcttaatgaaattcccccagttaattatcgattttcaaaatcaactaaaacctatgatcaagattagaagatgtttttttgccttaaatcaataccccaatgatcatggatctatcaatttaatccaaatgattaaatcaattttagggatgattaattaaagattaactaatctattggaattacccaaatagtttggatcatgcaatttggtataaaacattatctaccaattacatgcagaagatcattactatgcaatcgattgagtattaaaatgacccgttccaaataaacattaaaatgaggaagataattaattaacataaaacaatgaagaatttcatttagattaaggagaggagtacaaatggatagctacatcattactctcgaactaaggggactacccatttatgatcagagcaaaactaaagaaatcttagagagagagaaaacatcactaacaaaattgaggtgaagtgagatattattcaacccaaacagaaaccgagtataatacagtttatatagcagttacgatactgtaactgtcaactaacttgagttagttagtgcaactgctgaacagttgtcctaactaattgtcaactaacatagctgtaactgcctaactaatgtaaaccaactatagttagactaacagagtaacataactgtgtaacagcatgactaaatgaaaagaaagagttacactgagtaagtatactcctataaaaactagcaattctatatagagtaaacatagacatacctataggcaggaacaatgatcacgagatccgttctaacggtgttgtccacactcttcagctttcaaaaaccctcaaggttctctcaaattcgtaaaaagataagaataaaattgaatgcctttatttataagtcagagacctctatatatagcttcctaaagataaatacacgaaaatgtgcattacgaccatggtgaatccacctcaccacaaccgtcgtcgaaagtaacactgaagccttgggttatggattgactacgactctcttggttgaccaccgccgtggtgaggtcactcgttatcaaatccttgatgctattctgaaagggctgttatcatttgactatagctgtgttgatgaccatggccgtggtgaatggatcacatccattatcaagtgcagagtcttcaaatcttcataaatttgtgtaatttctaactctttcactcaattgagtgattgtacttttgcaatacaaaactagtatccaaatgtgagttttactaaaaaaaatgcatacaaaatgacacaaaaaatcacataaaataccacccataaagttggtttatcatgggcttactgctattgacgtgcaatgaggaaggatttgctgctgagaagtggacaatgatatacattacagatatacaatccaaaattagttcttaagattgatcctaattgattcttccatatatacatgatatgctaccataaataatctagatattataattttgatttctgacaatttgtgtcctgtgagcatttctttatgattttgtgttagcaatttaaaaagtgtactgtgcattgactactttcaaatttgtatcttgattttgaatttatcttgtattctgatcatttttcagaatcttatctaatgtatgtaacttttgaatgtcaatgacagaaccacaggagctggacgaatacttaatttatttgcctcctgagctttgtgaactaaaagtaataggtttttcgaaggatattggcagttccatatctttgctgccctcaattatgcatcgtcttggaaacttgctggtggctattgaactaaagcacatgctatcttcttcctttccagaagcagctgaaattagtgccattagagtaaggccttattaaattcaatgtattatttacattattttcaagtagtgtattcttattcacatctaaccattgcagtgcttatatgggacagatgaatcttgtatacagctactaacaattgtgaacaaattactaggttttagaggctctcaccactgagaagtgtcaggagcgcttttcccttgaaagacttgaagtgcttggtgatgctttccttaaatttgctgttgcacgtcatttttttctcatgcatgacagccttcatgaaggagaccttacaaaaaggcgttccaatgctgtaaataattccaatttgtttaagttggctattaagcgcaatttgcaggtagagttatactagcacatccctgcttcatttactaagaaagtataattattcttatttattgattttctgttagactagggtttccacagcccccacattccatttcaaaacaaaatcacctgttgatgctttcttagaacgttgatctctcattaagaccatgagaaaaaaagatatacgtgggaaataattttaataaatacctaattaattaatatatatactaaaattatattggcaatgaaaaacatatagtgccggatttgagtctgtctttaatttctagctcacccacccttatcgttttaggagatagatagacacaggactctaccaggaatcccccatttcctgctctgggacctactactgtgtctcaaaattgttgagccaaaatgagaggttcaaatcctatttatgaagttaattcatgcatttgatgtaaggtttcctggatggattaaatggtggataagttcttttctatcacataaactcctaataattaactacctacaatcctttaacagatccttcctgactaacttggatctcagttcccatcaaaataacacttggataacataaatccaaaccctatacaattcctaaccgaggattaaagatactggagttttccctagaactgaataatagaaattaactgaaccatttagtagggcttattaccttgataagatttttctatcaatatcaggctttagaatgggttaatgtatatattttaggtctttgtatatatattaggttgtgttattttattctagtctggctcattcaacccataggccatgattatatattattctatcttgtaatcttttattttttatcaatagcaaaacactttctctcttcattttcacagtgcatatttttatttactgacttgagtcttatctctatctcctcgctccctcttgcaggtctatatatgcgatcagacatttgatcccactcagttttatgcattgggccgtccttgcccaagagtttgtagcaatgaaaccgaagaaagcatacacttttgtttaaattctgttatgcaacaaggaaaagcaactgaaacccgatgtagcaaaaatcatcattggttacataggaaaacaattgctgatgtggttgaagctctggttggagcattcctagttgacagtggctttaaagctgcaattgcctttctttcatggattggcatacaagttgattttgaagcttcacaagtggttgatatctgcatagcaagtgctagctattcccctctttcttctgaagtagacattccttctcttgaaggtaagctaggacatcacttttttcataaaggcctgcttctccaggcatttgtacatccttcttacaataagcttggaggaggctgttatcaggcaagtgtaacttttcttttccctcccagtgttctgacttcatataagaattatttcctttactttatagatctatgaatcctagtgagacatttgatctttaatttttaaaatgtgataattctttgcagcgattggagtttcttggagatgctgtcttggattatttgattacttcatatctattctcagcttatcccaaactaaagcctggtcaattgacagatttgagatcattgtctgttaacaacaaggcatttgcttgtctagcggtagatcgcagttttgataattttcttttatgtgattcaagtggcctgtctgaggcaataaaaaagtatgtggactatgttagaagacctgtgtcagataatggcattaaagaagggccaaaatgtcccaaggtagatagtatgacctttatataaagttgctacacctggttgttgttgttgttgttatgcatttactcatctaagatgaagttcctaaagcattatgtctgtattcatttcaaagtttgctttaggtattttacttggaataatgctactcccacacacgacacctcacatctgtaaagtttccattatttgatcatagctcacctacactttgattctgccatctatgcttgatgtaaattgatgtgcacccactgtcccacaagatgtgtaccaagcattattcttttacttggaaatgacaagagcaaataaatggaatactaaaagagaacccaagcccttgtgtaggaagaagacacagaaaacccatccaaatgattgccaatatttttgcaaaaaagcacaaaataagccagtacatgttgggtgggaaagcctgacgcgtgacagtcaactgaacaaattatttattatattgagataagatgacaaatttaccttctgctctatgatttgtgttatggacatgagtaactcttctaggaacattacgagtcttttgtttgtccaattcaagcagctcataagttaattaagtttctgataggtgtgcattgctttgttattttgcatcaaaaggtatatggggtataaattgacatcattggtttcttcaggcactgggtgacttagtggaatcttgtgttggtgccatccttcttgattcagggttcaatttgaacaaagtttggaagattatgacttcattcttggacccaatcatgaaattctcatcaagcttgcagctcagtcctgttagggatttgcgagaactttgccaatctcataatttggagttggagtttctgccagtgccctcaaaattgactaaaaggttttcagttgaagctaaagtgagtgggaatggtgtatgtgaaacagcttcagcaactggccaaaataaaaaagaggcttgcagaattgcttcacagctactttttttaaagttcaaggtaaagcaatcatgttaagttttattttttccatccttattttctcaactcaacaccttaggattagcatttctttattgtacggtgacaccacaggtgagtatattacttttgtgattcatgtaaacaagggtaataatcatattttaactttttctgctgatgtggtgaaatcagttgtgcttatattccttaaatttctaaatactctagttgttaatgaaacaagtgttctagtttaagatgttccttgtttcttcatttggagctacttttgatcaagttcagaataatgcaatagtacctctttttcccgaaatgagaagcttggtagtaacgtcatattttttttactgtggagttcttgtaagttgaattgctatactagatagattggctcacttagtccaacagattatggacaaatttcattattatatattcattttcctttatattttccgtagagctgtctagtgtattatgtttgctttcttctgccaagttctattctttatataactttagtttgggccaatcgaaaatagtactacctccaatcctatatataagaaacaactgtctaatttatcaagatcagtaaacgtggttagattggttaacttgtcataaattttaattttattccaaaatggtacattaaatgatttaagagataattattttttaaaagataatttttcaacctatgagtataccttgcgttaagaagagagtgagagaagcaaagctattttgaatatgtctttctgggttttatcttccacccagtcaaaatgattacatggataataaataactattcttgttttcaagagaacaattaaaatatcacaattttctaagatacattgaacccaactaactattaactaagctacttgaaaggaaattatcattaaatgctcctcttttcaacactccccccaagctggagaatagattttatccattcccagcttgtataatattctatcaaaatttggagtgtgcaatcctttagtgagaatatctacaagttgaccttgtgaaggcacatatggagtgcaaatcaaaccactatccaacttttccttgataaaatgtctatccacttcaatgtgttttattcgatcatgttgtacaagattatgggctatgctaattgctgacttattatcactgtagagcttcataggtccgtcccatttaatcttcgagtcttctaagatgatttttaaccaaagcaattcacaaataccttgtgccatagcccaaaattcagcttcagctctagattgtgctacaacatcttgttttttactctccaagttaccaagtttcctcctagaaaggtacaatatttggaagtggatttactatcagctattgatccttcattgttagcattcgtataagcttcaagtattgtattcccatttcttttgtacaaaattcctcttcctggtggtgtcccctcaaggtaatgaagaattctataggtaacttgtaagtgaacttctcttggacaatgcataaattggctcaccaaactaacagcaaaagtaatatcaggccttgggtgagacaagtaaatcaattttccaactagacgttgatacatctccttatccgcttctgcaatgtcatcttcattacccaatttaaggtttgaatccatgggagtacttagagatttacaagctgtcatgcatgtctccttcggctaatctgtgacatatttttgttggaatatgaaaatacctttcttggagtgggacacttcaattcccgaaaaatatttcagcctcccaagagttttcatctcaaactcctttgctagatgctgacttaagagtagttgttccttccaatcatcactagtaacaatgatatcatccacaaatactaacaatacagtcactccccctgaggttgagtgtttgatgaataaagtgcggtctccttggctttgtttgtatcctaaggctgtcatgaccttagtgaatctcccaaaccatgtctgaggggattgtttcaacccatataaagtctttcttgactggaaaatagaattggcagcatcttcatatccaggtggaacctccatatagatttcctcctcaagctccccttgcaagaaaacattctttacatcaaactgttgtaatttccagccataatttgcagcaagagataatattactcgaactgtattcatctttgcaacaggagcaaaagtctctgagtaatctatcccataggtttgtgtgaaatccttagcgaccaatctcgccttgtacctctcaatcgacccatctaccctatattttattatatacacccacttgcaacccactggtttctttcctattggcaaagaaaccaactcccatgtcttgttcttctgcaatgcctccatttctgtatccatggcctgcttccaatttttatcaggtaatgcctcaaaaacattagtgggaattgagatagagtttaggtttgcaagaaaggttttataggttggagagattttatgaaatgaattgtaatttgagagaggatagaaaggctttttggtacatgttctggttccttttctaaaggcaatgggaagataaaggtcgtcattatgttctgaaatttccatttcatttggagaagctaaaatattatcattcaagattggaaaatcaaagttagttacctgatctaaaggagttggattggcctcttgggcaagttttgatttagaaatggcctttgatcttcttgtgtaaaccagattcttcccaaaccttgtatcattttcaagtctggtgggtgcatccttgttggattcattttgggctaatgtttcttgcttaggtttttgtgtaagatcacaattccttgtcctggaatacacaacaatggtcataaaaaacaataatacaagatatgtcatttgtatgtttctgaacagagacaagatttgtggacaattttgggacatgcaaaacattttttaggttttgaagggatttatttggatgtttcctataccggctatagttacaagagtgccatcaacaataattattttcttattgctaggacatggagaataggtggagaagatcatatggtcagtggctctagaatctaaaacccaaagggatggaaggattttttagacattaatttcaaatgaaagaggaagtatacctgaatatgccaatgtacaagtacttgatggtttttcaaggttgctaaaaaaggctctcattctttctatttttcaagcagcaggaaaaattattggaaaactgagtcgccggaattctaacagtcgctggaaaagtctccggaattttggcagttatcggaaaagtttgacagcttcaagagcccagtcaaacttgctaaataaccaaccctttttgtgcagaagcagagcacccctagatcaggagctctgatattattcgagaaaatgagagaaagaaagagagaaaacgagagagaaaggaaaatgatattattgtgatctgaaaagttagttagaattagttacaacagaggtatatatagacctctgaccctctgaactatcactaacagactctgacttcctaatactagtgaggtgttgttagcaaaagctaatagaccttacaaacatataatctgatgtctaacactagaggggtgctgttagcaaaagctaacggcccttacaatcattctataaaactgttttcacagttatacaagtacttactctaataccccccccccccccccccctcaaactcaaggagaagagttttgagaagaaacactcttcacattgaatttgtccctgagaacttcaaatcttgctgcagaaagaggcttggtcagtacatcagcccactggtccagagctggaatatgcacaatggaaagttgcttggccagaatcttttctcttacgaagaagacatcaattttcatgtgttttgtacgaatgtgaaacacaggattgtgagcaataggcacggttctctgattatcacaaaagattataggagtagtgaatggaacttgaaactctgttaggagagcatgaatccatgttaacttagtggaagtttgagttaaaatgcgatactcagcttcaatactagacctgacagcgaccttttgtttgcgagaccaccaagatattaagtttggaccaagaaatatggcagcccctgaggtggaacgcctgtcatccacattggatgcccagtcagcatcacaacagaacacgcgaagagccaagggcttggtaacagaagtaggctaaagaagtagtccatgaaacaaagtacccttgagatacctcaagattcttttcagcaccgcctagtgagagtttagagatgcagccataaattgacaaactttattgacaacaaagttgatttcaggcctagtaagagtagcatattgtaagacaccaactatagacctgtatagagttgaatcatgaaagatatcaacaccatgtcgagataacttgcaattagagaccatgggggaagaaatagaataagctttagttatgtgagttttgtggagtaaatcatgaatatatttactccgagtcatcaatatggagttattgggtagatacttgatctctagacccaaaaaataatccaaatgaccaagttgcttgagagagaatgcaatgtgtagtttggttgtgagctgctgaattagagaagcagtgctacccgtgatgatgatatcgtccacatatagactaaaagatagacaatatgcatttgttgctcgtagatgaaaagggaagaatcacatttgctcccaacaaatccaaactgcagcagagtaaatttcagtctatcaaaccattgccttggggcctatttcaagccatagagagctttgttgaacttgcagactagggacctatctgtaacttcaaaaccaaggggttgtgtcataaatacagattcttcaagaagcccatttagaaaagtcttattcgcatcaagctgaaacaacttccacccatgtgacagagcaagggtgagaacaatatgaatggtgacaggcttgaccacaggagaaatgaaaatcaaagccatgaatttgatgaaatcccttgactaccaaccttgctttgaacctattgatggaaccatcaacattttcctttactttgaaaatccacttacacccaatagcttgtccattggaaggtaagggtcccaagttttgtttttcaacaaagcaccatactcttgttgcatggcagcaagccaatctggatttttcaaggcttgtttcacagttttgggttcagaatgggtaagaaataaaaaaggatgtagtctaggattgtgaattccagacttgaaccttatttgcataaagtgtgtattatctggtatagaattaggtgctgaaacagactcagaagaggatgcactaggggtactggattttgaagtttgaggatgaacagaggtaggctcagaggaagtggatgatggacaaggcacagaaaaagaggttgtgggggaatgagttggaataggggaaaaaccaaagggaacaagaggtatagaaggagaatgaaagggagacaattgagaggattgaggggtaggaataacacaaggtggagataggttgggattaaggctgaagtaggaatcaagattcttaatggggttagaagatgaaggaaacatgtcagaataagggaaccttaattcattaaacagaacatctttggaaatattgattctgccaaatgaagacaaacatttgtaacctttgtgggaggaggaataccccaaaaataaacactcctgagatcgaaaatttagtttgtgtgtatggtaaggcctcaacaaggaaaacaggcacaaccaaaggttttaaggaaatgaaaatcaggatccttgttaaaaagagtaacaaaaggaatgacaaagttgagggaagcagtgggaactatgttaattagatagacaacagtagtaaaggcataatcccaaaattgtaagggtaaagaagcatgatgcaacaatgtaaggcccaaatcaactatatgtctgtgctttctttcaatcacaccattttgatgatgagtgtggggacaaatgagtctgtgggagatgtcataggaggttaagagagtagagaaaagtttgtattcacccccaatcaaattgaatactcttgattttgcagttcaaccatagatttggaagcttgaaaaacagaaagagtttcagccttaaactttgataggaaatattcaggtgtacttggcaaaagcatcaataaaggagacataatatttataaccagcatatgaagtcaaatgagaaggtccccacaaatctgtgaaaataagctccaaaggagagtaaacagaaacaaaagtgtgagatggtaatctatgagatttttccatacagcaggaagaccaaaaacctaagaaatttttatttgatggagaaattttacaatgattgaagacaagtttcattacatgaccattagggtgacctaatctaacatggtagaggctagcagtactagaagaagaaacaacataattagaaactacactagagttattattaacagtagcagttggatagacaagtcagtatctgaaattgaggttgaggtagacaacaatagaggagagttgtcttgaagcttgagattatgaaatgagtaaagaccatcagtaccaacaactccttgaagaaggactttattggtctcctgagatttcacaagaacaagtgaggatgaaattcaaagaaaacaaagttatctttagcaaattgactcacacttaacaaattttttgaaattgaaggaacatgtaataacttgtgaagtttaaatgttatgtgagcatcattggaggacacaaaagaagaggaaccaacactggagatactcaaaccttcaccattgcctatgaaaatttgatcaggtctatcaaagtgagtgaattggttgatattctgtgattcaccagtcacatgaaagctggctccaaagtctggaatccaggtagagccatcaggaccattcccacaagaggaggaatttgtgagcatagcactgggttgattggaggttggaacaacagccttggaattaggactaatccaggtattggaagttctgattgaaccagtggagttgggaattggttgaagtgtggtaggatcaaagaaggtgagtgattcatgaggctaaaaactcatattagacctaaagtggcaaacattggcaatgtgtccatacataaggcaaatttaacactgaaagttggcaaatcgaccaccatcacgacctctgtcggagccaccaccaccacgttcgacaccgcgatctggaaaatcaccacgacaaccgccacgaccatacgaacttcgagaaccagcaggatcaccggatttataagaattttggtgcgaatagccttgagtgtaattcaaggacggagaacttagcaccttgttagacttttggcaagcgtaccaatgttgttgcaggttacagatttataaaaagagattgtctccacaaggagatgagttactcaattccgccgaataaaagtaaacagttcaatagttatgtacaaatttaatcgagatatcatggatttgtctaactaatgaaaaataattgacgtaacagaatgacggaaataacagaatttagtgcgtcagaaatacgtaaaattatggaaacaataataatgaatctaattaatttaagaaaaatgtaggattggatttcatcgttctaataagattaacatatatgaatcattttctaacattactaatgaatacattaaattatcccaaatcaatccctcacactcatgaatcctaagaatatttactgaatatcgatccctctcactcaagagtcctaaaaatatttaccaaatattgatccctcgcatatgaagtaaataacccagcattacaatcataatctcgtgctatttgcaatcaaaacgtaatgctctattcctagcaatgtaacgtaaagataaattcattaagttcaaattctaagtattttccggtcaaacttaaaatccaattttatgaaattagtgatcaaatagaatcaagcattacgaacaaaatgaaattaccaataatgagtagaaaagattcatacatatataaaatatcaaaaaagatacataagggtacgaagattacatccaatcttttggagaaactagctgatcattgcgtagagcacaagatcaacaagagaaatgacgccagcaagttcatcatcatagcctttaattttacgcaaatactcatagattgatttaccgtcaagcaaaaccgcgcgcatcgcaattcgaagctgtcgagcatgagatttcttatgaagattgaagtactcatgaatcatctcccaaacttgataggagtgattcgagtcaagaatgcgcgatagaacgggtttcgagagagtagattaaagcaaaacaaggagcgtttggtcctaaacttcccaagcttcataatcaagattcatgcaatcaacaatgcgatcatccttcgtgagataacaaggcagaacgacgggattgacgatgaaacactacaatttatgcgacttgataaccggttctacatgttgccagtggagatagtttgagtcatcaagcttcttggtgatagagtttggaacgactgagaaacgagattcaaaggagcggaagctatggatgcacggatctggaacttcagaaggaacaataactacaaaaaaatggctctagataccatattcgagaaagaaagagagaaaactagagagaaaggaaactggtattattgtgatctaaaaacttaattagagttagttacaacaaaggtatatatagacttctgaccctctgaactaacactaacagactctgacttcctaatactagtgaggtgctgttagcaaaagctaacggcccttacaaacatataatctgttgtctaacactagaggggtgctgttagctaacagcccttacaattattctagaaaactattttcacagttatacaagtacatactctaatagataccatgttaagaagagaatgagagaagcaaaactattttgaatatgtctttttgggttttatcttccacccagcagattgatttatttataatcagaatgattacatggataataaataactaattctgttttcaagagaacaattaaaatatcacaacttcctaagatacattaaacccaactaactattaactaagctacttgaaaggaaattatcattaaatgctcctctttccaacaccttgttttgttgatagttcataaatgcacccactttcatgggaaaatgagtatatatcattgatagacctcacagttaattaggagtaaaaaggaaatttaacaataaagtagttttatgtttcttataattaagaccaagaaaatgttgtcttttgttacttatatagaggatcggaggtagtatcttttaaaacccattctcgtgccaaaacacaattgtagttttttagtttttcaaccgtcattttataagagctttcttttaaaataaataaataaataaaagggatgaaagtggttcatattcacccgcatcagcatattactaatactgggaactagcccttaaatatgatatctccttgatttttttctttgacatcatccctgtagagagaaatctgtatttgtgttatatcagtggcaaggcactgtacagagaggtcttgttattaacaaggaagagtgcaagtatctgtctagtacaattattgaagctgtagtatagctatatgcaatgacaattaatgcagaacttaagaactaacattaatatctcaattctcaacattccttggtgaatttcttcttcaacatgcataattaaacacaaattccctaagcctagtactgtattgttgtacaaaacacttggctagatgcattttatcttccctagctacaactccaggaactatattgtttgaatttaacagtcatgggtgtggatgtgcaggctcaaggttggaaagctaagtcaaaaaccctggaagaagttctggaatcaacttctaaaatggaaccaaaacttattggctatgatgaaactcccattgatgtaacagataccaatactgccaagcacatagtggttaatgctgacccgtacaacaactctaacccagaaatttgccctatgcaactgacagatgaaatatgctctccatgtgtgaaacctttcggccaacggcttcaatcttctgctaagggaaagcttagtcaaatatttgaaaatcgtgattgtggcagtgactcgtctgggacaggtagtataaaaatcatagtatttttgtcgatactgcgtctctgttaatcctgaatattgtttcatattttttgtacaaaggaacagcaagatcacgattgtatgaattatgtgctgcgtattgctggaaacctccttcatttgaatgctgcaagaaagagggaccagaccacctgaaacagtgagttactttaaaaataaaatgaagttttaaacatccgtactatcaggtttcagctttggaatttcactcaggatcttcatttcatcctctgaaaatccaaagttaacaatagaagttcaaaactagctatcaatgataatgagaatcacagccaaaagaaaagaaaaatatccctaaaaacttgtttatattaacatggactaaagtataaacaacaaacattcaaattttgtagactggagtggtgtccttaaagggctgtgtaatttaagcatctccatgaaaaaacgggtggattttctcattcaaatcaattacatttctgaatttttgacactggtgatgaatggatgatgataattatagttgaaatttgtaatctttttcatcaatatttagtatatatataaaacttggttcacttgcattccgtgtgttgttttcttaacgactctaggttccttcgtttcagggtacatagaactttcacttgcatttgtttattgttccatttttagatttacttgcaaggtgaccttagagatagaagaggcccagaatttgattttagagtttgttggggaacctctgtcaaagaagaaagatgcagcagagagtgcggcagagggtgcattatggtatctacaacatgaaggtttcttgcctagtattggtaattgacatattgcacaacaattatcatgtcacataaatctgaggcaatgtcttagggtgtcatttgaaatttctggatgcaccctcattgttattgataatcatataaatctagaagacaataatagataatacaggtttagtaacccagggccagagggttccctaatggtaatctattgtaaagcattatttatgtatgtattattgtagtgtcaaagttacatttatttgtaatgaccctcgattgtaacagtgaattttctatttactacgtttgaaatataaatataagctcccgaaacatttgaatggtaa

SEQ ID NO: 230 - DNA, 35587 bp, Glycine max
ttaggtgtagccactatcttaacttgaacttaatttttaataagtttggtagctcaaattttttactagctcatgaatctttgcaaatgcttccaaatcttgatcattttgtctggtacaaggtcattttagcacttgcaagtcatggacagagttccaaatacaaggggtcctcttttaaaaaagtttaggacattaaaacttatgtatttttttgtgtgtgtcttagatgttttataggttaaaaaagtacagaaaataataaaaggttgagaaaagtttaccaaaaagcttgaaacatgtgccttagtgtaaaagaaccgttgtgagtagcaatggatgtctacattcaaatttttaccattttggtaataaattttagactttgaataaaaagaaaaaaaagtgtgtttagcaattttggtgaaataatttaatttaatataaattaatgtgctaatgatcaaactagaatgttactaacatgtgattacttcacggtatttcagtaagctgtagaagccttatcaaaggcgtgcattcaacattaggtaaaattataacatttcaatcaacaatataaaatatagtaatccaacatcttaaggaagtttaactataattcttaatgaccagtcattattaatttcatcatatacttgactatctattcccaatcacaagctaatgttacattgtctatttcataacatagtctaagttttagttgaattaactactaagttttcactaaaaaaatacataaatttatgataaaataggtggtacattaaaaatgttaaaatatgttataacatcatttaattttaatttattatgcatgaaaaatttgttaacttttattataattatcttaaaaattatataaaataatttataattgattcacaatgtaaataattttatattatcaatgtaacatattaaattcttaatctatttaatcaaaacttataattatgaaaaaatcatttaaatagaaattacatgaaatcaaggtgttgccattgtggtgctcccaatagtatatacatacacaaaatctaatctttattttctctttgatagacataaaaaagtttgattgatgataataaaatagatgagtgagaataaataagaaataaaataaaattttaaaatatttgattgaagataaataaagaaaaaacgagtaaaaacaaataaaaataatacaactaagtcccacaatttttaaaaatgttttcaccctattcatatcttaccaaacaaacaaacttatttcgatttctctccctctttcctatgtttcatctatcaaaaatcaaacaaaggctaaggataatataattttttttatgtcctgatatataaattttatttctacataaaaaaaaaatataaaattgatttctaaaaagccattttgtttggaaaatactagtaacaaaaaacgacatgggggagtgttgggaatgaagtgatgcgaaaacgtgcgtggaaacaaaacaaagaacaaagactttcagtcattcagtctttagtgagcgtgttcactaaggtaactcttcactctcttctccgttgactccataatcaacgttttggttgggaacagaagtgaatgaagtgactacaaacaaagctctctctctgttattattattattattcattttctcttttcacactcctttgtcctttgaacccacccgtgaactctccaaccgtcgtcgttttgatttcacccactctcatacctccaaactctcttttcctcggctaatgccggacggagaatcctctgccgtcgccggcggccaagtttccatggaaccctctttaagcctctccgatcaactacagtccctgagtctttcccaagtaaaaaatcatgatgactcggtcaagaaagatccccggaagattgcaagaaggtaagtaacttttgctacccctttgttcttttgattattttcttcactgagtcacgtttatttttcaaatgggtgggtggagtttggctttttttattttatttttttattgttattttttgcacgtgggcttggtcattattgcttggcgttgtttgctgttgtagttagttagttattttttttgtttggcttttgagaattggagttgaagaaaacgcctgtttcaagattctgcttaaaatgtgactagttgaattgcactagcaagctttgttgtgtatgcaagattgtacttcttgcgtctgtgaaattttcaaccgagtgttttgttatttatatgttttattccagaaaatgtttttgtagttcaagaaaatgttcctaatttatggtgatcagatgtctgaaatgtgatgccgactatgcttatcttttttattcttcacttgtcttctggaactccaataatcttatgaatgttttggtcctttaaaggtatcagttggagttgtgcaaaaaagctatggaggaaaatataattgtgtatttagggacagggtgtgggaagacccacattgctgtgcttcttatgcatgagatgggtgatttgattcggaaaccacagaagaacatatgtgtctttcttgctcccactgtggctttagtccatcaggtgagctgctgtacatattgttgcattcaatgttgttattgtacaaaagtatttttttgggaagtacaatattttttttttctgggcaaattagaaatataatggaacaaatatctttttcctcccttttatttttgggtgctctgtactttggccatttcaggttgggtaattttgtgttgcaggtttacagtctgtaaggccagtgagaatggctttctgggataaataggcctagcaaggaagtattctgttgtattataactgaacatgaaaattttaatgacagatgacctttatacctttgattataatcattgcaattgggtcagtctcaatttcccgccaatctttttgaataaaacatttcttgaatctagaattagagatcttagtgatctacttgttatgtcaagcatggttgttttatgtgtgaatctgatgaattaatttgttctcgtgtttaataatgtcccaccaaactttagttttaactgatttcactatgttggtcaattccatcatgtgttttctgaagcctattttttatttatctatagcaagcaaaggttatagcagactctactgattttaaggttgggacatactgtggaagttccaagcgcttgaaacatcatcaagactgggagcaggagatgggacaatatgaggtgataatgctagttaaatcatgttgaaattaattatgtttttctctaaattattttattttatatccagacttgttactgttacagaaattttaagtaaaagctgttgaaagaaagttggtttcatcactgaaatttaatttggcaaaaaattcaaattagctcctgctgttttgaaatcttaaaatctgcttacttaaattttaattccatgttgttttttgcttctaaaatttctgtgttcttgtttttttcccttcaggttcttgttatgaccccacaaatattacatcataacttatcccattgcttcatcacaatggagatgattgcacttttgatatttgacgaatgtcatcatgctcaagtcaaaagcaaccatgcttatgcagtaatcatgaaagtatgttgcactcttgctcaactttaaagattcaaaatggagctacacaattttccacataaatttttccattttcatagcttttatttttgacaatctttaatttggcattttttcaggtcttctacaaaagtaattccacaaaggttccccgtatatttggcatgactgcttcccctgttgtaggaaaaggtaaaataatgcttatcttaaaaaaattgagtactaacaagagccaagatatttgccttcctcaattatcttccccttgttggtagcagttataatgtggatgtttgtgaaagcttttattgagaaaaataattgcttgtttttcaaaagttctcttggaaagggataaagtaaattttttttttttttactccaaataagctatttcaaacactcgttctatcaaaaaaaggttcaaggtgggagtgggggaagggaatttgtcacacagaagaaggtcaatgggttgtgtggtctattaatccatttttgtacatggatggaaaaaagtatgaaagatctggacttaagaagtcagtttgttaagttcaccaaaagacttaccctaccattaacaagcaatttttttttatatagtttgttgtgatatatcatgcaaggcactattgttgtgcctaggtagaatgtgtaaatgatatggtgtacctttatatgtgtatacattctctttatcagaataaaaagatcttaaatttcagcaaaggggctgaaagagactgactgtataggatgtggtccacatatagtttgactggaaaccattggttaactttgaaaggttcaaatgtgtcaagaaaaagaaaatcttgtgatgtgagggacctttttcttgaatatgggacagggagtgaagggacaaaccaaggtcacagacatttaatataaatttttcaattattgacaagaattttttttaatgaaaattttaacatgtcattttagttttcaatactttgacctttgtttaatttttttttctctaggactaggtccatctaatcctgcgaaatattattgaaataatatacacgtgtgtgcagttttgatggttggctttctgtttatacatatatgtacatatttttttattttgtatttgaaaaatattaactgttacctgctttacttttgggaatgttgatgttccatcatataaatgttttgttgttcttatatcccatttctgtctgttcttcaagagtgttaccctaaaatttgcctacattgttaataatatattctttctttcctttttatattttatgcatatttctattagcataattgctgaatactgatagtgtagtttattccaaatatgtaaaaccctcttcataatttctgaatttgctggttctttcaattttcaggtgcttctagtgaagcaaatttagcaaaaagcatcaacagtcttgaacatatacttgatgccaaggtacagtttatttagtacaatatgtcaaaattcttaaatttgtgaacaatatctgttgtttgtgtaaaagattttttgtcaaacttttgctgtcctttcctgtgcaagaaagcaaatgttcttcccattagctattgactagaaaccattgatataatggttgcagctgtgtattggttgagctccatataaagatatttgtgtctgaactcttctgaattccttatgtttaccttatatgcgaactgcatggttcttgtggatagttacctagttgttctgcttgttagatgctgggcatggttactaatctgtaatgatttgaatctcatttgtaggtatactctgttgaagacaaggaattgcaatcttttgtgaccactcctgtgattaatatatatcattatgtttcaactgcaagtggggaaactagcttgcacttgaaaattgaggagattaaacgccaggtgcacttttgctatgggttttaagatgattagataaataaggtttactgatccctgtgtaattttatttgaatagtgcatagcaacccttggtaggagtatagaagatcaccagaaacggatgaatacaaagaaacttctgaaccggatgcatgataatgtgattttcggtctgcagaatcttggcatttggggagcattgcaagtaagactcttgtagtgtattataagttttagttctctaatcatttgactagaaatatattaatataagtcaataatgtttttagcagaatctataaataataatacagagaaaatttttgttgttatttgttccattttgttggtcctcctacggggcccgcacacccaaagaagaaaaaacctaggaagaaaaataagcctagaataggctgtggaatttcttggttataatgttaagcttacataaattagacacagtagcagacactctacatcgattcatgaagatgaatggtttagaatggtgttttgtttcttgaagatgatgtcttggtagttggtaccaattcagtttttgctagtgaggtagatgggatatttgaagataaggggatgttatttggaattcatttagacaagtcttctgaatacatgttttccttgggttttggtgtatttatattttttcttgtgttttgttatatatctctgacatctctgttttttctttttaatttttattttgtccattcctgtggttttccatcatgcttcttgttttattgatatcgggaaatgattttataggttagaaggactgtcactgtcactatcttggtttttattctttttccttttctaatatatgtgttcaccttccaaggctagtcatattcttctgagtggtgatcattctgagaggcatgaattagtggaggcagatggaaattcaagtgatgactctctgtgtgataaatatcttgctcaggctgctgaactatttacttcacaatgcatgataggtattttgacattatctgatattcttttaatcatgccactgctgttactaggttttctggctgttatgtgcttccattttgcttgatgtgttaggctaacatttgtctagcaatgaatcagtctttttcattattgttaatttttatgatatgtttaaaacagagttcttgtaggatagatgcttcatttatattgcaactaaacatactttttttgtaggcgacagggtaactgatttatcttctgtggaaatattaaaagagccatttttctcagcaaagcttttacgactcattgggatactatccaactttaggttggcaaaactatgctgtttaaaccactcctttaatacatgttttcatatagcacaagtctcgttgatatttggttatgaaactaatatatttgggcaaattctgattacatgttccaactcaggttgcaaaagaacatgaaatgtataatttttgtgaatagaattgtgacagcaagatccctgtcatacatactacagaagctcaagcttctaagacaatggaggagtgattttctagtaggagtccatgctggactgaagagtatgtcacgaaagaccatgaacatcattgttgataaatttcgttctggagaggtattactattggatttctcattaatttttaaatgaattaaactatactcctgtatatgtgtgtataagttgctaattctcatagaagattctctgattttacctgattggcaatagatatattgagggaatgtaaaatgtctcttacattgcaaaactatgaaatagctgggacctactggagagttttgtaaaaaatattttacctaacttctcttcatgttctttaaatatgtatatatttcctagcttgttagagagttgatcgctagtaatgtgcctgcatggtcatgctgttaacagttgaatctactggttgcaaccaaagtgggtgaagaaggacttgacattcagacatgttgtctcgtcatacgatttgatcttccagaaactgttgccagcttcatacagtcaagaggtcgtgcacgtatgcctcagtcagaatatgcatttttggtggacaggtactactttctaatagatttcagaagtaatttaagcaaatccatccatttggttagttttgtaatcatcttgttgttgcagtggcaataagaaggaaattgacgtaattgatggtttcaaggaagatgaataccgaatgaatatggaagttacttttcgaacatccaaggagacatacatcatccctgaggaaagaatattcagaattgattcgtctggtgcttctgttagttctggatatagtatctcattgcttcaccaatattgttcaaagcttccacacgatgagtatgagcttatttaaactagaccattttgatccaaattatatactctgtgagattatgtcttgatattattcctgctgttgtatttattattagaatattctttttcctgttaattagtaattgattgatcttgtaatcaatactgattcatgtttcatattataaataacatgaggtgtggtctacattgccacttccattagtttcttcgtaggaggggaatgaatatcctctcacacaagattttcacataatcgtatcatatgaaaaaattgtctttcttaattttcacatagactaatatagattttgataatatccctcctattcaatgtatatgaagatagagaaataggtacagagagagagagatgagtagagagagaaacaatggggggggggtgagtgtcaggagtggcggtgaggcaagagtgagaggtacagcgagcttccatgcggacccacaacggacatcagcacacaaggatggacagcaacaaggttacagtcgagaaaattggcgggacaagagtgacatatcaacattctacttcacacgatttacagaggacatcacagagaaggaactatggtatcatttcaagaggtggggtgatgtgaaacaagaacgggaggagatttggatttgcaagattcaaaggagtggaggatgcgcacggtttagcaaagaaaatggaccagatggtcattggcggtctgaaactgtacgtgaacgtacccaagtatgggagagacacgaggaggatggcaccggcacaacccaaaacgcagtggcactaacttggaccatttggaagcatcgaaatggggtggtttttgctaatcaaactttcgaaggaagtaaagtgatggaagatgcgatttttctactatggacatggcttaaacttttggagaagggtttcaccctgcatttcaatcattggtcctctcatctcacagcagcgttttgtaattagggaaaaaaggtagttgtaatattataagtatttgtgctgtgtagtagtgtctttcctcagggtcagctggttcttattgcatgtatcttggcattctgaaccagctattaattcaatcctcttatgtatctatagtacctctggtactcatttttataaatgatacttacttttgctgagcaaaaaaaaaaaaatgttagatggaatctgttttcagacgattgcttggatgtcttggagccagtgctgcactcctaagcatatgggaggattggggatcagagatattcaaagtctcaacaaggctttgctgttcaaatggaagtggatgatgttccaccaaccagaccagctttggactagaatcctgaactctaagtataatggctggaggggattggagcatggtcctagaaagcagtatttctctacttggtgggctgacttaagggccatctctcaacatcagaatgtgatcaatgctgataatcaaattaggtggaagctggggagaggcgacaaattcctgttttgggaagatccttggggcgatgaaggagttcctctcaaggaccaattccctgaattattcactatttcttcccaaagggatttaagagtggcagaggtgggatcttggactgagagtaggtgggtctggaatatggtttggagaagacacttgtttgataacgaggtgcagctagcctctaaattcattgatcacatccatcaaatcagattaattaacaatctcaatgacacctggatttggagagctgaatccactggggttttcacatctaaatctggttatcaagttattaaagctgatagggatgatgaaggtcagtacctgggattcaagaaactctgggagattaaactccctcctaaagccctctcctttgtttggaggttactatgggatagacttcccacgaaggacaacttgattaagaggcaaattcaggtggataatgatttatgccccttctgtcatagtcaacctgaaactgcatcccacttatttttcacttgtggcaaaactatgcctatatggtgggaattcctatcttggataaaggaagaaaaggtgtttcactgcagacctttggataattttctccagcacttctcctcagcagtttcaaaggatgctaacataagaaggacaatgtggtggatagcagttacaagctcaatttggaggctcagaaatgatataattttccagaatcaaacctttgatatcactagactgacagatagcactctgttcctcttatggacctggttgaggggttgggaaaggaatttccagattccttattatagttggtcttcaaatatatctatagcttttagttaaagcttctgttagtagggatttcatctgtgtagggtgttgtatctcctgaattttcaggacccttttctgtattatgtagtacctctagtacttgttattacatattacatattatcttcgctttccaaaaaaaaaagacaattaaccaacaacagaaagaaatgctgatggggaggttttgggaggaggaagtaaaagaggccatgtgggactgtgggagtgagaaaagtccaggtccagatggtctcaatttcaagttcatcaagaaattttgggtcaccatcaagcccgatgtccttcgatttttggatgaattctatgttaaggaatgcttcccaaagggatgcaatgcatcctttatagcattaatcccaaagatggctgatccacaaggattgaatgattatagacctatttcactcataggctgtgtctacaagatcgtgagtaaggttctggccaacagattgaagaaagtgatggcttccattatagatgaacgccagtctgcatttataggtggtaggcacctgttgcacaatgtcattatagcaaatgaagtggtggaggaagctaagaggagtcataaaccatgccttgtgttcaaagttgattatgaaaaggcatacgattcagtctcatggaaatttttgaaatacatgatgagaaggatggagttttgtcccaaatggatacaatggattaaggggtgtttatcatctgcctctgtttcgattttggtgaatgggagtccctcggctgaatttacccctcaaagaggccttaggcaaggcaatccactagtgccccttctttttaatattgttgctgagggtctaaatggtttgatgagacaagctgtggagaaaaacatatttagagggtatccagtgggtagccacagagtgagcatcagcctgttacaatacgcggatgacaattttttttggggaggcatcaatggagaacactaaggcaatcaaatcaattttgaggacctttgaacttgtttcaggcctcaaaattaattttgcaaagagcaactttggtgcaattggtatgccggaatcgtggaagcaaaatgaagctgatttcttgaattgtaatctgctgtccattccttttgtgtacttggggatccccattggggataacccgaggagatgtcagttgtgggatcctataattaaaaagtgtaagaagaaattagctaagtgcaagcagagacatatcctttggggggagagttacactcatacattcagtcctaacatctatacctatttattttctttcatttttcaggattcctagaagggtggtggaaagattggtgcgtattcagcgaagattcctttggggtggtggacctgaacacaacaagattgcttaggtcaaatgggaaactgtgtgtctcccaaaagacaaaggggggctaagaattaaggacatcaacagcttcaaccttgcattgctggccaaatggaaatggagcttgttccaaaatcacacaggcctatgggctagagtgttggagtcgaagtatggtgggtggaggggtttagatgaagcatcacgtgattctaatgagtccatatggtggagggatctgaaattggcactccaccatccgcaaactaagaatgcttttcataatggtttggtgtggaagttggggtgtggcgaccgaatcaagttttgggaggatggatggcttcatgatgggacaacattacttgccaaataccctaggctatatcttaattcctgtcaacagcaacattcagcaaatgggagctcataccgacacaggttgggaatgggaccttaaatggaggaggcatttgtttgacagtgaggtatctatggctggcagttttctgggtgaggtggcaggcatacaggttcagattaattgcagggatgattgggtctggttaagtcaccaatattcagcaaaatcagcctatgatatgctgaggggggatatagtacagggagatgatgttgtagattttgtggaattgtggaagctaaggatcccaaccagaattgcagtttttgtatggaggttacttcgagatagattgccaactaaagttaatctgtgcaggcggcaggtggcaattaatgaatcaagctgcccattctgtgggagcgcggaggaggacgcggcgcattttttctttcactgcagtaaaattttacctctttggtgggaatctatgtcttgggtgagcgtatctagtgtatttccacagcacccaaggcatcattttgcccaacatatgactgccggggtggaaggaattcgggcaactagatggaggtcttggtgggcggctcttacatggttatatggcagctgaggaacaacattatattctcaagtgggactttcaacggaaacaaactgatggaggactccctatttctactttggacgtggctcagaaactatgagaaagattctatatctcactacaatcagtggtcatctaaccttagagaggcttttgtttttagacaaggaaagcagtcatagtgtattgataattgtataaccaagctgtctaatgtggttcccagcaagactgctgtcaagtgtctagtctggcttgggaaccatttatctggatttttgttgtaatcacggtacctctggtactcagattcatttctcatatatatatatatatatatatatatatatatatttatttatttatctttgctgaccaaaaaaaatagtaaaacactgttatatactcaaccaactagttccatgtaaataaagtacaaatcttgtgttttaaaatgtaataatctatctttacaggtactttgaccccaagccaagttttcattacttagatgattcagggggaatttcctgccacataacattgccttccaatgcaccaataaaccaaattttgggtacaccacagttatctatggaggcttccaaaagagaagcttgcctgaaagcaatagaagaactgtataatttgggcgctttaagtgattgtctcttgccaaaacaagatgatgcagagcctgaggtgcaggtttcaggctcttctgatgaagatgaatgtgaaggtcaaacttcagttgctttctgataagccattactttcattgtctttcactgggttgccaaaaattactgttcaaattgtattttgcaataaactgttgagcatatttacttgtcaataactatattaaggagagcgactattccagcatgttgccatgctgatcattttcagacctttcaaatactacataatccattgttggtaattatttttgtaacatacctgtctatggatttagtgttaatcccattgtcagtgtataaacttctacaccatcattcaatcatgtgttgccagatcattagaaggttttttctcctctcatgtagttattgtctcaaactcttttgtgatgatacaataacacatgattggaagagagtgtaaaagttttactccaaaatgaatcaaatcaaaattttcttatgtgttgataatctttaatgggaagctttttatttgttttcagatgtagtaccgttactatgttgattactatcaacttatgtctctagggatgcgactatatcatatgttgtgttgtactatatttattttccttttttagcagatgccatatcaagaggaaaattacatgagatgctagttccttctgcctttggacagtcatggataaatgaggataacattgtccgtctcaactcttactacataaaattttgtccctatccagaggacagggtctacaaagagtttggtctattcatgatgacctgtcttccgatggaggctgagaaattggaacttgatctccatcttgctcatggtcgatctgtgatgacaatgtttgtcccatttggagttgtagaatttaacaaagatgaggtaagtggtgtgtgtatgtgtgtgctttattttattttaagaattttgttaattaatgcttggagttttccatcctgcagattaagatggcagagaattttcaagaaatgttcctcaaaattattcttgatagattagaattcatttccgagtttgtagacttgggtatgagtgctgaatctcactcaggcacatcaaccttctaccttttgcttccagttgtattgcaagaatatggaaatgccatggaagtagattggaagatagtgaagagatgcctttgttcaccaattttcaggcatccagctgatactatggataaaaaagttttccctttagatattcacctgcaacttgccaatggttacagaagtgtaagaaatgtcgagaatagtttagtgtatgccccacataagaagaacttttattttgtcacgaatgttaactatgaaaagaatggatatagtcctcataatgattcaggcacttcaagctatgtggattacttcattgaaaagtaggtatctgtttattattatgggttcattcttgtgttattttggttttgcatccctaattcttctatgtcgatgaaggcatttatatttatgggggcttttgtaaaattgctgattaactgatggaattggatatctgagaatgttggaatatcatatattgtgcttataatatttgacaaaaatatgcatgcttgaatgccaggttttccattcacctcaaatgtccgaagcaaccacttctgcatgtgaaaccggtctccaatttgcacaacctgttacacaacagaaagcgtgaggatgcaggtattgtattggatatgttatttttagcgttagagtctgacaggaacagtgttgattaaaaagaaaaatagagccaaagctccttacaaccagaaaatattttgaaagccttggaatgtaaaacagcaactccaggaataaatgtgactgaaaaagagactccacaaagaaaatctcagccttaggaatggagaaccccacttaaaccatgttctaccaaaattgtccctatgttccttcccactatcacgatcccccttagtcattttgcgcccattcagttaggattctctactattctctttgtttcagctcagcatactcatcattcctttcatctccccccttggaccataactaactcctcttttgccccattatccataatctgaggcccccttgatgtttcttcttgagtaaacacaagatatgggcaatagagcttaatcaactaagacatgagaatttagtttttgttacctaaaaccttttacgagctagtggaatgacaaaaacatgctaggaagagatgtggtagggtgggctaatgcgtaaaatatgttaggttcgcacaagaacaagtgtaccctacgcaataataacagtggactcgaaggtccgaatatcaaccccaaagaaccaattgtattcccaattagttaagtttattaaattaataatagagatgattgaaaagaggatttaaatattttcatgattttagtttttataagaaaacaaataaacaaatataaagatagtattagtgtattaagtaagttttactttgtgatttagttaagggggagtatgaggctcttcttaacaataaaacatgggatcttattcctcttcccaaagacagacaaagcgtgggttgtaggtgggtcttcagaattaagtgggctgtaagtgggtcttcagaattaaggagaatgctgatgggactattaacaggttcaaggctaggttagtggctaaaggatttcatcaggttgttggttgtgactttaatgaagccttttctcctgtgataaaacctgttacaatcaggctaattatccctcttgctctcactaataaatgggatttgttccagctagatgtcaacaatgcctttttaaatggccatcttgaacagactatctacatgcaggaaccacaaggcttcgaaagttcagataaaaccttggtttgcaagctacaaaaagctttgtatggcctcaaacaagctccaagacagtggttggataggctcaaaggaactcttttacagcttgggtttgtggccagcaagtgcgatccttcgttgtctgtttattaagacaaagggcacattatctacattcttgtttatgtagatgatattattattactggtacctccaatgtagtaattcagcaactcaccactaagctgcattccaatttttctcttaaacaattgggaaaacttgactattttcttggtattgaaatcaaatcactggctgatgggactattctatggactcaaagcaaatatacaagagatttgcttcagaaaaccaaaatggcataagcacaacctatttcttcccctatgattgctaattgcaagttaaccaaagctgactcggatttattcggtgatccatctctctatcgatctgttgttggtgctcttcaatacacaaccattacaaaacctgagttaagctatgttgtgaacaaggtctatcagttcatggctaatcatatggactctcactggacaactgttaaatgcattctaaggcacctcaaaggctctattcatcatggtctgcatttgaaggctgctccttccttagaggtggcagacctggtggattgctttgacatggtgtatttggcagcataggaataggatggtcttccaaaatgaaagtttcaacagtcataaagtgatggagcatgctctattttattgctgaacctggcttaaaaatctggagaaaggatttgatatcctgtttcacttatggttcagtaacattagggatagttttttgtgttgaggggggatagtttatataatacaagttaggctggatgggtacctagcggttagctagatctttggtttcctaattcaagttggttagcatgtattaggtcactacagttctgcaccttgcaagtgctaggatgtatatacaactatactgcttgtactatttttaatattctatataatatatatatacttttgctgataaaaaaaaaggctgctcttcctctcagccttttactatcaaagccctgtgtgatgctgattgggcctcggatctagatgatagaaggtctacctttggtgcagtgatttattttggtcctaatttggtctcatagtggtccaagaaacaacaaattgtggctagatcttccactaaagttgaatacaggagctcgactcaagccacgactgaagttacatggattcaaactctcttaacaaagttattgttctttttcagaccccagagatttactatgacaaccaaagtgcagctatatcactcataatctagtttttcattcccggactaagcacatgaaaattgacatctttttttgtcaaggagaaagtcttagctaaagagctcaaagtgtatcatattcctgctatagatcaatgggctgattccctcactaagcctttatcaccaactcgatttctttttcttaggtccaaactcaatgttgttgatttctgattctcaaccccattgagtttaaggggagggggggggggggtattagtgtattaagtaagttttactttgtgtaaccagaagacttaatagaaaggccttggccattaccaatgtatatttggtctggccttcaaatggaccaagctgctacatgttttgagactctccagttacgtagaacgatgcacccgaatcaggtatccaagtagtagagttaggatcttgatttttagaattaaccagcattgcactaggttaggagtctttgtgagaattagttccctgattttgttctgaaccgaaggtgtttgatgaattgctttgaaatactggttccatcagagtgagagacgcatttggctcaaaatcagaatcatagcgaaaatgacacatcgttgctgtgtgaccaaatttgaagcaaacttggcactgaaaatttgcataacgaccggggcctttaccgccaccacggcgacctccattgccgcagtcagaatcattgcctccatgactgtagcctccgccgtgattgaagccaccacgatttccaaaataattggatcaattttgtgaattgaaattattcgaggatgaattgtaagaatttgaagatgaattgtaaccttgagcaacattaatcgaaggtgaattagcaaagcgcttctgaaactttttcatgtatgtctcatgtgcgagcaacagtgccactacttctctaatcggaagtgattccaacttacttttgatcattgagatcactggaccgtactcctctggtaggccttcaagaatcacgtcaaggtgttcacgcagaaaaataggatctccacacgatccaagcgcaccgactatgcatttgatgcgcaaaagaaactcacacattgttttctgttcagacattgtagttctgagttctattcgaagtatcctagctttcgcacgtgtttgcttttgaaaatactcatggatctgctcccaaagctgatatgaatgaacgcatctgataattcgagatatgattgaaacttaaagagtcgattggagccacgacaagagaatctgatcttattgttcccaattggtgtatgctggattttcatttccagcttcacaatctgcctctgtgagaaagcgcatcgggatctaaggacttgccacgaaacgctgaagtctatgagccttgatgacagattctacttgttgcctccatagcagggagttagaatcatctaacttctgagaaatcggatgaaaagaaggttcggaagcaaaattctgatttgtcaccatggatagaccttaagctctggataccatcatagagtttgagagagagaaaaagaagaaagatgaaagatattattattgatttagaaagaaaaggtcagttacaaattaattttgtttctctatttatggagaaaacaaatatggttacacataacttgactaaggcagttaactaaccaaagttagttactgctctaatagaaataattgttctaacagaatcacaagtgttctaactgaatcataattgctctaacagaataacaactgctctaactgaatcacaaagtaaaacttacttaataccctaatagagaggtttaagtaacgataagaatgatcaggagttatgactgactgataccaattttctcttaatcctagtcttaatgaaattcccccagttaattatcgattttcaaaatcaactaaaacctatgatcaagattagaagatgtttttttgccttaaatcaataccccaatgatcatggatctatcaatttaatccaaatgattaaatcaattttagggatgattaattaaagattaactaatctattggaattacccaaatagtttggatcatgcaatttggtataaaacattatctaccaattacatgcagaagatcattactatgcaatcgattgagtattaaaatgacccgttccaaataaacattaaaatgaggaagataattaattaacataaaacaatgaagaatttcatttagattaaggagaggagtacaaatggatagctacatcattactctcgaactaaggggactacccatttatgatcagagcaaaactaaagaaatcttagagagagagaaaacatcactaacaaaattgaggtgaagtgagatattattcaacccaaacagaaaccgagtataatacagtttatatagcagttacgatactgtaactgtcaactaacttgagttagttagtgcaactgctgaacagttgtcctaactaattgtcaactaacatagctgtaactgcctaactaatgtaaaccaactatagttagactaacagagtaacataactgtgtaacagcatgactaaatgaaaagaaagagttacactgagtaagtatactcctataaaaactagcaattctatatagagtaaacatagacatacctataggcaggaacaatgatcacgagatccgttctaacggtgttgtccacactcttcagctttcaaaaaccctcaaggttctctcaaattcgtaaaaagataagaataaaattgaatgcctttatttataagtcagagacctctatatatagcttcctaaagataaatacacgaaaatgtgcattacgaccatggtgaatccacctcaccacaaccgtcgtcgaaagtaacactgaagccttgggttatggattgactacgactctcttggttgaccaccgccgtggtgaggtcactcgttatcaaatccttgatgctattctgaaagggctgttatcatttgactatagctgtgttgatgaccatggccgtggtgaatggatcacatccattatcaagtgcagagtcttcaaatcttcataaatttgtgtaatttctaactctttcactcaattgagtgattgtacttttgcaatacaaaactagtatccaaatgtgagttttactaaaaaaaatgcatacaaaatgacacaaaaaatcacataaaataccacccataaagttggtttatcatgggcttactgctattgacgtgcaatgaggaaggatttgctgctgagaagtggacaatgatatacattacagatatacaatccaaaattagttcttaagattgatcctaattgattcttccatatatacatgatatgctaccataaataatctagatattataattttgatttctgacaatttgtgtcctgtgagcatttctttatgattttgtgttagcaatttaaaaagtgtactgtgcattgactactttcaaatttgtatcttgattttgaatttatcttgtattctgatcatttttcagaatcttatctaatgtatgtaacttttgaatgtcaatgacagaaccacaggagctggacgaatacttaatttatttgcctcctgagctttgtgaactaaaagtaataggtttttcgaaggatattggcagttccatatctttgctgccctcaattatgcatcgtcttggaaacttgctggtggctattgaactaaagcacatgctatcttcttcctttccagaagcagctgaaattagtgccattagagtaaggccttattaaattcaatgtattatttacattattttcaagtagtgtattcttattcacatctaaccattgcagtgcttatatgggacagatgaatcttgtatacagctactaacaattgtgaacaaattactaggttttagaggctctcaccactgagaagtgtcaggagcgcttttcccttgaaagacttgaagtgcttggtgatgctttccttaaatttgctgttgcacgtcatttttttctcatgcatgacagccttcatgaaggagaccttacaaaaaggcgttccaatgctgtaaataattccaatttgtttaagttggctattaagcgcaatttgcaggtagagttatactagcacatccctgcttcatttactaagaaagtataattattcttatttattgattttctgttagactagggtttccacagcccccacattccatttcaaaacaaaatcacctgttgatgctttcttagaacgttgatctctcattaagaccatgagaaaaaaagatatacgtgggaaataattttaataaatacctaattaattaatatatatactaaaattatattggcaatgaaaaacatatagtgccggatttgagtctgtctttaatttctagctcacccacccttatcgttttaggagatagatagacacaggactctaccaggaatcccccatttcctgctctgggacctactactgtgtctcaaaattgttgagccaaaatgagaggttcaaatcctatttatgaagttaattcatgcatttgatgtaaggtttcctggatggattaaatggtggataagttcttttctatcacataaactcctaataattaactacctacaatcctttaacagatccttcctgactaacttggatctcagttcccatcaaaataacacttggataacataaatccaaaccctatacaattcctaaccgaggattaaagatactggagttttccctagaactgaataatagaaattaactgaaccatttagtagggcttattaccttgataagatttttctatcaatatcaggctttagaatgggttaatgtatatattttaggtctttgtatatatattaggttgtgttattttattctagtctggctcattcaacccataggccatgattatatattattctatcttgtaatcttttattttttatcaatagcaaaacactttctctcttcattttcacagtgcatatttttatttactgacttgagtcttatctctatctcctcgctccctcttgcaggtctatatatgcgatcagacatttgatcccactcagttttatgcattgggccgtccttgcccaagagtttgtagcaatgaaaccgaagaaagcatacacttttgtttaaattctgttatgcaacaaggaaaagcaactgaaacccgatgtagcaaaaatcatcattggttacataggaaaacaattgctgatgtggttgaagctctggttggagcattcctagttgacagtggctttaaagctgcaattgcctttctttcatggattggcatacaagttgattttgaagcttcacaagtggttgatatctgcatagcaagtgctagctattcccctctttcttctgaagtagacattccttctcttgaaggtaagctaggacatcacttttttcataaaggcctgcttctccaggcatttgtacatccttcttacaataagcttggaggaggctgttatcaggcaagtgtaacttttcttttccctcccagtgttctgacttcatataagaattatttcctttactttatagatctatgaatcctagtgagacatttgatctttaatttttaaaatgtgataattctttgcagcgattggagtttcttggagatgctgtcttggattatttgattacttcatatctattctcagcttatcccaaactaaagcctggtcaattgacagatttgagatcattgtctgttaacaacaaggcatttgcttgtctagcggtagatcgcagttttgataattttcttttatgtgattcaagtggcctgtctgaggcaataaaaaagtatgtggactatgttagaagacctgtgtcagataatggcattaaagaagggccaaaatgtcccaaggtagatagtatgacctttatataaagttgctacacctggttgttgttgttgttgttatgcatttactcatctaagatgaagttcctaaagcattatgtctgtattcatttcaaagtttgctttaggtattttacttggaataatgctactcccacacacgacacctcacatctgtaaagtttccattatttgatcatagctcacctacactttgattctgccatctatgcttgatgtaaattgatgtgcacccactgtcccacaagatgtgtaccaagcattattcttttacttggaaatgacaagagcaaataaatggaatactaaaagagaacccaagcccttgtgtaggaagaagacacagaaaacccatccaaatgattgccaatatttttgcaaaaaagcacaaaataagccagtacatgttgggtgggaaagcctgacgcgtgacagtcaactgaacaaattatttattatattgagataagatgacaaatttaccttctgctctatgatttgtgttatggacatgagtaactcttctaggaacattacgagtcttttgtttgtccaattcaagcagctcataagttaattaagtttctgataggtgtgcattgctttgttattttgcatcaaaaggtatatggggtataaattgacatcattggtttcttcaggcactgggtgacttagtggaatcttgtgttggtgccatccttcttgattcagggttcaatttgaacaaagtttggaagattatgacttcattcttggacccaatcatgaaattctcatcaagcttgcagctcagtcctgttagggatttgcgagaactttgccaatctcataatttggagttggagtttctgccagtgccctcaaaattgactaaaaggttttcagttgaagctaaagtgagtgggaatggtgtatgtgaaacagcttcagcaactggccaaaataaaaaagaggcttgcagaattgcttcacagctactttttttaaagttcaaggtaaagcaatcatgttaagttttattttttccatccttattttctcaactcaacaccttaggattagcatttctttattgtacggtgacaccacaggtgagtatattacttttgtgattcatgtaaacaagggtaataatcatattttaactttttctgctgatgtggtgaaatcagttgtgcttatattccttaaatttctaaatactctagttgttaatgaaacaagtgttctagtttaagatgttccttgtttcttcatttggagctacttttgatcaagttcagaataatgcaatagtacctctttttcccgaaatgagaagcttggtagtaacgtcatattttttttactgtggagttcttgtaagttgaattgctatactagatagattggctcacttagtccaacagattatggacaaatttcattattatatattcattttcctttatattttccgtagagctgtctagtgtattatgtttgctttcttctgccaagttctattctttatataactttagtttgggccaatcgaaaatagtactacctccaatcctatatataagaaacaactgtctaatttatcaagatcagtaaacgtggttagattggttaacttgtcataaattttaattttattccaaaatggtacattaaatgatttaagagataattattttttaaaagataatttttcaacctatgagtataccttgcgttaagaagagagtgagagaagcaaagctattttgaatatgtctttctgggttttatcttccacccagtcaaaatgattacatggataataaataactattcttgttttcaagagaacaattaaaatatcacaattttctaagatacattgaacccaactaactattaactaagctacttgaaaggaaattatcattaaatgctcctcttttcaacactccccccaagctggagaatagattttatccattcccagcttgtataatattctatcaaaatttggagtgtgcaatcctttagtgagaatatctacaagttgaccttgtgaaggcacatatggagtgcaaatcaaaccactatccaacttttccttgataaaatgtctatccacttcaatgtgttttattcgatcatgttgtacaagattatgggctatgctaattgctgacttattatcactgtagagcttcataggtccgtcccatttaatcttcgagtcttctaagatgatttttaaccaaagcaattcacaaataccttgtgccatagcccaaaattcagcttcagctctagattgtgctacaacatcttgttttttactctccaagttaccaagtttcctcctagaaaggtacaatatttggaagtggatttactatcagctattgatccttcattgttagcattcgtataagcttcaagtattgtattcccatttcttttgtacaaaattcctcttcctggtggtgtcccctcaaggtaatgaagaattctataggtaacttgtaagtgaacttctcttggacaatgcataaattggctcaccaaactaacagcaaaagtaatatcaggccttgggtgagacaagtaaatcaattttccaactagacgttgatacatctccttatccgcttctgcaatgtcatcttcattacccaatttaaggtttgaatccatgggagtacttagagatttacaagctgtcatgcatgtctccttcggctaatctgtgacatatttttgttggaatatgaaaatacctttcttggagtgggacacttcaattcccgaaaaatatttcagcctcccaagagttttcatctcaaactcctttgctagatgctgacttaagagtagttgttccttccaatcatcactagtaacaatgatatcatccacaaatactaacaatacagtcactccccctgaggttgagtgtttgatgaataaagtgcggtctccttggctttgtttgtatcctaaggctgtcatgaccttagtgaatctcccaaaccatgtctgaggggattgtttcaacccatataaagtctttcttgactggaaaatagaattggcagcatcttcatatccaggtggaacctccatatagatttcctcctcaagctccccttgcaagaaaacattctttacatcaaactgttgtaatttccagccataatttgcagcaagagataatattactcgaactgtattcatctttgcaacaggagcaaaagtctctgagtaatctatcccataggtttgtgtgaaatccttagcgaccaatctcgccttgtacctctcaatcgacccatctaccctatattttattatatacacccacttgcaacccactggtttctttcctattggcaaagaaaccaactcccatgtcttgttcttctgcaatgcctccatttctgtatccatggcctgcttccaatttttatcaggtaatgcctcaaaaacattagtgggaattgagatagagtttaggtttgcaagaaaggttttataggttggagagattttatgaaatgaattgtaatttgagagaggatagaaaggctttttggtacatgttctggttccttttctaaaggcaatgggaagataaaggtcgtcattatgttctgaaatttccatttcatttggagaagctaaaatattatcattcaagattggaaaatcaaagttagttacctgatctaaaggagttggattggcctcttgggcaagttttgatttagaaatggcctttgatcttcttgtgtaaaccagattcttcccaaaccttgtatcattttcaagtctggtgggtgcatccttgttggattcattttgggctaatgtttcttgcttaggtttttgtgtaagatcacaattccttgtcctggaatacacaacaatggtcataaaaaacaataatacaagatatgtcatttgtatgtttctgaacagagacaagatttgtggacaattttgggacatgcaaaacattttttaggttttgaagggatttatttggatgtttcctataccggctatagttacaagagtgccatcaacaataattattttcttattgctaggacatggagaataggtggagaagatcatatggtcagtggctctagaatctaaaacccaaagggatggaaggattttttagacattaatttcaaatgaaagaggaagtatacctgaatatgccaatgtacaagtacttgatggtttttcaaggttgctaaaaaaggctctcattctttctatttttcaagcagcaggaaaaattattggaaaactgagtcgccggaattctaacagtcgctggaaaagtctccggaattttggcagttatcggaaaagtttgacagcttcaagagcccagtcaaacttgctaaataaccaaccctttttgtgcagaagcagagcacccctagatcaggagctctgatattattcgagaaaatgagagaaagaaagagagaaaacgagagagaaaggaaaatgatattattgtgatctgaaaagttagttagaattagttacaacagaggtatatatagacctctgaccctctgaactatcactaacagactctgacttcctaatactagtgaggtgttgttagcaaaagctaatagaccttacaaacatataatctgatgtctaacactagaggggtgctgttagcaaaagctaacggcccttacaatcattctataaaactgttttcacagttatacaagtacttactctaataccccccccccccccccccctcaaactcaaggagaagagttttgagaagaaacactcttcacattgaatttgtccctgagaacttcaaatcttgctgcagaaagaggcttggtcagtacatcagcccactggtccagagctggaatatgcacaatggaaagttgcttggccagaatcttttctcttacgaagaagacatcaattttcatgtgttttgtacgaatgtgaaacacaggattgtgagcaataggcacggttctctgattatcacaaaagattataggagtagtgaatggaacttgaaactctgttaggagagcatgaatccatgttaacttagtggaagtttgagttaaaatgcgatactcagcttcaatactagacctgacagcgaccttttgtttgcgagaccaccaagatattaagtttggaccaagaaatatggcagcccctgaggtggaacgcctgtcatccacattggatgcccagtcagcatcacaacagaacacgcgaagagccaagggcttggtaacagaagtaggctaaagaagtagtccatgaaacaaagtacccttgagatacctcaagattcttttcagcaccgcctagtgagagtttagagatgcagccataaattgacaaactttattgacaacaaagttgatttcaggcctagtaagagtagcatattgtaagacaccaactatagacctgtatagagttgaatcatgaaagatatcaacaccatgtcgagataacttgcaattagagaccatgggggaagaaatagaataagctttagttatgtgagttttgtggagtaaatcatgaatatatttactccgagtcatcaatatggagttattgggtagatacttgatctctagacccaaaaaataatccaaatgaccaagttgcttgagagagaatgcaatgtgtagtttggttgtgagctgctgaattagagaagcagtgctacccgtgatgatgatatcgtccacatatagactaaaagatagacaatatgcatttgttgctcgtagatgaaaagggaagaatcacatttgctcccaacaaatccaaactgcagcagagtaaatttcagtctatcaaaccattgccttggggcctatttcaagccatagagagctttgttgaacttgcagactagggacctatctgtaacttcaaaaccaaggggttgtgtcataaatacagattcttcaagaagcccatttagaaaagtcttattcgcatcaagctgaaacaacttccacccatgtgacagagcaagggtgagaacaatatgaatggtgacaggcttgaccacaggagaaatgaaaatcaaagccatgaatttgatgaaatcccttgactaccaaccttgctttgaacctattgatggaaccatcaacattttcctttactttgaaaatccacttacacccaatagcttgtccattggaaggtaagggtcccaagttttgtttttcaacaaagcaccatactcttgttgcatggcagcaagccaatctggatttttcaaggcttgtttcacagttttgggttcagaatgggtaagaaataaaaaaggatgtagtctaggattgtgaattccagacttgaaccttatttgcataaagtgtgtattatctggtatagaattaggtgctgaaacagactcagaagaggatgcactaggggtactggattttgaagtttgaggatgaacagaggtaggctcagaggaagtggatgatggacaaggcacagaaaaagaggttgtgggggaatgagttggaataggggaaaaaccaaagggaacaagaggtatagaaggagaatgaaagggagacaattgagaggattgaggggtaggaataacacaaggtggagataggttgggattaaggctgaagtaggaatcaagattcttaatggggttagaagatgaaggaaacatgtcagaataagggaaccttaattcattaaacagaacatctttggaaatattgattctgccaaatgaagacaaacatttgtaacctttgtgggaggaggaataccccaaaaataaacactcctgagatcgaaaatttagtttgtgtgtatggtaaggcctcaacaaggaaaacaggcacaaccaaaggttttaaggaaatgaaaatcaggatccttgttaaaaagagtaacaaaaggaatgacaaagttgagggaagcagtgggaactatgttaattagatagacaacagtagtaaaggcataatcccaaaattgtaagggtaaagaagcatgatgcaacaatgtaaggcccaaatcaactatatgtctgtgctttctttcaatcacaccattttgatgatgagtgtggggacaaatgagtctgtgggagatgtcataggaggttaagagagtagagaaaagtttgtattcacccccaatcaaattgaatactcttgattttgcagttcaaccatagatttggaagcttgaaaaacagaaagagtttcagccttaaactttgataggaaatattcaggtgtacttggcaaaagcatcaataaaggagacataatatttataaccagcatatgaagtcaaatgagaaggtccccacaaatctgtgaaaataagctccaaaggagagtaaacagaaacaaaagtgtgagatggtaatctatgagatttttccatacagcaggaagaccaaaaacctaagaaatttttatttgatggagaaattttacaatgattgaagacaagtttcattacatgaccattagggtgacctaatctaacatggtagaggctagcagtactagaagaagaaacaacataattagaaactacactagagttattattaacagtagcagttggatagacaagtcagtatctgaaattgaggttgaggtagacaacaatagaggagagttgtcttgaagcttgagattatgaaatgagtaaagaccatcagtaccaacaactccttgaagaaggactttattggtctcctgagatttcacaagaacaagtgaggatgaaattcaaagaaaacaaagttatctttagcaaattgactcacacttaacaaattttttgaaattgaaggaacatgtaataacttgtgaagtttaaatgttatgtgagcatcattggaggacacaaaagaagaggaaccaacactggagatactcaaaccttcaccattgcctatgaaaatttgatcaggtctatcaaagtgagtgaattggttgatattctgtgattcaccagtcacatgaaagctggctccaaagtctggaatccaggtagagccatcaggaccattcccacaagaggaggaatttgtgagcatagcactgggttgattggaggttggaacaacagccttggaattaggactaatccaggtattggaagttctgattgaaccagtggagttgggaattggttgaagtgtggtaggatcaaagaaggtgagtgattcatgaggctaaaaactcatattagacctaaagtggcaaacattggcaatgtgtccatacataaggcaaatttaacactgaaagttggcaaatcgaccaccatcacgacctctgtcggagccaccaccaccacgttcgacaccgcgatctggaaaatcaccacgacaaccgccacgaccatacgaacttcgagaaccagcaggatcaccggatttataagaattttggtgcgaatagccttgagtgtaattcaaggacggagaacttagcaccttgttagacttttggcaagcgtaccaatgttgttgcaggttacagatttataaaaagagattgtctccacaaggagatgagttactcaattccgccgaataaaagtaaacagttcaatagttatgtacaaatttaatcgagatatcatggatttgtctaactaatgaaaaataattgacgtaacagaatgacggaaataacagaatttagtgcgtcagaaatacgtaaaattatggaaacaataataatgaatctaattaatttaagaaaaatgtaggattggatttcatcgttctaataagattaacatatatgaatcattttctaacattactaatgaatacattaaattatcccaaatcaatccctcacactcatgaatcctaagaatatttactgaatatcgatccctctcactcaagagtcctaaaaatatttaccaaatattgatccctcgcatatgaagtaaataacccagcattacaatcataatctcgtgctatttgcaatcaaaacgtaatgctctattcctagcaatgtaacgtaaagataaattcattaagttcaaattctaagtattttccggtcaaacttaaaatccaattttatgaaattagtgatcaaatagaatcaagcattacgaacaaaatgaaattaccaataatgagtagaaaagattcatacatatataaaatatcaaaaaagatacataagggtacgaagattacatccaatcttttggagaaactagctgatcattgcgtagagcacaagatcaacaagagaaatgacgccagcaagttcatcatcatagcctttaattttacgcaaatactcatagattgatttaccgtcaagcaaaaccgcgcgcatcgcaattcgaagctgtcgagcatgagatttcttatgaagattgaagtactcatgaatcatctcccaaacttgataggagtgattcgagtcaagaatgcgcgatagaacgggtttcgagagagtagattaaagcaaaacaaggagcgtttggtcctaaacttcccaagcttcataatcaagattcatgcaatcaacaatgcgatcatccttcgtgagataacaaggcagaacgacgggattgacgatgaaacactacaatttatgcgacttgataaccggttctacatgttgccagtggagatagtttgagtcatcaagcttcttggtgatagagtttggaacgactgagaaacgagattcaaaggagcggaagctatggatgcacggatctggaacttcagaaggaacaataactacaaaaaaatggctctagataccatattcgagaaagaaagagagaaaactagagagaaaggaaactggtattattgtgatctaaaaacttaattagagttagttacaacaaaggtatatatagacttctgaccctctgaactaacactaacagactctgacttcctaatactagtgaggtgctgttagcaaaagctaacggcccttacaaacatataatctgttgtctaacactagaggggtgctgttagctaacagcccttacaattattctagaaaactattttcacagttatacaagtacatactctaatagataccatgttaagaagagaatgagagaagcaaaactattttgaatatgtctttttgggttttatcttccacccagcagattgatttatttataatcagaatgattacatggataataaataactaattctgttttcaagagaacaattaaaatatcacaacttcctaagatacattaaacccaactaactattaactaagctacttgaaaggaaattatcattaaatgctcctctttccaacaccttgttttgttgatagttcataaatgcacccactttcatgggaaaatgagtatatatcattgatagacctcacagttaattaggagtaaaaaggaaatttaacaataaagtagttttatgtttcttataattaagaccaagaaaatgttgtcttttgttacttatatagaggatcggaggtagtatcttttaaaacccattctcgtgccaaaacacaattgtagttttttagtttttcaaccgtcattttataagagctttcttttaaaataaataaataaataaaagggatgaaagtggttcatattcacccgcatcagcatattactaatactgggaactagcccttaaatatgatatctccttgatttttttctttgacatcatccctgtagagagaaatctgtatttgtgttatatcagtggcaaggcactgtacagagaggtcttgttattaacaaggaagagtgcaagtatctgtctagtacaattattgaagctgtagtatagctatatgcaatgacaattaatgcagaacttaagaactaacattaatatctcaattctcaacattccttggtgaatttcttcttcaacatgcataattaaacacaaattccctaagcctagtactgtattgttgtacaaaacacttggctagatgcattttatcttccctagctacaactccaggaactatattgtttgaatttaacagtcatgggtgtggatgtgcaggctcaaggttggaaagctaagtcaaaaaccctggaagaagttctggaatcaacttctaaaatggaaccaaaacttattggctatgatgaaactcccattgatgtaacagataccaatactgccaagcacatagtggttaatgctgacccgtacaacaactctaacccagaaatttgccctatgcaactgacagatgaaatatgctctccatgtgtgaaacctttcggccaacggcttcaatcttctgctaagggaaagcttagtcaaatatttgaaaatcgtgattgtggcagtgactcgtctgggacaggtagtataaaaatcatagtatttttgtcgatactgcgtctctgttaatcctgaatattgtttcatattttttgtacaaaggaacagcaagatcacgattgtatgaattatgtgctgcgtattgctggaaacctccttcatttgaatgctgcaagaaagagggaccagaccacctgaaacagtgagttactttaaaaataaaatgaagttttaaacatccgtactatcaggtttcagctttggaatttcactcaggatcttcatttcatcctctgaaaatccaaagttaacaatagaagttcaaaactagctatcaatgataatgagaatcacagccaaaagaaaagaaaaatatccctaaaaacttgtttatattaacatggactaaagtataaacaacaaacattcaaattttgtagactggagtggtgtccttaaagggctgtgtaatttaagcatctccatgaaaaaacgggtggattttctcattcaaatcaattacatttctgaatttttg

SEQ ID NO: 231 - protein, 906 aa, Glycine max
MASFGPNGTENEDSLPPPPPVVPSDVVPVKAEPEKKKASRFPIARRGLASKGTKLQLLTNHYRVNVANTDGHFYQYSVALFYDDGRPVEGKGVGRKLLDRVHETYDSELNGKDFAYDGEKTLFTLGSLARNKLEFTVVLEDVIATRNNGNCSPEGNGELNESDKKRMRRPNRSKAFKVELSYASKIPLQAIANALRGQESENYQEAIRVLDIILRQHAAKQGCLLVRQSFFHNNPKNFADVGGGVLGCRGFHSSFRTTQSGLSLNIDVSTTMIITPGPVVDFLISNQNVRDPFSLDWAKAKRTLKNLRIKSSPSNQEFKITGLSELPCKDQMFTLKKKGGDDDTEEEVTVYDYFVNIRKIDLRYSGDLPCINVGKPKRPTYIPLELCSLVSLQRYTKALSTLQRSSLVEKSRQKPQERMRVLSDALKSSNYGSEPMLRNCGISISPNFTEVEGRVLQAPRLKFGNGEDFNPRNGRWNFNNKKIVKPTKIERWAVVNFSARCDIRGLVRDLIKCGGMKGIVIDQPFDVFEENGQFRRAPPVVRVEKMFELVQSKLPGAPQFLLCLLPERKNSDLYGPWKKKNLAEFGIVTQCIAPTRVNDQYLTNVLLKINAKLGGLNSMLGVEHSPSIPIVSRAPTIIIGMDVSHGSPGQTDIPSIAAVVSSREWPLISKYRASVRTQSPKMEMIDNLFKKVSDKEDEGIMRELLLDFYTSSGNRKPDNIIIFRDGVSESQFNQVLNIELDQIIEACKFLDEKWNPKFLVIVAQKNHHTKFFQPGAPDNVPPGTVIDNKICHPRNYDFYMCAHAGMIGTSRPTHYHVLLDEIGFSPDDLQELVHSLSYVYQRSTTAISVVAPICYAHLAATQMGQFMKFEDKSETSSSHGGSGIPAPPVPQLPRLQDKVSSSMFFC

SEQ ID NO: 232 - protein, 906 aa, Glycine max
MASSGPNGTDNGDSLPPPPPVVPSDVVPVKAELEKKKALRLPIARRGLASKGTKLQLLTNHYRVNVANTDGHFYQYSVALFYDDGRPVEGKGVGRKLLDRVHETYDSELNGKDFAYDGEKTLFTLGSLARNKLEFTVVLEDIIASRNNGNCSPDGNGELNESDKKRMRRPNSSKAFKVELSYASKIPLQAIANALRGQESENYQEAIRVLDIILRQHAAKQGCLLVRQSFFHNDPKNFADVGGGVLGCRGFHSSFRTTQSGLSLNIDVSTTMIITPGPVVDFLISNQNVRDPFSLDWAKAKRTLKNLRIKASPSNQEFKITGISEFPCKDQTFTLKRKGGDDVAEEEVTVYDYFVNIRKIDLRYSGDLPCINVGKPKRPTYIPLELCSLVSLQRYTKALSTLQRASLVEKSRQKPQERMRVLTDALKSSNYGSEPMLRNCGISISPNFTEVEGRVLQAPRLKFGNGEDFNPRNGRWNFNNKKIVKPTKIERWAVVNFSARCDTRGLVRDLIKCGGMKGIVIDQPFDVFEENGQFRRAPPVVRVEKMFELVQSKLPGAPQFLLCLLPERKNSDLYGPWKKKNLAEFGIVTQCIAPTRVNDQYLTNVLLKINAKLGGLNSILGVEHSPSIPIVSRAPTIIIGMDVSHGSPGQTDIPSIAAVVSSREWPLISKYRASVRTQSPKMEMIDNLFKKVSDKEDEGIMRELLLDFYTSSGNRKPDNIIIFRDGVSESQFNQVLNIELDQIIEACKFLDEKWNPKFLVIVAQKNHHTKFFQPGAPDNVPPGTVIDNKICHPRNYDFYMCAHAGMIGTSRPTHYHVLLDEIGFSPDDLQELVHSLSYVYQRSTTAISVVAPICYAHLAATQMGQFMKFEDKSETSSSHGGSGMPAPPVPQLPRLQENVSSSMFFC

SEQ ID NO: 233 - protein, 947 aa, Glycine max
MNQRSPTHGTEPQRIIALLTHKRERETMTKEAMDSFEPDGNGKESLPPPPPVVPSDIVPLKAEEVLCTPTEHNKKKASRLPIARSGLGSKGNKIQLLTNHFKVNVAKNDGHFFHYSVAFTYEDGRPVEGKGVGRKIIDRVQETYHSDLNGKDFAYDGEKSLFTVGSLPQNKLEFEVVLEDVTSNRNNGNCSPDGLGDNESDRKRMRRPYRSKSFKVEISFAAKIPMQAIASALRGQETENFQEAIRVLDIILRQHAAKQGCLLVRQSFFHNNPNNFADVGGGVLGCRGFHSSFRTTQSGLSLNIDVSTTMIISPGPVVDFLISNQNVRDPFQLDWAKAKRTLKNLRIKTSPSNQEFKISGLSELPCREQTFTLKGKGGGDGEDGNEEITVYDYFVKVRKIDLRYSADLPCINVGKPKRPTFFPIEVCELVSLQRYTKALSTLQRASLVEKSRQKPQERMKILSDALRTSNYGAEPMLRNCGISISTGFTEVEGRVLPAPRLKFGNGEDLNPRNGRWNVSRVKFVEPSKIERWAVANFSARCDVRGLVRDLIRIGDMKGITIEQPFDVFDENPQFRRAPPMVRVEKMFEHIQSKLPGAPQFLLCLLPDRKNCDIYGPWKKKNLADFGIINQCMCPLRVNDQYLTNVMLKINAKLGGLNSLLGVEHSPSLPVVSKAPTLILGMDVSHGSPGQTDIPSIAAVVSSRHWPLISKYRACVRTQSAKMEMIDNLFKLVSEKEDEGIIRELLLDFYTTSGRRKPENIIIFRDGVSESQFNQVLNIELDRIIEACKFLDENWEPKFVVIVAQKNHHTRFFQPGSPDNVPPGTVIDNKICHPRNYDFYLCAHAGMIGTSRPTHYHVLLDQVGFSPDQLQELVHSLSYVYQRSTTAISVVAPICYAHLAATQLGQFMKFEDKSETSSSHGGLSGAGAVPVPQLPPLQENVRNTMFFC

SEQ ID NO: 234 - protein, 915 aa, Glycine max
MDSFEPDGNGKESLPPPPPVVPSDIVPLKAEEVLCTPTEHNKKKASRLPIARSGLGSKGNKIQLLTNHFKVNVAKNDGHFFHYSVAFTYEDGRPVEGKGVGRKIIDRVQETYHSDLNGKDFAYDGEKSLFTVGSLPQNKLEFEVVLEDVTSNRNNGNCSPDGLGDNESDRKRMRRPYRSKSFKVEISFAAKIPMQAIASALRGQETENFQEAIRVLDIILRQHAAKQGCLLVRQSFFHNNPNNFADVGGGVLGCRGFHSSFRTTQSGLSLNIDVSTTMIISPGPVVDFLISNQNVRDPFQLDWAKAKRTLKNLRIKTSPSNQEFKISGLSELPCREQTFTLKGKGGGDGEDGNEEITVYDYFVKVRKIDLRYSADLPCINVGKPKRPTFFPIEVCELVSLQRYTKALSTLQRASLVEKSRQKPQERMKILSDALRTSNYGAEPMLRNCGISISTGFTEVEGRVLPAPRLKFGNGEDLNPRNGRWNVSRVKFVEPSKIERWAVANFSARCDVRGLVRDLIRIGDMKGITIEQPFDVFDENPQFRRAPPMVRVEKMFEHIQSKLPGAPQFLLCLLPDRKNCDIYGPWKKKNLADFGIINQCMCPLRVNDQYLTNVMLKINAKLGGLNSLLGVEHSPSLPVVSKAPTLILGMDVSHGSPGQTDIPSIAAVVSSRHWPLISKYRACVRTQSAKMEMIDNLFKLVSEKEDEGIIRELLLDFYTTSGRRKPENIIIFRDGVSESQFNQVLNIELDRIIEACKFLDENWEPKFVVIVAQKNHHTRFFQPGSPDNVPPGTVIDNKICHPRNYDFYLCAHAGMIGTSRPTHYHVLLDQVGFSPDQLQELVHSLSYVYQRSTTAISVVAPICYAHLAATQLGQFMKFEDKSETSSSHGGLSGAGAVPVPQLPPLQENVRNTMFFC

SEQ ID NO: 235 - protein, 881 aa, Glycine max
MEVSKRVPMARKEVGSKGEPRQLLANHFGVCLVKPKDDIDGYFYHYDVAMSYEDGNPVEAKGVGRKVLNQVCETYVELRNMSFAYDGEKSLFTLGPLASQRLQYPVVLEDVSSRRVGKNGNPAESPKGGYTKRMRIRHQFRPKTINVDIKYAAKIPLQAIEDALRGRDSEKSQEAVRVLDIILRQHSANQGYLLVRQSFFHDNRRTCTDIGGGVQGCRGFHSSFRVTQGGLSLNMDVTTTMIVKPGPVVDFLLQNQSVQNPNYIDWTKAKRMLKNLRIRANGVEFKISGLSDNTCRNQKFLLRQKGTNGEVQEREITVHDYFTRQKLIGLNYSADMPCINVGKPKRPSYFPIELCEMVSLQRYTKALTNLQRAQLVEKTRQKPQVRRQALEDALRSSRYDDEPMLRSSGITIEPNFVRLVGRVLEPPKLIVGGEKSIIPRNGRWNFNNKKLYEPLMIGRWAIVNFSSRCDTRLLIELIRRCAAAKGMTMSNSLFDKVIEEDGCFIREPPNVRVERMYAKLRTTLPHEKPHFLLCILPEKKNSDIYGPWKKKSLVEEGIVTQCIAPTKINDQYITNVLLKINAKYGGMNSYLSVELCNSIPFVSAVPTLILGMDVSHGSPGRSDVPSIAAVVSSRCWPQISRYRASVRTQSSKVEMIQSLFKPVANTNKDEGIIREVLLDFEITSFKRKPQQIIIFRDGVSESQFNQVLNIELSQIIEACKHLDEKWDPKFTLIIAQKNHHTRFFQANARDQTNVPPGTVIDNTVCHPKNNDFYLCAQAGMIGTTRPTHYHVLHDEIGFSADEVQELVHSLSYTYQRSTTAVSLVAPICYAHLAAAQMAQFMKFDEHSETSSTHGGLTSASAPLVPQLPRLHKQVINSMFFC

SEQ ID NO: 236 - protein, 874 aa, Glycine max
MEVSKRVPMARKEVGSKGEPRQLLANHFGVCLVKPKDDIDGYFYHYDVAMSYEDGNPVEAKGVGRKVLNQVCETYVELRNMSFAYDGEKSLFTLGPLASQRLQYPVVLEDVSSRRVGKNGNPAESPKGGYTKRMRIRHQFRPKTINVDIKYAAKIPLQAIEDALRGRDSEKSQEAVRVLDIILRQHSANQGYLLVRQSFFHDNRRTCTDIGGGVQGCRGFHSSFRVTQGGLSLNMDVTTTMIVKPGPVVDFLLQNQSVQNPNYIDWTKAKRMLKNLRIRANGVEFKISGLSDNTCRNQKFLLRQKGTNGEVQEREITVHDYFTRQKLIGLNYSADMPCINVGKPKRPSYFPIELCEMVSLQRYTKALTNLQRAQLVEKTRQKPQVRRQALEDALRSSRYDDEPMLRSSGITIEPNFVRLVGRVLEPPKLIVGGEKSIIPRNGRWNFNNKKLYEPLMIGRWAIVNFSSRCDTRLLIELIRRCAAAKGMTMSNSLFDKVIEEDGCFIREPPNVRVERMYAKLRTTLPHEKPHFLLCILPEKKNSDIYGPWKKKSLVEEGIVTQCIAPTKINDQYITNVLLKINAKYGGMNSYLSVELCNSIPFVSAVPTLILGMDVSHGSPGRSDVPSIAAVVSSRCWPQISRYRASVRTQSSKVEMIQSLFKPVANTNKDEGIIREVLLDFEITSFKRKPQQIIIFRDGVSESQFNQVLNIELSQIIEACKHLDEKWDPKFTLIIAQKNHHTRFFQANARDQTNVPPGTVIDNTVCHPKNNDFYLCAQAGMILCHFGQPLSPFGHGGIHRRDPPGTPLRHRRGPGPLRRHLGGREPGVPWFPLLSPLTSNIEMCISHIGWWGQLDLLTTMFYTMKSDSQLMKCKN

SEQ ID NO: 237 - protein, 393 aa, Glycine max
MSNSLFDKVIEEDGCFIREPPNVRVERMYAKLRTTLPHEKPHFLLCILPEKKNSDIYGPWKKKSLVEEGIVTQCIAPTKINDQYITNVLLKINAKYGGMNSYLSVELCNSIPFVSAVPTLILGMDVSHGSPGRSDVPSIAAVVSSRCWPQISRYRASVRTQSSKVEMIQSLFKPVANTNKDEGIIREVLLDFEITSFKRKPQQIIIFRDGVSESQFNQVLNIELSQIIEACKHLDEKWDPKFTLIIAQKNHHTRFFQANARDQTNVPPGTVIDNTVCHPKNNDFYLCAQAGMIGTTRPTHYHVLHDEIGFSADEVQELVHSLSYTYQRSTTAVSLVAPICYAHLAAAQMAQFMKFDEHSETSSTHGGLTSASAPLVPQLPRLHKQVINSMFFC

SEQ ID NO: 238 - protein, 913 aa, Glycine max
MEVAITRAKGGMTEEVPGIVEAAEPPTSSQSPADVPHNLETEQMTPTKYSIISRNGVGTTGKHIPLLVNLFEVAVNVPDTVFFQYSVAITFEDKQAVESKGIGRKVIDRLYQTYSSELGGKRFVYDGGKTLYTVGPLPLNKYEFKVLLEKSFTKRSAKSPGANGSLHEETKRSKHSFQSKTFMVEISFATKIPLQSIVISLKEVESDTNSQDALRVLDTILRQRAANCGCLLVRQSFFHDDSRNFNDVGAGVTAVSGFHSSFRSTQRGLSLNIDVSTTIIIKPGPVIDFLLSNQQVKEPRYIDWEKAKKMLKNLRVQATHHNQEFKISGLSEKPCIQQLFSMKVKNDDNNSRGQTVDITVYEYFAKHCGIELTSSAYLPCLDVGKPKRPVYLPLELCSLVSLQRYTKVLSLMQRASLVEKSRQKPQDRIKILKSAVGKCYDDDPVLAACGISIEKQLNLIEGRVLETPKLKVGKNDDCIPHNGRWNFNKKTLLQASHIDYWAVVNFSASCDTSYISRELIRCGMSKGINIERPYTLIEEEPQLRKSHPVARVERMFDLLASKLNREPKLILCVLPERKICDIYGPWKKKCLSEIGVVTQCIAPVKITNQYLTNVLLKINSKLGGINSLLAIEHSGHLPLIKDTPTMILGMDVSHNSLGRLDSPSIAAVVGSRHWPLISRYRASVRMQASKVEMIDALYKPLENGSDDGIIRELLLDFYDSSNGRKPTQFIVFRDGVSESQFEQVLTIELNQIIKAYQHLGEVNVPQFTVIVAQKKHHIKLFLPNGPENVPPGTVVDTTITHPRNYDFYMCAHAGMLGTSRPVHYHVLLDEIGFSADGLQNLIHSLSYVNQRSTIATSVVAPICYAHHAAAQMGQLLNFDDSSETGSSPASEGGIPIPELPRLHRNVRSSMFFC

SEQ ID NO: 239 - protein, 911 aa, Glycine max
MSLGNAKGGMTEEVPGIVEAAEPPTSSQSPADVPHNLETEQMTPTKYSIISRNGVGTTGKHIPLLVNLFEVAVNVPDTVFFQYSVAITFEDKQAVESKGIGRKVIDRLYQTYSSELGGKRFVYDGGKTLYTVGPLPLNKYEFKVLLEKSFTKRSAKSPGANGSLHEETKRSKHSFQSKTFMVEISFATKIPLQSIVISLKEVESDTNSQDALRVLDTILRQRAANCGCLLVRQSFFHDDSRNFNDVGAGVTAVSGFHSSFRSTQRGLSLNIDVSTTIIIKPGPVIDFLLSNQQVKEPRYIDWEKAKKMLKNLRVQATHHNQEFKISGLSEKPCIQQLFSMKVKNDDNNSRGQTVDITVYEYFAKHCGIELTSSAYLPCLDVGKPKRPVYLPLELCSLVSLQRYTKVLSLMQRASLVEKSRQKPQDRIKILKSAVGKCYDDDPVLAACGISIEKQLNLIEGRVLETPKLKVGKNDDCIPHNGRWNFNKKTLLQASHIDYWAVVNFSASCDTSYISRELIRCGMSKGINIERPYTLIEEEPQLRKSHPVARVERMFDLLASKLNREPKLILCVLPERKICDIYGPWKKKCLSEIGVVTQCIAPVKITNQYLTNVLLKINSKLGGINSLLAIEHSGHLPLIKDTPTMILGMDVSHNSLGRLDSPSIAAVVGSRHWPLISRYRASVRMQASKVEMIDALYKPLENGSDDGIIRELLLDFYDSSNGRKPTQFIVFRDGVSESQFEQVLTIELNQIIKAYQHLGEVNVPQFTVIVAQKKHHIKLFLPNGPENVPPGTVVDTTITHPRNYDFYMCAHAGMLGTSRPVHYHVLLDEIGFSADGLQNLIHSLSYVNQRSTIATSVVAPICYAHHAAAQMGQLLNFDDSSETGSSPASEGGIPIPELPRLHRNVRSSMFFC

SEQ ID NO: 240 - protein, 902 aa, Glycine max
MTEEVPGIVEAAEPPTSSQSPADVPHNLETEQMTPTKYSIISRNGVGTTGKHIPLLVNLFEVAVNVPDTVFFQYSVAITFEDKQAVESKGIGRKVIDRLYQTYSSELGGKRFVYDGGKTLYTVGPLPLNKYEFKVLLEKSFTKRSAKSPGANGSLHEETKRSKHSFQSKTFMVEISFATKIPLQSIVISLKEVESDTNSQDALRVLDTILRQRAANCGCLLVRQSFFHDDSRNFNDVGAGVTAVSGFHSSFRSTQRGLSLNIDVSTTIIIKPGPVIDFLLSNQQVKEPRYIDWEKAKKMLKNLRVQATHHNQEFKISGLSEKPCIQQLFSMKVKNDDNNSRGQTVDITVYEYFAKHCGIELTSSAYLPCLDVGKPKRPVYLPLELCSLVSLQRYTKVLSLMQRASLVEKSRQKPQDRIKILKSAVGKCYDDDPVLAACGISIEKQLNLIEGRVLETPKLKVGKNDDCIPHNGRWNFNKKTLLQASHIDYWAVVNFSASCDTSYISRELIRCGMSKGINIERPYTLIEEEPQLRKSHPVARVERMFDLLASKLNREPKLILCVLPERKICDIYGPWKKKCLSEIGVVTQCIAPVKITNQYLTNVLLKINSKLGGINSLLAIEHSGHLPLIKDTPTMILGMDVSHNSLGRLDSPSIAAVVGSRHWPLISRYRASVRMQASKVEMIDALYKPLENGSDDGIIRELLLDFYDSSNGRKPTQFIVFRDGVSESQFEQVLTIELNQIIKAYQHLGEVNVPQFTVIVAQKKHHIKLFLPNGPENVPPGTVVDTTITHPRNYDFYMCAHAGMLGTSRPVHYHVLLDEIGFSADGLQNLIHSLSYVNQRSTIATSVVAPICYAHHAAAQMGQLLNFDDSSETGSSPASEGGIPIPELPRLHRNVRSSMFFC

SEQ ID NO: 241 - protein, 902 aa, Glycine max; identical to SEQ ID NO: 240

SEQ ID NO: 242 - protein, 882 aa, Glycine max
VTTVTKKVDPSLSLETNVPARVAILKKICFSFAQTLFCPHLFSFAQRYATMAKRKTSDASDAQDDTVSLLPSQRNKAKHPNSNSNACFAGKPIPPAEALAKWPHRYPSEGKKKGSARTSKEATSENSEVMPARCHYRQAKVDGVVYNLYDDAYVKAEDGKPDYIARIVEMFETVDKEQCFTAQWFYRAEDTVIKNHGDLVDKKRIFISDVKDVNPLDCIVSKVKIYKKSPSVDLTSKKGKLPSCDYYYDMKYTVPYLTFSNIVNETVKTESDASSTISSESGSNGCVSNANLANGKTTQNNSSGSSEWTLLDLYSGCGAMSTGLCFGASLAGIKLVTRWAVDINAHACESLKLNHPETQVRNEPAEDFLNLIKSWAKLCEEFALLGSERLDSDPDMDEDENEAVRKEESGNQSDSEEFEVEKLLAVCYGDPNDVKKPGLYFKVRWLGYASSYDTWEPIEGLSDCKEAMKDFVTKGYKKRLLPLPGDANFICGGPPCQGVSGFNRFRNAAAPLEDTKNKQLLVYMDIIDFLKPKYVLMENVVDILRFSGGYLGRYAICRLVAMNYQARMGMMAAGSYGLPQFRMRVFLWGARPTEKLPPYPLPTHEVVSRGSVPTEFEEITVAYDKKDTCHLAGALLLEDAISDLPHVTNDENQDERNYEAPSETEFQKYIRLKKNEMVGSMASAQSAPDRILYDHRPLQLNKDDYERVCQIPQKKGANFRDLPGVLVNGNKVQWDPSVQRVMLDSGKPLVPDYAMTFVRGTSSKPFGRLWWDEIVSTVVTRAEPHNQAILHPTQNRVLTIRENARLQGFPDCYKLCGPVKERYIQVGNAVAVPVALALGYTFGLACQGLLSDDNPLTTLPFKYPSCLALSSLAETENDNESS

SEQ ID NO: 243 - protein, 833 aa, Glycine max
MAKKRSASDATDDAQNDTVSLLPSQRKKPKHSAPNPDACFVGKPIPSAEARAKWPHRYPSEVKKKAPARSSEEVTSENSEVMLARCHYRQAKVDGVVYNLYDDAYVKAEDGKPDYIARIVEMFETVDKEQCFMAQWFYRAEDTVIKNHGDLVDKKRVFISDVKDVNPLDCIVSKVKIFKKNPSVDLASKKAKLPFCDYYYDMKYTVPYLTFSNLVNETVKTESDASSTISSESGSIGCVNNANLAKRKTTQNNSSGSSQWTLLDLYSGCGAMSTGLCLGASLAGIKLVTMWAVDINAHACKSLKLNHPETHVRNEPAEDFLNLIKAWAKLCEEFALLGSERSDSDPDMDEDENEAVQKEESGNQSDLEEFEVEKLLAVCYGDPNGVKKPGLYFKVRWLGYDSSYDTWEPIDGLSDCKEVMKDFVTKGYKKRLLPLPGDANFICGGPPCQGVSGFNRFRNAEAPLEDTKNKQLLVYMDIIDFLKPKYVLMENVVDILKFSGGYLGRYAIGRLVAMNYQARMGMMAAGSYGLPQFRMRVFLWGARPTEQLPPYPLPTHEVVSRGFVPTEFEEITVAYDKKDTCQLAGALLLDDAISDLPPVTNDENQDERNYGAPARTEFQRYIRLKKNEMVGSMATAQSTPRRILYDHRPLQLNKDDYDRVCQIPQKKGANFRDLPGVLVNGNKVEWDPSVERVMLDSGKPLVPDYAMTFVRGTSTKPFGRLWWDEIVPTVVTRAEPHNQAILHPRQNRVLTIRENARLQGFPDCYKLCGPVKERYIQVGNAVAVPVALALGYTFGLACQGLSDDKPLTTLPFKYPSCLALSSLAGTENDNESS

SEQ ID NO: 244 - protein, 875 aa, Glycine max
MPSKRKTRSSASPAAAPPSKRASRSSASRVADSAPVKSEAEEVVAASSVVKEEAQASFTDVTDGNVSDGEGTNARFVGEPVPDEEARRRWPKRYQEKEKKQSAGPKSNRNDEDEEIQQARRHYTQAEVDGCMLYKLYDDAHVKAEEGEDNYICKIVEIFEAIDGALYFTAQWYYRAKDTVIKKLAYLIEPKRVFFSEVQDDNPLDCLVEKLNIARITLNVDLEAKKETIPPCDYYCDTQYLLPYSTFVNLPSENGESGSETSSTISSETNGIGKYEVNSQPKEAFLPEESKDPEMKLLDLYCGCGAMSTGLCLGGNLSGVNLVTRWAVDLNQHACECLKLNHPETEVRNESAENFLSLLKEWQELCSYFSLVEKKVSHEKYVNLFSEDDDDTSSNEEVNSEDDNELNEDDEIFEVSEILAVCYGDPNKKKEQGLYFKVHWKGYESALDSWEPIEGLSNCKEKIKEFVSRGFKSQILPLPGDVDVICGGPPCQGISGFNRFRNKESPLDDEKNKQLVVFMDIVQYLKPKFTLMENVVDLVKFAEGFLGRYALGRLLQMNYQARLGIMAAGAYGLPQFRLRVFLWGAAPSQKLPQFPLPTHDVIVRGVIPLEFEINTVAYNEGQKVQLQKKLLLEDAISDLPRVQNNERRDEIKYDKAAQTEFQRFIRLSKHEMLELQSRTKSSKSLLYDHRPLELNADDYQRVCRIPKKKGGCFRDLPGVRVGADNKVEWDPDVERVYLDSGKPLVPDYAMTFVNGTSSKPFARLWWDETVPTVVTRAEPHNQAILHPEQDRVLTIRENARLQGFPDFYKLCGPVKERYIQVGNAVAVPVARALGYTLGLAFEGSTSTSDDPLYKLPDKFPMIRDRVSSVSSEDDV

SEQ ID NO: 245 - protein, 503 aa, Glycine max
MKFLTDFQVEEYYGAKGVDTWSLKMWEKVISNNDTIADCVEALIGAYYVDGGLFASLNVMKWLGIGVELELSSLDEAITAASLSTCVPIESDIASLEKKIEYEFSVKGLLLEAITHLSEKELGIGCCYERLKFLGDSVLDLLITWHLYQSHTDIDPGVLADLRSASVNNDNFAQVAVRHNLHQHLLHSSGLLVSQILEYVKVISESDPRSLPSIRAPKALGDVVESIVGPILIGTKLSLDQVWNVFYPLLSPIVTPDKLELPPFRELNELCDSLGHFVKVKENCEKMGSAMHVEVSVQLPNALLVREGKGPNKKTAKGEAAFHLLKDLEKRGILHGSLMSKGKRDNPDHIYDSFHLKRDSSICSSLIEEHSSEPASHKRHTLDETNLTASIQFCETSELITPAVAFINQIIDNAMSVGGPRTTLYDVCKKLQWPVPAFDSREYKDSFYFVTDLYLNPVKGCKEARDKTVSLSKITLCIPNYGNIECKGEARSDKKSSFDSAAI

SEQ ID NO: 246 - protein, 1674 aa, Glycine max
MNSNIDSTDHSQDQSRKRNLPDADDSPAPNFHIDSSDHNQDQSKKRKQPNDEDSPSLESPCSNMNPRRYQIEVYEVARRRNTIAVLDTGSGKTLIAVMLMKEVGQAIKTSGVKKLIIFLAPTVHLVNQQFKNIKFLTDFQVEEYYGAKGVDTWTLKTWEKEISNNDVLVMTPQILLDALRKAFLRMEMICLIVIDECHRTIGNHPYTKIMKEFYHQANEKPKIFGMTASPVGKKGVSSTMDCEDQISELESILDSQRYTVEDRTEMDRCVPSAKESCRYYDQARFSALSLKPKIEALSFKFDALLSENQSNYKDVENKFKTLSQRMSNELAKILHCLEDLGILCAYEAVKICHENFSKSEGECEIYRKGYLQCITFLEEVIKLIEESLHLADKKILEVDFNYSQAEDLGYISPKLIELIKLFQSFGESSQVLCLIFVDRIITAKVIQRFAKTVPNISHFTVSYLTGNNTSVDALAPKRQKEILDSFRSGKVNLLFTTDVLEEGIHVPNCSCVIRFDLPKTVRSYVQSRGRSRQANSQFVVMLERGNLKQRDQLFDIIRSERSMTDASIYKEHESSLRACMVGKTNAYYVESTGASFTLDSSVSLIHRYCGTLPRDKYSCVKPNFEFLSVEGGYQCKLILPSNSAFQTIIGPSGKDMRLAKHLACFEACKKLHQMGALNEHLVPLIEDSSEDDHIVKNKESSSGAGTTKRKELHGKANIHALSGAWGDKLTRVKFNAYKFEFTCNIVSEIYSGFALLIESELDEDVGNVNLDLYLVSKIVKASVSSCGQVDLDAEQMMRAKCFHELFFNGLFGRLVLKSKSAGEREFLLQKDTNSLWSPKHLYLLLPLEKLNDICEGSLQINWCGINSCASAIKFLRRKFSLVTGDCDDNGTITSPHDTSSSEMECVGANKIHFANCVVDADNIKDRVVLAIHTGKIYCIIEIDSNLSAESPFYGNNEKSKESITFSDYFSKSYGISLRHPGQPMLRLKQSHNPHNLLFNFYEEDARDKSSKIGPAASKLPVHVHIPPELLYILDVKRDVLKSLYLLPSLMYRIESLMLSSQLREEIDGQTSKFNIRSSLILESLTTLRCSESFSMERLELLGDSVLKYVVSCHLFLKYPKKHEGQLSARRSSAVCNSTLHKLGTDRKLQGYIRDSAFEPRRWVAPGQRSIHLVCCDCGLETLEVPLDAKFHTEDPKVVVGKFCDRGHCWMCSKTIADCVEALIGAYYVDGGLFASLNVMKWLGIGAELELSLVDEAITAASLRTCLPKESEIASLEKKIGYEFSVKGLLLEAITHLSEKELGIGCCYERLEFLGDSVLDLLITWHLYQSHTDIDPGVLTDLRSASVNNDNFAQVAVRHNLHQHLLHSSGLLLSQISEYVKVISESDPRSLPSISAPKALGDVVESIVGAILIDTKLSLDQVWNVFYSLLSPIVTPDKLELPPFRELNELCDSLGYFVKVKENCEKVGSAMHVEVSVQLPNALLVREGKGANKKTAKGEAAFYLLKDLEKQGISHGSFMSKGKRDNPDHVYGSSHLKMDSSILIEEHSSEPASHKRHILDETNLTAINLSINMKKGGPRTTLYEVCKKLQWPVPTFDSTEYKDRSLFESCEGLQGSKGQNCFVSKITLCIPNYGNIESKGEARSDKKTSFDSAAVQMLLELQRLGKVEIDPLPSS

SEQ ID NO: 247 - protein, 537 aa, Glycine max
MQFHNYVGSEGDDSSPSDYDWNTDDELEVFGIPPSDPTISSQESCEDSVGESSASCSSAKHSKLIHLFVGMGFSRETVIKAIDENGRDNEEDIMEALLTLTAEKPLTVEKDEALSVLVNMGYPFEEALTAIDKCGPKAHISELADFISASQLEKGLHSPQESPNNKHDASDYTHEKPCQPSGEYYLHTSKKVKLGLGIFNEASQVISRKFPREVANKPYFYFENVALAPKGVWKTISRFLYEIEPEYVDSKYFCAATRKRGYIHNLPTHNRSPLLPIPPLTIQEAFPTTKKWWPSWDRRTKLNCLLTRVAPGPVTERIRKLLEKFGDEPPLHVQENVLVEIRKWNLVWVGKNKLAPLEPDEYEMLLGFPRDHTRGGGVTRTERYKSLGNAFQVNTVAYHLSVLKGRFPNGINVLSLFSGIGGAEVALHRLGMMLKNVVSVEIAEVNRNIIRSWWEQTNQRGNLIEVEDVQKVSSNELSQWITKFGGFDLIIGGSPCNNISGSNRVSRHGLEGEQSSLFYEYFRIVEAVMEIQRDELL

SEQ ID NO: 248 - protein, 531 aa, Glycine max
MGSEGDDSSPSDYDWNTDDELEVFGIPPSDPTISSQESCEDSVGESSASCSSAKHSKLIHLFVGMGFSRETVIKAIDENGRDNEEDIMEALLTLTAEKPLTVEKDEALSVLVNMGYPFEEALTAIDKCGPKAHISELADFISASQLEKGLHSPQESPNNKHDASDYTHEKPCQPSGEYYLHTSKKVKLGLGIFNEASQVISRKFPREVANKPYFYFENVALAPKGVWKTISRFLYEIEPEYVDSKYFCAATRKRGYIHNLPTHNRSPLLPIPPLTIQEAFPTTKKWWPSWDRRTKLNCLLTRVAPGPVTERIRKLLEKFGDEPPLHVQENVLVEIRKWNLVWVGKNKLAPLEPDEYEMLLGFPRDHTRGGGVTRTERYKSLGNAFQVNTVAYHLSVLKGRFPNGINVLSLFSGIGGAEVALHRLGMMLKNVVSVEIAEVNRNIIRSWWEQTNQRGNLIEVEDVQKVSSNELSQWITKFGGFDLIIGGSPCNNISGSNRVSRHGLEGEQSSLFYEYFRIVEAVMEIQRDELL

SEQ ID NO: 249 - protein, 590 aa, Glycine max
MGGDDSGLESDNFDWNTEDELEIQNYNSSSSCLTLPNGDAVTGSGEASSSAVLANSKVLDHFVSMGFSREMVSKVIQEYGEENEDKLLEELLTYKALESSSRPQQRIEPDPCSSENAGSSWDDFSDTDIFSDDEEIAKTMSENDDTLRSLVKMGYKQVEALIAIERLGPNASLEELVDFIGVAQMAKAEDALLPPQEKLQYNDYAKSNKRRLYDYEVLGRKKPRGCEKKILNEDDEDAEALHLPNPMIGFGVPTESSFITHRRLPEDAIGPPYFYYENVALAPKGVWQTISRFLYDVEPEFVDSKFFCAAARKRGYIHNLPIQNRFPLLPLPPRTIHEAFPLTKKWWPSWDIRTKLNCLQTCIGSAKLTERIRKAVEIYDEDPPESVQKYVLHQCRKWNLVWVGRNKVAPLEPDEVETLLGFPRNHTRGGGISRTDRYKSLGNSFQVDTVAYHLSVLKEMYPNGINLLSLFSGIGGAEVALHRLGIPLKNVVSVEKSEVNRNIVRSWWEQTNQKGNLYDMDDVRELDGDRLEQLMSTFGGFDLIVGGSPCNNLAGSNRVSRDGLEGKESSLFFDYFRILDLVKNMSAKYR

SEQ ID NO: 250 - protein, 590 aa, Glycine max; identical to SEQ ID NO: 249

SEQ ID NO: 251 - protein, 580 aa, Glycine max
MGGDDFDWNTDDELEIENYNSSSSCLTLPNGDAGEASSSAVLANSKVLDHFVNMGFSREMVSKVIQEYGEENEDKLLEELLSYKALESSPQPQQRIEPDPCSSENAGSSWDDFSDTDIFSDDEEIAKTMSENDDTLRSLVKMGYKQEEALVAIERLGPNASLEELVDFIGVAQMAKAEDALLPPEEKLQYNDYAKSNKRRFYDYEVLGRKKPRGCEKKILNEDDDEEDEALHLPNPMIGFGVPTESSFITHRRIPEDAIGPPYFYYENVALAPKGVWQTISRFLYDVQPEFVDSKFFCAAARKRGYIHNLPIQNRFPLLPLPPRTIHEAFPLTKKWWPSWDTRTKLNCLQTCIGSAKLTERIRKAVEIYDEDPPESVQKFVLHQCRKWNLVWVGRNKVAPLEPDEVETLLGFPRNHTRGGGISRTDRYKSLGNSFQVDTVAYHLSVLKEMYPNGINLLSLFSGIGGAEVALHRLGIPLKNVVSVEKSEVNRNIVRSWWEQTNQKGNLYDIDDVRELDGDRLEQLMSTFGGFDLIVGGSPCNNLAGSNRVSRDGLEGKESSLFFDYFRILDLVKNMSAKYR

SEQ ID NO: 252 - protein, 679 aa, Glycine max
MSGRRERVRESDFEYYERVYYEDLKSGYYKLKISKSSYKCPFCQDKREYSLNELSKHAVRFERDSRSMKIKDLAKHSALQLYIKKYLDVYDKVGSVVHDKVESVIHDKAGSVVHDRPGKVVLDRSGKVVNDGSGNVYSDRFGKVVNDRPRNVVIANDRSEKVGKDQLFVWPWVGIVANIATEFKNGMRIGDSGSKLRDEFTLKGFHPLKVQPLWNRYGHSGFAIVEFSKDWDGFTNAMNFERSFEAEHCAKRDYDNLRDRGGRLYGWVARDDDYHSKSIIGDHLRKTGDLQSVSGKQAEEKRKTTLLVSDLAKTLIVRNEKLEQVCSKYDDISVSLNRVMDEKEAMIESYNNEIKKMHQITRKYWEVFYRDREKAGLKLHAQRKKLESREKDLQRNQVQNENERKKLYLERKNNEMAIMEQNKADEKVMHLAEEHKKEKEKMHKKILELQNELDAKQKLELEIQQLKGNLQVRNQIGEDDEEEKNKLDAIKTELEDKEEELEDLEALQQALVVKERKTNDELQDARKELIRWLRKTNSSRAFIGVKRMGELDEKPFLSAAKRKYSGDEVNLKAVELCSQYEAYLRDPTWFPFKVLIDKEGKAKEVLDEEDEKLRTLKDEFGDDVFQAVVTALKELNEYNPSGRYPLPELWHSKEGRKALLKEGCSFIIRQWKALKQRKK

SEQ ID NO: 253 - protein, 670 aa, Glycine max
MSGGRERVRESDFEYYEREYYKDLKSDYYKLKISKSSYKCPFCQDKREYSLNELLKHAVRFERDSRSMKTKDLAKHSALQLYIKKYLDENDRPGSVVHDKAGSVVLDRPGKVVHDRSGKVVIDGSGNVYNDRFGKVVNDRPGNVVIVNDRSEKVGKDQLFVWPWMGIVANIATEFKDGRRTGDSGSKLRDEFTLKGFHPLKVQPLWNRYGHSGFAIVEFSKDWEGFTNAMNFGRSFEAEHCGKRDYNKLRDRGDRLYGWVARDDDYHSKSIIGDQLRKTGDLQSVSGKQAEEKRKTSLLVLDLAKTLKVRNETLEQVCSKYDDISVSLNRVMDEKEAMIESYNNEIKKMHQTTQKYWEVFYRGREKARLELHAQRKELEGREKDLQRSQVKNENERRKLYLERKNNEMAIMEQNKADERVMHLAEEHKEEKEKMHKKILELQNELDAKQKLELGIQQLKGNLQVRKQIGEDDEEEKNKLDAIKTELEDKEEELEGLEALQQALVVKERKTNDELQDARKELIRWLGKTNSSRAFIGVKRMGELDGKPFLSAAKRKYSGDEVNLKAVELCSQYEAYLRDPNWFPFKVLIDREGKAKEVLDEEDEKLRTLKDEFGDDVFQAVVTALKELNEFNPSGRYPLRELWHSKEGRKASLKEGCSYIIKQWKTLKRKK

SEQ ID NO: 254 - protein, 1555 aa, Glycine max
MGSASLLNPSQPGVKKNSKSKQKSVVSKTEEKVMVKDKQKKRSLLESSEQPAATRKMPKRAAACKNLKEKSFLISEKSCLIEMEKDQIVEEESLAVRMTAGQDDGRPNRRITEFILHDATGKAQPLEVLEVNELFITGLILPLEVSTGKKKEKGVKCEGFGRVESWDISGYEDGSPVIWLSTDIADYDCQKPAASYKKVYDLFLEKARACIEVYLKLAKSSGGDPDISLDELLAGMVRSMSGSKCFSGTASIKDFVISHGEFIYKQLIGLDMTSKANDRTFADIPALIALRDESKKQANYVHAQVMPSNGSLRIDSGVGDEENKNQMDSVASVNEEDEDAKLARLLQEEEYWQSMKQKKNSRPTSVSNKYYIKINEDEIANDYPLPAYYKTSLQETDEFIVFDNDYDIYDTQDLPRSMLHNWSLYNSDARLVSLELLPMKPCSDIDVAIFGSGIMTSDDGSGFHLDTEAGQSSSVGSGAQVADGMPIYLSAIKEWMIEFGSAMIFISIRTDLAWYRLGKPAKQYAPWYDTVLKTARLAISIITLLKEQSRVSRLSFGDVIRKVSEFNQKDGSYISSDPLTVERYVVVHGQIILQLFAEFPDDNIRKSSFVTGLTNKMEERHHTKWLVKKKKVVPRSEPNLNPRAAVGPVVSKRKAMQATTTRLINRIWGEYYSNHLPEDSKEGIASELKDEDEVEEQEENEDDDNEEETILLEGTPKAHSASKQTKKISADTEIRWEGEPEGKTSSGYPVYKQAIIRGEVISVGRSVLVEVDETDEFPDIYYVEYMFESKIGRKMFHGRMMQCGCQTVLGNAANEREVFLTNECRDLGLHDVKQTVVVNIQNRPWGHQHRKDNIIADRVDRTQAEERKKKGLPTDYYCKSLYWPERGAFFTLPHDTLGLGSGVCPSCKIQDAEKEKDVFKVNSSKSGFLFNGTEYSLDDYVYVSPFEFEEKIEQGTHKSGRNVGLKAYVVCQVLEIVVKKEIKQAEIKSTQVKIRRFFRPEDLSNEKAYCSDIREVYYSDETYIISVESIEGKCQVRKKNDIPECSALGGIFQNVFFCELLYDPATGSLKKLPAHIKVKYSSGQTSDAAARKRKGKCIEGDGVSESTKEGKTLNDKRLATLDIFAGCGGLSEGLQQSGVSSTKWAIEYEEPAGDAFKANHPEALVFINNCNVILRAVMEKCGDTDDCISTSEAAELAAKLDEKEISSLPMPGQVDFINGGPPCQGFSGMNRFNQSSWSKVQCEMILAFLSFADYFRPRYFLLENVRNFVSFNKGQTFRLTLASLLEMGYQVRFGILEAGAFGVSQSRKRAFIWAASPEDVLPEWPEPVHVFSAPELKITLSENVQYAAVRSTANGAPLRAITVRDTIGDLPAVGNGASKGNMEYQNDPVSWFQKKIRGDMVVLTDHISKEMNELNLIRCQKIPKRPGADWRDLPEEKIKLSSGQVVDLIPWCLPNTAKRHNQWKGLFGRLDWQGNFPTSVTDPQPMGKVGMCFHPDQDRILTVRECARSQGFPDSYEFAGNIIHKHRQIGNAVPPPLASALGRKLKEAVDSKSST

SEQ ID NO: 255 - protein, 1551 aa, Glycine max
MGSASLLNPSQPGVKKNDKSKQKSVVSKTEEEVMFKDKQKKRSLSESSEQTAAMRKMPKRAAACKNLKEKSFLIYEKSCLIETEKDHIVEEESLAVRMTAGQDNGCPNRRITEFILHDETGKSQPLEVLEVDDLFITGLVLPLEASSGKKKEKGVKCEGFGRIESWDISGYEDGSPVIWLSTEVADYDCQKPAASYKKVYDLFLEKARACVEVYKKLAKSSGGDPDISLDELLAGMVRSMSGSKCFSGAASIKDFVISQGEFIYKQLVGLDMTSKANDRMFADIPALIALRDESKKQVHAQVMPSNGSLRIDSGVGDEENKNQMDSVASVNEEDEDAKLARLLQEEEYWQSMNQKKNSRSASASNKYYIKINEDEIANDYPLPVYYKTSLQETDEFIVFDNDYDIYDTQDLPRSMLHNWSLYNSDARLVSLELLPMKPCSDIDVAIFGSGIMTSDDGSGFHLDTEAGKSSSVGSGAQVADGMPIYLSAIKEWMIEFGSSMIFISIRTDLAWYRLGKPAKQYAPWYDTVLKTARLAISIITLLKEQSRVSRLSFGDVIRKVSEFDKKDGSYISSDPLTVERYVVVHGQIILQLFAEFPDDKIRKSAFVTGLTNKMEERHHTKWLVKKKKVVPRSEPNLNPRAAVGPVVSKRKAMQATTTRLINRIWGEYYSNHLPEDAKEGIASELKDEDEVEEQEENEDDDNEETILLEGTPKAHSASKQTKKFSAETEIRWEGEPEGKTSSGYPVYKQAIIRGEVISVGRSVLVEVDETDEFPDIYYVEYMFESKIGRKMFHGRMMQRGCQTVLGNAANEREVFLTNECRDLGLHDVNQTVVVNIQNRPWGHQHRKDNIIADRVDRAQAEERKKKGLPTEYYCKSLYWPERGAFFSLPLDTLGLGSGVCPSCKIQDAEKEKDVFKVNSSKSGFLLKGTEYSLNDYIYVSPFEFEEMIEQGTHKSGRNVGLKAYVVCQVLEIVVKKEIKEAEIKSTQVKIRRFFRPEDVSNEKAYCSDIQEVYYSDETHIISVESIEGKCQVRKKNDIPECSALGRMFQNVFFCELLYDPATGSLKKLPAHVKVKYSSGQTSDAAARKRKGKCIEGDDVLESPNEGKTLNEKRLATLDIFAGCGGLSEGLQQSGVSSTKWAIEYEEPAGDAFKANHPEALVFINNCNVILRAVMEKCGDTDDCISTSEAAELAAKLDEKEISSLPMPGQVDFINGGPPCQGFSGMNRFNQSSWSKVQCEMILAFLSFADYFRPRYFLLENVRNFVSFNKGQTFRLTLASLLEMGYQVRFGILEAGAYGVSQSRKRAFIWAASPEDVLPEWPEPMHVFSAPELKITLSENVQYAAVRSTANGAPLRSITVQDTIGDLPAVGNGASKGNMEYQNDPVSWFQKKIRGDMVVLTDHISKEMNELNLIRCQKIPKRPGADWRDLPEEKIKLSTGQVVDLIPWCLPNTAKRHNQWKGLFGRLDWQGNFPTSITDPQPMGKVGMCFHPDQDRILTVRECARSQGFPDSYQFAGNIIHKHRQIGNAVPPPLASALGRKLKEAVDSKSST

SEQ ID NO: 256 - protein, 1454 aa, Glycine max
MDDDLFQRNKTPSGVIKAIKFDVLTEEDIENIAVLEINAAGQVTGSSLGFPNASDECATCGSKDKRFCEGHFGVIKFPTPILHPYFMSEIAHILNKICPVCKSIRHKSKGVRLIYGTKRSNDCNYCSAYPSMKFRVSSNDLFRRTAIIVEVKASKKTLGTEIPADYWNFIPCDAQQEENYVNRRVLSPAQVLNLLNGVDPDFIEKYIPRKNLLYLNCFPVTPNCHRVTEVPYAISSGSRLSFDDRTRSCKKLVDFRGTPNELSSRVLDCLRISKLNPDKTPNSIFADIQQRKIGENACNSSGLRWIKDVVLGKRNDSSLRTVVVGDPDLELSEVGIPCHIAESLQVSEYVNRQNREKLLYCCELRLLEKGKIDVCRNGSKVHLYKKEDLQIGDKIYRPLADGDKVLINRPPSIHQHSMIALTVRVLPISSVVCINPLCCSPLRGDFDGDCLHGYIPQSVTARIELNELVALDRQLINGQSGRNLLSLSQDSLTAAYLLMEDGVLLNVYQMQQLQMLSISDKRLIPPAVVKAPSSNSSLWSGKQIFSMLLPYDFDYSFPSDGVVVSDGELVSSSEASGWLRDSDYNVFQSLVEHYQGKTLNFLYTAQKVLCEWLSMTGFSVSLSDLYLSSDSYARKNMIEEIFYGLQDAEQACNFKQLLLDCYCDFLSGSIQESENAITVDADRLNYERQISAALSQASVDAFRQVFRNIQSLADKYACKDNAFLAMFKAGSKGNLLKLVQHSMCLGMQNSLVRLSYRLPRHLSCAAWNSQKWLDSIQMSSGTLESVQSYIPYAVVESSFLTGLNPLECFVHSVTNRDSSFSDHADLPGTLTRRLMFFMRDLHDAYDGTVRNLYGNQLIQFSYDIEEDSSCDKGFQEYAIGGEPVGAISACAISEAAYSALGQPVSLLETSPLLNLKNVLECGSRKRNGDQTVSLFLSEKLGKQRHGFEYAALEVKNYLERLLFSNIVSTVMIIFTPHDGSSQEKYSPWVCHFHLDKEIVTRRKLKVHSIIDSLYQRYYSQRKDSKVCFTNLKISSKKCSADSMAKEGEDTSIDKKEGDDCITVTIVENSKNPIQLDSVRDLVIPFLLGTAIKGFLDVKKVDVLWNNQSKVKNSCNGFSGELYLRVTLSSEGSRGRFWGVLLNLCHKIMHIIDWTRSHPDNINHFSSAYGIDAGWQYFFNSLASATSDTGKSILPKHLCLVANSLSCSGEFVGLNAKGMALQRKHASVSSPFVQACFANPGSCFIKAAKSGVTDNLQGSLDALAWGNCLSMGTSGMFDIIYSEKVAKSGNVYELLEASFDKPNNKAGTHLHKYSSDKCGSEFRHKNGYALKEGKQWKTILRNFVTVNDIQKLTFASRCILNKYSIDELLSESDRSTMLRVLNFHPRKSEKFGIGPQDIKVGWHPKYKDSRCFHIVRIDGTVEDFSYRKCILGALDIVDPKKSKIQEKKWSGHGNT

SEQ ID NO: 257 - protein, 1454 aa, Glycine max; identical to SEQ ID NO: 256

SEQ ID NO: 258 - protein, 1457 aa, Glycine max
MDDDLLQRNKTPSVVIKAIKFDVLTEEDIENISVLEINAAGQVTGSNLGLPNASDECATCGTKDKKFCEGHFGVIKFPTPILHPYFMLEIAHILNKICPVCKSIRHKSKGARLIYGTKRSNDCNYCSVYPSMQFRVSSNDLFRRTAIIVEVKASKKTLGTEIPADFWNFIPCDAQQEENYVNRRVLSPVQVNYLLNDVDPDFIEKYIPRKNLLCLNCFPVTPNCHRVTEVPYAISSGSRLSFDDRTRSCKKLVDFRGTANELSSRVLDCLRISKLNPDKTPNSIFADIQQRKIGENAFNSSGLRWIKDVVLGKRNDSSFRTVVVGDPDLELSEIGIPCHIAESLQVSEYVNRQNREKLLYCCELHLLEKGKINVCRKGSIVHLYKKEDLQIGDKFYRPLADGDKVLINRPPSIHQHSMISLTVRVLPISSVVCINPLCCSPLRGDFDGDCLHGYIPQSVTARIELNELVALDRQLINGQSGRNLLSLSQDSLTAAYLLMEDGVLLNVYQMQQLQMLSISNKRLIPPAVVKAPSSNSSLWNGKQLFSMLLPYDFDYSFPSDGVVVSDGELVSSSEASGWLRDSDYNVFQSLVEHYQGKTLNFLYAAQKVLCEWLSMTGFSVSLSDLYLSSDSYARENMIEEIFYGLQDAERACNFKQLLLDYYCDFLSGSLQESENAITVNADRLNYERQISASLSQASVDAFRQVFRNIQSLADKYACKGNSFLAMFKAGSKGNLLKLVQHSMCLGMQNSLVRLSYRLPRHLSCADWNSQKWVDSIQMSSGTLESVQSYIPYAVVESSFLTGLNPLECFVHSVTNRDSSFSDHADLPGTLTRRLMFFMRDLYDAYDGTVRNLYGNQLIQFSYDIEEDSSCNKGFQQYALGGESVGAISACAISEAAYSALGQPVSLLETSPLLNLKNVLECGSRKRNGDQTVSLFLSEKLGKQRHGFEYAALEVKNYLERLLFSNIVSKVMIIFTPHDSRSQEKYSPWVCHFHLDKEIVTRRKLKVHSIIDSLYQRYYSQRKDSKVCFTNLKISSRKCSADSMVKEGEDTSIDKEEGDDCIMVTIVENSKNPIQLDSVRDLVIPFLLGTAIQGFLDVKKVDILWNNQSKVTNSRNGFSGELYLRVTLSSEGSRGRFWGVLLKLCHKIMHIIDWTRSHTDNINHFSSAYGIDAGWQYFFNSLACATSDTGKSILPKHLCLVANSLSCSGEFVGLNAKGMALQRKHASVSSPFVQACFANPGSCFIKAAKSGATDNLQGSLDGLAWGNCLSMGTSGMFDVIYSEKGHQVAKSVDVYELLEASFDKPNNKIGTHLHKYSSDKCGSEFRHKNGYALKEGKQWKTILRNFVTVNDIQKLTFASRCILNKYSIDELLSESDRSTMLRVLNFHPHKSEKFGIGPQDIKVGWHPKYKDSRCFHIIRTDGTVEDFSYRKCILGALDIVDPKKSKIQEKKWSGHGDT

SEQ ID NO: 259 - protein, 1454 aa, Glycine max
MDDDLLQRNKTPSVVIKAIKFDVLTEEDIENISVLEINAAGQVTGSNLGLPNASDECATCGTKDKKFCEGHFGVIKFPTPILHPYFMLEIAHILNKICPVCKSIRHKSKGARLIYGTKRSNDCNYCSVYPSMQFRVSSNDLFRRTAIIVEVKASKKTLGTEIPADFWNFIPCDAQQEENYVNRRVLSPVQVNYLLNDVDPDFIEKYIPRKNLLCLNCFPVTPNCHRVTEVPYAISSGSRLSFDDRTRSCKKLVDFRGTANELSSRVLDCLRISKLNPDKTPNSIFADIQQRKIGENAFNSSGLRWIKDVVLGKRNDSSFRTVVVGDPDLELSEIGIPCHIAESLQVSEYVNRQNREKLLYCCELHLLEKGKINVCRKGSIVHLYKKEDLQIGDKFYRPLADGDKVLINRPPSIHQHSMISLTVRVLPISSVVCINPLCCSPLRGDFDGDCLHGYIPQSVTARIELNELVALDRQLINGQSGRNLLSLSQDSLTAAYLLMEDGVLLNVYQMQQLQMLSISNKRLIPPAVVKAPSSNSSLWNGKQLFSMLLPYDFDYSFPSDGVVVSDGELVSSSEASGWLRDSDYNVFQSLVEHYQGKTLNFLYAAQKVLCEWLSMTGFSVSLSDLYLSSDSYARENMIEEIFYGLQDAERACNFKQLLLDYYCDFLSGSLQESENAITVNADRLNYERQISASLSQASVDAFRQVFRNIQSLADKYACKGNSFLAMFKAGSKGNLLKLVQHSMCLGMQNSLVRLSYRLPRHLSCADWNSQKWVDSIQMSSGTLESVQSYIPYAVVESSFLTGLNPLECFVHSVTNRDSSFSDHADLPGTLTRRLMFFMRDLYDAYDGTVRNLYGNQLIQFSYDIEEDSSCNKGFQQYALGGESVGAISACAISEAAYSALGQPVSLLETSPLLNLKNVLECGSRKRNGDQTVSLFLSEKLGKQRHGFEYAALEVKNYLERLLFSNIVSKVMIIFTPHDSRSQEKYSPWVCHFHLDKEIVTRRKLKVHSIIDSLYQRYYSQRKDSKVCFTNLKISSRKCSADSMVKEGEDTSIDKEEGDDCIMVTIVENSKNPIQLDSVRDLVIPFLLGTAIQGFLDVKKVDILWNNQSKVTNSRNGFSGELYLRVTLSSEGSRGRFWGVLLKLCHKIMHIIDWTRSHTDNINHFSSAYGIDAGWQYFFNSLACATSDTGKSILPKHLCLVANSLSCSGEFVGLNAKGMALQRKHASVSSPFVQACFANPGSCFIKAAKSGATDNLQGSLDGLAWGNCLSMGTSGMFDVIYSEKVAKSVDVYELLEASFDKPNNKIGTHLHKYSSDKCGSEFRHKNGYALKEGKQWKTILRNFVTVNDIQKLTFASRCILNKYSIDELLSESDRSTMLRVLNFHPHKSEKFGIGPQDIKVGWHPKYKDSRCFHIIRTDGTVEDFSYRKCILGALDIVDPKKSKIQEKKWSGHGDT

SEQ ID NO: 260 - protein, 2020 aa, Glycine max
MEDNPPSSVLDGTVVGIKFGMATRQEICTASISESSISHASQLSNPFLGLPLEFGRCESCGTSEVGKCEGHFGYVELPVPIYHPSHISELKRMLSVVCLNCLKMRKTKFPASSSGLAQRLISPCCQDVNAALVSIREVKTSDGACYLALKVSKSKIHDGFWSFLEKYGYRYEGDETRALLPCEAMEIIKRIPIETKKKLAGKGFFPQDGYVLKYLPVPPNCLSVPEVSDGASVMSSDPSMTILRKLLRKVEIIKSSRSGEPNFESHHVEANDLQSVVDQYFQIRGTSKPARDIETHFGVNKELTASSTKAWLEKMRTLFIRKGSGFSSRNVITGDCYKRINEVGIPVEVAQRITFEERVNIHNIRYLQKLVDEHLCLTYKEGVSTYSLREGSKGHIYLKPGQIVHRRIMDGDIVFINRPPTTHKHSLQALYVYIHEDHTVKINPLICGPLGADFDGDCVHLFYPQSLAAKAEVVELFAVENQLLSSHSGNLNLQLSTDSLLALKMLVKRCFLGRAAANQLAMFLLLPLPRPALLKASSDDACWTSIQILQGALPMGFDCTGGRYLIRQSEILEFDFSRDALPATINEIAASIFFGKGPMEALKFFDVLQPFLMESLFAEGFSVSLEEFSISRAIKRIIRRSIGKASSLLYQLRSLYNELVAQQLEKHIQDVELPIINFALKSTKLGDLIDSKSKSTIDKVVQQVGFLGQQLFDRGRFYSKGLVDDVASHFHAKCCYDGDGYPSAEYGLLKGCFFNGLDPYEEMVHSISTREIMVRSSRGLSEPGTLFKNLMAILRDVVICYDGTVRNICSNSIIQFEYGIQAGDKTEHLFPAGEPVGVLAATAMSNPAYKAVLDASPNSNSSWELMKEILLCKVNFRNEPVDRRVILYLNDCDCGGSCCRENAAYSVKNQLRKVSLKNAAVEFIIEYQQQRTQKENSETDAGLVGHIYLDEMMLEELKISMANVFEKCLERLKSFSRKKKVNQYLKNIELSFSESCSSSHPAAPCLTFWLKNHDSDLDNAVKVLSENICPVLFETIIKGDPRISSASIIWVSPDTNTWVRNPYKSSNGELALDIVLEEEAVKQSGDAWRIVLDSCLPVLHLIDTRRSIPYAIKQIQELLGISCTFDQAIQRVAASVKMVAKGVLREHLILLASSMTCGGNLVGFNTGGYKALSRQLNIQVPFTDATLFTPKKCFERAAEKCHTDSLSSIVASCSWGKHVAVGTGSKFDIVWDSSEIKSNEIEGMDVYSFLHMVKSVTNGEEETDACLGEDIDDLLEEEYMDLGMSPQHNSGFEAVFEENPEVLNGSTSNGWDVSSNQTQSKTNEWSGWASSNKDGRSETAQENSWGKTVNQEDSSKSNAWNTSTTADQTKTKSNEWSDWGSNKSEIPAGGSKAVQEDSSKSNAWNTSTTSNQTKTKSKEWSAWGSNKSEIPACGSKAVQEDSSKSNTWNTSTTADQTKTKSNEWSAWGSNKSEIPAGGSKAVQEDSSKSNAWNRSTTADQTKTKSNEWSAWGSNKSEIPAGGSKAVQEDSSKSNAWNTSTTADQTKTKSNEWSAWGSNKSEIPAGGSKAVQEDSSKAWNTSTTADQTKTKSNEWSARVSNKSEIPAGGSKAVQEDSWGSSKWKADVAQEDNSRLGAWDANAADQTKSNEWSGWGKKKDVTQEDNVQHSWGSGKRKDKVTQEDNSGSGDWGANRTDLAITKSSEWSSWGKNKTEIPAGGSANVQNDSWGLGKLNDTQKDNSGCGAWGENSGSAWVRNKAETIDGGSEKPQEDAWNSGNWKAESKVGNTTWGKPKSSESHAWDSHNQSNQNSSSQGWESHIASANSENEKGFQWGKGRDSFKKNRFEGSQGRGSNAGDWKNRNRPPRAPGQRLDIYSSEEQDVLKDIEPIMQSIRRIMQQQGYSDGDPLAAEDQLFVLENVFEHHPDKETKMGAGIDYVMVNKHSSFQESRCFYVVCKDGQSKDFSYRKCLANYISKKYPDLAESFLGKYFRKPRARGDQTATLGGDQTATPAQDEAATSGE

SEQ ID NO: 261 - protein, 2020 aa, Glycine max; identical to SEQ ID NO: 260

SEQ ID NO: 262 - protein, 2098 aa, Glycine max
MEDNPPSSVLDGTVVGIKFGMATRQEICTASISDSSISHASQLSNPFLGLPLEFGRCESCGTSEVGKCEGHFGYIELPIPIYHPSHISDLKRMLSMVCLNCLKLRKTKLPASSSGLAQRLISPCCQEDKAALVSIREVKTSDGACYLALKVSKSKMQNGFWSFLEKYGYRYGGDHTRALLPCEAMEIIKRIPIETKKKLAGKGYFPQDGYVLKYLPVPPNCLSVPEVSDGVSVMSSDPSITILRKLLRKVEIIKSSRSGEPNFESHHVEANDLQSVVDQYFQIRGTSKPARDIETHFGVNKELTASSTKAWLEKMRTLFIRKGSGFSSRNVITGDCYKRINEVGIPVEVAQRITFEERVNIHNIRYLQKLVDEHLCLTYKEGGSTYSLREGSKGHIYLKPGQIVHRRIMDGDIVFINRPPTTHKHSLQALYVYIHEDHTVKINPLICGPLGADFDGDCVHLFYPQSLAAKAEVVELFSVENQLLSSHSGNLNLQLSTDSLLSLKMLVKRCFFDRAAANQLAMFILLPLPRPALLKASSGDACWTSIQILQCALPLGFDCTGGRYLIRQSEILEFEFSRDVLPATVNEIAASVFFGKGPKEALNFFDVLQPFLMESLFAEGFSVSLEEFSISRAIKRIIRKSIGKVSSLLYQLRSLYNELVAQQLEKHIRDVELPIINFALKSTKLGDLIDSKSKSAIDKVVQQIGFLGQQLFDRGRFYSKGLVDDVASHFHAKCCYDGDGYPSAEYGLLKGCFFNGLDPYEEMVHSISTREIMVRSSRGLSEPGTLFKNLMAILRDVVICYDGTVRNICSNSIIQFEYGIQAGDKSEHLFPAGEPVGVLAATAMSNPAYKAVLDASPSSNSSWELMKEILLCKVNFRNELVDRRVILYLNDCDCGGSYCRENAAYSVKDQLRKVSLKDAAVEFIIEYQQQRTQKENSETDVGLVGHIYLDEMMLEELKISMAYVFDKCHERLKSFSQKKKVNQSLKNIELSFSLFVGLYHFLIMFHLSSESCSSSHPAAPCLTFWLKNYDSDLDNAVKVLAEKICPVLFKTIIQGDPRISSASIIWVSPDTNTWVRNPYKSSNGELALDIILEKEAVKQSGDAWRVVLDACLPVLHLIDTRRSIPYAIKQIQELLGISCTFDQAIQRVAASVKMVAKGVLREHLILLASSMTCGGNLVGFNIGGYKALSRQLNIQVPFTDATLFTPKKCFERAAEKCHTDSLSSIVASCSWGKHVAVGTGSKFDVVWDANEIKSNEIEGMDVYSFLHMVKSFTNGEEETDACLGEDIDDLLEEEYMDLGMSPQHNSGFEAVFEENPEVLNGSTSNGWDVSSNQGESKTNEWSGWASSNKAEIKDGRSEIAPKNSWGKTVNQEDSSKSNPWSTSTIADQTKTKSNEWSAWGSNKSEIPVGWASSNKTEIKDGRSETAQENSWGKTVNQEDSSKSNAWNTSTTVDHANTKSNEWSAWGSNQSEIPAGGSKAVQEDSWGSSKWKADVAQEDNSRLGAWDANAADQTKSSEWSGWGKKKDVTQEDNSRLGAWDANAADQTKSRDWSGWGKKKDITQEDNSRLGAWDANAADQTKSSEWSGWGKKKDVTQEDNSRLGAWDANTADQTKSNEWSGWGKKKEVTQEDNSRLGAWDANTADQTKSNEWSGWGKKKEVTQEDNSRFGAWDANAEDQTKSNEWSGWGKKKDVTQEDNSRLGAWDANAADQTKSNEWSDWGKKKEVTQEDNVQDSWGSGKRKDKVTQEDNSGSGGWGANRTDLAKSKSSEWSSWGKNKSEIPAGGSENVQNDSWGSGKLEDDTQKENSGSAWVRNKAETIDGGSEKPQEDAWNSGNWKAESKVGNASWGKPKSSESQAWDSHNQSNQNSSSQGWESHIASANSESEKGFQWGKQGRDSFKKNRFEGSQGRGSNAGDWKNRNRPPRAPGQRLDIYSSGEQDVLKDIEPIMQSIRRIMQQQGYNDGDPLAAEDQLFVLENVFEHHPDKETKMGTGIDYVMVNKHSSFQESRCFYVVCKDGESKDFSYRKCLANYISKKYPDLAESFLGKYFRKPRARGDQTATPGRDEAATPGEQTATPGRDEAATPAEQISTPTPMETNE

SEQ ID NO: 263 - protein, 2082 aa, Glycine max
MEDNPPSSVLDGTVVGIKFGMATRQEICTASISDSSISHASQLSNPFLGLPLEFGRCESCGTSEVGKCEGHFGYIELPIPIYHPSHISDLKRMLSMVCLNCLKLRKTKLPASSSGLAQRLISPCCQEDKAALVSIREVKTSDGACYLALKVSKSKMQNGFWSFLEKYGYRYGGDHTRALLPCEAMEIIKRIPIETKKKLAGKGYFPQDGYVLKYLPVPPNCLSVPEVSDGVSVMSSDPSITILRKLLRKVEIIKSSRSGEPNFESHHVEANDLQSVVDQYFQIRGTSKPARDIETHFGVNKELTASSTKAWLEKMRTLFIRKGSGFSSRNVITGDCYKRINEVGIPVEVAQRITFEERVNIHNIRYLQKLVDEHLCLTYKEGGSTYSLREGSKGHIYLKPGQIVHRRIMDGDIVFINRPPTTHKHSLQALYVYIHEDHTVKINPLICGPLGADFDGDCVHLFYPQSLAAKAEVVELFSVENQLLSSHSGNLNLQLSTDSLLSLKMLVKRCFFDRAAANQLAMFILLPLPRPALLKASSGDACWTSIQILQCALPLGFDCTGGRYLIRQSEILEFEFSRDVLPATVNEIAASVFFGKGPKEALNFFDVLQPFLMESLFAEGFSVSLEEFSISRAIKRIIRKSIGKVSSLLYQLRSLYNELVAQQLEKHIRDVELPIINFALKSTKLGDLIDSKSKSAIDKVVQQIGFLGQQLFDRGRFYSKGLVDDVASHFHAKCCYDGDGYPSAEYGLLKGCFFNGLDPYEEMVHSISTREIMVRSSRGLSEPGTLFKNLMAILRDVVICYDGTVRNICSNSIIQFEYGIQAGDKSEHLFPAGEPVGVLAATAMSNPAYKAVLDASPSSNSSWELMKEILLCKVNFRNELVDRRVILYLNDCDCGGSYCRENAAYSVKDQLRKVSLKDAAVEFIIEYQQQRTQKENSETDVGLVGHIYLDEMMLEELKISMAYVFDKCHERLKSFSQKKKVNQSLKNIELSFSESCSSSHPAAPCLTFWLKNYDSDLDNAVKVLAEKICPVLFKTIIQGDPRISSASIIWVSPDTNTWVRNPYKSSNGELALDIILEKEAVKQSGDAWRVVLDACLPVLHLIDTRRSIPYAIKQIQELLGISCTFDQAIQRVAASVKMVAKGVLREHLILLASSMTCGGNLVGFNIGGYKALSRQLNIQVPFTDATLFTPKKCFERAAEKCHTDSLSSIVASCSWGKHVAVGTGSKFDVVWDANEIKSNEIEGMDVYSFLHMVKSFTNGEEETDACLGEDIDDLLEEEYMDLGMSPQHNSGFEAVFEENPEVLNGSTSNGWDVSSNQGESKTNEWSGWASSNKAEIKDGRSEIAPKNSWGKTVNQEDSSKSNPWSTSTIADQTKTKSNEWSAWGSNKSEIPVGWASSNKTEIKDGRSETAQENSWGKTVNQEDSSKSNAWNTSTTVDHANTKSNEWSAWGSNQSEIPAGGSKAVQEDSWGSSKWKADVAQEDNSRLGAWDANAADQTKSSEWSGWGKKKDVTQEDNSRLGAWDANAADQTKSRDWSGWGKKKDITQEDNSRLGAWDANAADQTKSSEWSGWGKKKDVTQEDNSRLGAWDANTADQTKSNEWSGWGKKKEVTQEDNSRLGAWDANTADQTKSNEWSGWGKKKEVTQEDNSRFGAWDANAEDQTKSNEWSGWGKKKDVTQEDNSRLGAWDANAADQTKSNEWSDWGKKKEVTQEDNVQDSWGSGKRKDKVTQEDNSGSGGWGANRTDLAKSKSSEWSSWGKNKSEIPAGGSENVQNDSWGSGKLEDDTQKENSGSAWVRNKAETIDGGSEKPQEDAWNSGNWKAESKVGNASWGKPKSSESQAWDSHNQSNQNSSSQGWESHIASANSESEKGFQWGKQGRDSFKKNRFEGSQGRGSNAGDWKNRNRPPRAPGQRLDIYSSGEQDVLKDIEPIMQSIRRIMQQQGYNDGDPLAAEDQLFVLENVFEHHPDKETKMGTGIDYVMVNKHSSFQESRCFYVVCKDGESKDFSYRKCLANYISKKYPDLAESFLGKYFRKPRARGDQTATPGRDEAATPGEQTATPGRDEAATPAEQISTPTPMETNE

SEQ ID NO: 264 - protein, 2082 aa, Glycine max; identical to SEQ ID NO: 263

SEQ ID NO: 265 - protein, 2065 aa, Glycine max
MEDNPPSSVLDGTVVGIKFGMATRQEICTASISDSSISHASQLSNPFLGLPLEFGRCESCGTSEVGKCEGHFGYIELPIPIYHPSHISDLKRMLSMVCLNCLKLRKTKLPASSSGLAQRLISPCCQEDKAALVSIREVKTSDGACYLALKVSKSKMQNGFWSFLEKYGYRYGGDHTRALLPCEAMEIIKRIPIETKKKLAGKGYFPQDGYVLKYLPVPPNCLSVPEVSDGVSVMSSDPSITILRKLLRKVEIIKSSRSGEPNFESHHVEANDLQSVVDQYFQIRGTSKPARDIETHFGVNKELTASSTKAWLEKMRTLFIRKGSGFSSRNVITGDCYKRINEVGIPVEVAQRITFEERVNIHNIRYLQKLVDEHLCLTYKEGGSTYSLREGSKGHIYLKPGQIVHRRIMDGDIVFINRPPTTHKHSLQALYVYIHEDHTVKINPLICGPLGADFDGDCVHLFYPQSLAAKAEVVELFSVENQLLSSHSGNLNLQLSTDSLLSLKMLVKRCFFDRAAANQLAMFILLPLPRPALLKASSGDACWTSIQILQCALPLGFDCTGGRYLIRQSEILEFEFSRDVLPATVNEIAASVFFGKGPKEALNFFDVLQPFLMESLFAEGFSVSLEEFSISRAIKRIIRKSIGKVSSLLYQLRSLYNELVAQQLEKHIRDVELPIINFALKSTKLGDLIDSKSKSAIDKVVQQIGFLGQQLFDRGRFYSKGLVDDVASHFHAKCCYDGDGYPSAEYGLLKGCFFNGLDPYEEMVHSISTREIMVRSSRGLSEPGTLFKNLMAILRDVVICYDGTVRNICSNSIIQFEYGIQAGDKSEHLFPAGEPVGVLAATAMSNPAYKAVLDASPSSNSSWELMKEILLCKVNFRNELVDRRVILYLNDCDCGGSYCRENAAYSVKDQLRKVSLKDAAVEFIIEYQQQRTQKENSETDVGLVGHIYLDEMMLEELKISMAYVFDKCHERLKSFSQKKKVNQSLKNIELSFSLFVGLYHFLIMFHLSSESCSSSHPAAPCLTFWLKNYDSDLDNAVKVLAEKICPVLFKTIIQGDPRISSASIIWVSPDTNTWVRNPYKSSNGELALDIILEKEAVKQSGDAWRVVLDACLPVLHLIDTRRSIPYAIKQIQELLGISCTFDQAIQRVAASVKMVAKGVLREHLILLASSMTCGGNLVGFNIGGYKALSRQLNIQVPFTDATLFTPKKCFERAAEKCHTDSLSSIVASCSWGKHVAVGTGSKFDVVWDANEIKSNEIEGMDVYSFLHMVKSFTNGEEETDACLGEDIDDLLEEEYMDLGMSPQHNSGFEAVFEENPEVLNGSTSNGWDVSSNQGESKTNEWSGWASSNKAEIKDGRSEIAPKNSWGKTVNQEDSSKSNPWSTSTIADQTKTKSNEWSAWGSNKSEIPVGWASSNKTEIKDGRSETAQENSWGKTVNQEDSSKSNAWNTSTTVDHANTKSNEWSAWGSNQSEIPAGGSKAVQEDSWGSSKWKADVAQEDNSRLGAWDANAADQTKSSEWSGWGKKKDVTQEDNSRLGAWDANAADQTKSRDWSGWGKKKDITQEDNSRLGAWDANAADQTKSSEWSGWGKKKDVTQEDNSRLGAWDANTADQTKSNEWSGWGKKKEVTQEDNSRLGAWDANTADQTKSNEWSGWGKKKEVTQEDNSRLGAWDANAADQTKSNEWSDWGKKKEVTQEDNVQDSWGSGKRKDKVTQEDNSGSGGWGANRTDLAKSKSSEWSSWGKNKSEIPAGGSENVQNDSWGSGKLEDDTQKENSGSAWVRNKAETIDGGSEKPQEDAWNSGNWKAESKVGNASWGKPKSSESQAWDSHNQSNQNSSSQGWESHIASANSESEKGFQWGKQGRDSFKKNRFEGSQGRGSNAGDWKNRNRPPRAPGQRLDIYSSGEQDVLKDIEPIMQSIRRIMQQQGYNDGDPLAAEDQLFVLENVFEHHPDKETKMGTGIDYVMVNKHSSFQESRCFYVVCKDGESKDFSYRKCLANYISKKYPDLAESFLGKYFRKPRARGDQTATPGRDEAATPGEQTATPGRDEAATPAEQISTPTPMETNE

SEQ ID NO: 266 - protein, 2049 aa, Glycine max
MEDNPPSSVLDGTVVGIKFGMATRQEICTASISDSSISHASQLSNPFLGLPLEFGRCESCGTSEVGKCEGHFGYIELPIPIYHPSHISDLKRMLSMVCLNCLKLRKTKLPASSSGLAQRLISPCCQEDKAALVSIREVKTSDGACYLALKVSKSKMQNGFWSFLEKYGYRYGGDHTRALLPCEAMEIIKRIPIETKKKLAGKGYFPQDGYVLKYLPVPPNCLSVPEVSDGVSVMSSDPSITILRKLLRKVEIIKSSRSGEPNFESHHVEANDLQSVVDQYFQIRGTSKPARDIETHFGVNKELTASSTKAWLEKMRTLFIRKGSGFSSRNVITGDCYKRINEVGIPVEVAQRITFEERVNIHNIRYLQKLVDEHLCLTYKEGGSTYSLREGSKGHIYLKPGQIVHRRIMDGDIVFINRPPTTHKHSLQALYVYIHEDHTVKINPLICGPLGADFDGDCVHLFYPQSLAAKAEVVELFSVENQLLSSHSGNLNLQLSTDSLLSLKMLVKRCFFDRAAANQLAMFILLPLPRPALLKASSGDACWTSIQILQCALPLGFDCTGGRYLIRQSEILEFEFSRDVLPATVNEIAASVFFGKGPKEALNFFDVLQPFLMESLFAEGFSVSLEEFSISRAIKRIIRKSIGKVSSLLYQLRSLYNELVAQQLEKHIRDVELPIINFALKSTKLGDLIDSKSKSAIDKVVQQIGFLGQQLFDRGRFYSKGLVDDVASHFHAKCCYDGDGYPSAEYGLLKGCFFNGLDPYEEMVHSISTREIMVRSSRGLSEPGTLFKNLMAILRDVVICYDGTVRNICSNSIIQFEYGIQAGDKSEHLFPAGEPVGVLAATAMSNPAYKAVLDASPSSNSSWELMKEILLCKVNFRNELVDRRVILYLNDCDCGGSYCRENAAYSVKDQLRKVSLKDAAVEFIIEYQQQRTQKENSETDVGLVGHIYLDEMMLEELKISMAYVFDKCHERLKSFSQKKKVNQSLKNIELSFSESCSSSHPAAPCLTFWLKNYDSDLDNAVKVLAEKICPVLFKTIIQGDPRISSASIIWVSPDTNTWVRNPYKSSNGELALDIILEKEAVKQSGDAWRVVLDACLPVLHLIDTRRSIPYAIKQIQELLGISCTFDQAIQRVAASVKMVAKGVLREHLILLASSMTCGGNLVGFNIGGYKALSRQLNIQVPFTDATLFTPKKCFERAAEKCHTDSLSSIVASCSWGKHVAVGTGSKFDVVWDANEIKSNEIEGMDVYSFLHMVKSFTNGEEETDACLGEDIDDLLEEEYMDLGMSPQHNSGFEAVFEENPEVLNGSTSNGWDVSSNQGESKTNEWSGWASSNKAEIKDGRSEIAPKNSWGKTVNQEDSSKSNPWSTSTIADQTKTKSNEWSAWGSNKSEIPVGWASSNKTEIKDGRSETAQENSWGKTVNQEDSSKSNAWNTSTTVDHANTKSNEWSAWGSNQSEIPAGGSKAVQEDSWGSSKWKADVAQEDNSRLGAWDANAADQTKSSEWSGWGKKKDVTQEDNSRLGAWDANAADQTKSRDWSGWGKKKDITQEDNSRLGAWDANAADQTKSSEWSGWGKKKDVTQEDNSRLGAWDANTADQTKSNEWSGWGKKKEVTQEDNSRLGAWDANTADQTKSNEWSGWGKKKEVTQEDNSRLGAWDANAADQTKSNEWSDWGKKKEVTQEDNVQDSWGSGKRKDKVTQEDNSGSGGWGANRTDLAKSKSSEWSSWGKNKSEIPAGGSENVQNDSWGSGKLEDDTQKENSGSAWVRNKAETIDGGSEKPQEDAWNSGNWKAESKVGNASWGKPKSSESQAWDSHNQSNQNSSSQGWESHIASANSESEKGFQWGKQGRDSFKKNRFEGSQGRGSNAGDWKNRNRPPRAPGQRLDIYSSGEQDVLKDIEPIMQSIRRIMQQQGYNDGDPLAAEDQLFVLENVFEHHPDKETKMGTGIDYVMVNKHSSFQESRCFYVVCKDGESKDFSYRKCLANYISKKYPDLAESFLGKYFRKPRARGDQTATPGRDEAATPGEQTATPGRDEAATPAEQISTPTPMETNE

SEQ ID NO: 267 - protein, 2049 aa, Glycine max; identical to SEQ ID NO: 266

SEQ ID NO: 268 - protein, 1205 aa, Glycine max
MGHVGSSKDGTEAGPSAAAMGIDDDEDIDLGDVDLDPTNAEILEELGEDIVKYWCKKASMLFFNEYGLISHQINSFNHFIHTGLQKTFESFGDLVVTPGFDPSKKGENEHFRYASVKFGNVKLDKPMFWGGEGNAQEFKMLPRHARIQRMTYASKVKIQVKVQVYVPKKVRSDKFKTGKAEFLDREVMKEDEREIIIGRLPVMVKSDLCWMKEAEKEDDEFDHGGYFIVKGAEKTFIAQEQLYLKRLWVMNSPGWMIAYKSQMKRNRMVIKLVGNSRGEEVENGDMSLAVYFLSVEVPVWVLFFALGVSSDKEIVDLIGCGNDDVRIQNILFASVRDADEKCGAFRRGRHAVQYLEKCVKSVQFPPSESMQECLEMYVFPGISGLNRKARFLAYMVKGLLLAYTGRRKCDNRDDFRNKRLELASELLDRELKVHIAHARKRMAKALQRDLYGDRDVRPIEHYLDASIITNGLQRAFSTGAWSHPYKRMERISGVVANVGRTNPLQTMAELRRARQQVQYTGKVGDARYPHPSHWGKVCFLSTPDGENCGLVKNLAVTGLVSTDVSAVSEYILPKLLDCGMEELVDDTSTHLGNKDKVLLNGDWVGVCPDSSSFVAELRSRRRRNELPHQVEIKRDQSQHEVRIYSDAGRILRPLLVVGNLLKIKGFKSDCNSFQSLLDKGVIELIGPEEEEDCCTAWGVEYLFGKEGKRSVKYTHCELDMSFLLGLSCSLVPFANHDHARRVLYQSQKHSSQAIGFSTTNPNIRVDTLSHQLHYPQKPLFRTMASDCLGKPDNSLGQNKISKIPPKAEFYNGQNAIVAVNVHLGYNQEDSLVMNRASLQRGMFRSEHIRSYKSEIDNKESSDKKRKPEDIVNFAKLQSKIGRVDSLDDDGFPYVGANLQSGDIIIGKGAESGADNSVKLKHTERGYVQKVVLSSNDEGKNFAVVSLRQVRSPVLGDKFSSMHGQKGVLGFLESQENFPFTRQGIVPDIVINPHAFPSRQTPGQLLEAALGKGIACGGILRQATPFSTPSVDAITEQLHRAGFSRWGNERVYNGRTGEMVRSLIFMGPTFYQRLHHMSEDKVKFRNTGPVHPLTRQPVADRKRFGGIKFGEMERDCLIAHGASANLYERLFTLSDSSQIHICSKCKNVANVILRPVSGGRKIRGPYCRHCESADDIVVAHVPYGAKLLCQELFSMGINLKFETQLC

SEQ ID NO: 269 - protein, 1205 aa, Glycine max
MGHVGSSKDGTKVGLSAAAMDIDDDDDDDDDDLGDVDLDPTNSEILEELGEDMVKYWCKKASMLFFDEYGLISHQINSFNHFVAIGLQNTFDSFGDLVVTPGFDPSKKGENEHFRYASVKFGKVKLDKPMFWGGEGNAQEFKMLPRHARIQRMTYASKVKIQVKVQVYVPKKVRSDKFKTGKEEFLDREIMKEDEREIIIGRLPVMVKSDLCWMKDAEKDDDEFDHGGYFIVKGAEKTFIAQEQLYLKRLWVMNSPGWMIAYKSQMKRNRMVIKLVGNSRSEEVENGDMCLTVYFLSVEVPVWVLFFALGVSSDKEIVDLIGCGNDDVRIQNILFASVRDADEKCGAFRRVRNAVQYLEKCVKSVQFPPSESMQECLEMYVFPGISGLNRKARFLAYMVKGLLLAYTGRRKCDNRDDFRNKRLELASELLDRELKVHVAHARKRMAKALQRDLYGDRDVRPIEHYLDASIITNGLQRAFSTGAWSHPYKRMERISGVVANVGRTNPLQTMAELRRARQQVQYTGKVGDARYPHPSHWGKVCFLTTPDGENCGLVKNLSVTGLVSTDVTDVTESILLKLVDCGMQELVDDTSTHLGSMDKVLLNGDWVGVCPDSSSFVAELRSRRRRNELPHQVEIKRDQSQHEVRIYSDAGRILRPLLVVGNLLKIKGFKSDRYSFQSLLDKGVIELIGPEEEEDCCTAWGVEYLFGKEGKRSVKYTHCELDMSFLLGLSCSLVPFANHDHARRVLYQSQKHSSQAIGFSTTNPNIRVDTLSHQLHYPQKPLFRTMTSDCLGKPDHSLGQSKIPPKAEFYNGQNAIVAVNVHLGYNQEDSLVMNRASLQRGMFRSEHIRSYKSEIDNKESSDKKRKPEDIVNFAKLQSKIGRVDSLDDDGFPYVGANLQSGDIIIGKCAESGADNSVKLKHTERGYVQKVVLSSNDEGKNFAVVSLRQVRSPVLGDKFSSMHGQKGVLGFLESQENFPFTRQGIVPDIVINPHAFPSRQTPGQLLEAALGKGIACGGILKQATPFSTPSVDAITEQLHRAGFSRWGNERVYNGRTGEMVRSLIFMGPTFYQRLHHMSEDKVKFRNTGPVHPLTRQPVADRKRFGGIKFGEMERDCLIAHGASANLYERLFTLSDSSQIHICSKCKKVANVILRPVSGGRKIRGPYCRHCESADDIVVAHVPYGAKLLCQELFSMGINLKFETQLC

SEQ ID NO: 270 - protein, 1120 aa, Glycine max
MGTTTTPLSHTVRVSNIPQSATAKDLLDFLESTLGSSTVFALEIFSDNPNWKSRGFGRVQFETLDARSRALSLSQLNQLLFNRHFLRLSETDSDIIFRPQHRLQNGVLYAGFMLSDHRMSVLESWEGIAGWVLPQRKRLDFWVWHNGDCYRLEFLFEDILESHGYCLGEDARLNALLLKMKFGPRIYKKKTGTDVAANFRGDRYRFLKEDFEFLWVRTTDFSPLKSIGHSTSFCWEIVEEHLASDVFTSFPLYKENLRDLALEDREELCSLTEAVPLVKHATQSKLPYEAVFQLNSLVHTQKISLASVDDELIDLLADLDEETRAVVFQKLHKMSFTCYEPLKFVKTQLHVLSNKKKGLLQSPQNRLTDSNIMSCHRALITPTKIYCLGPELETSNHVVKHFASLASDFMRITFVEENWNKLPTNAVSTGVQKGIFSKPLKTEIYKRILTILRDGIVIGSKRFEFLAFSASQLRSNSVWLFASNDNLKAADIREWMGCFNNIRSVSKCAARMGQLFSSSMQTFEVASEDVEMIPDIEVTSDGVSYCFSDGIGKISQCFARQVAQKLNLDHTPSAFQIRYGGFKGVIAIDRHSFRKLSLRSSMLKFESNNRMLCVTKWSESMPCFLNREIISLLTTLGVKDEVLLAMQQDQLDLLGRMLTDSKAALDVLESLNGADSKSILVKMLHEFNEPNSEPYLSMMLKAYYAYQLSDLKSRCRIFVPKGRVLVGCLDETGLLNYGQVFVRITVAKTRENFGDENLRKVDGDDSTRIIVGKVVVTKNPCLHPGDIRVLDAIYSKELEENGLRDCLVFPQKGHRPHPNECSGGDLDGDLFFLSWDKDLIPCQTEAPMDYTGRRPRIMDHKVTLEEIQQFFVDYMINDTLGAISTAHLVHADREQDKAKSRKCLELAELHSMAVDFAKTGAPAAMPRVLKPREFPDFMERVDKPMYISKGVLGKLYHAIIESQMQIRYSFVWSEKHAEEAYDRSLEVNGFEAFLETASTHKEMYAEKMSSLMDFYGAETEDEMLLGNVQNRASYLQRDNRRYGDMKDRILLSVKNLQREAKEWFETSCQPREYKPMASAWYHVTYHRSHYCQESPCFLSFPWIVGDILLQIRSVNSFVNR

SEQ ID NO: 271 - protein, 1121 aa, Glycine max
MGTTTTTTLSNTVRVSNIPQSATAKDLLDFLESTVGPSTVFALEIFSDNPNWKSRGFGRVQFETLDARSRALSLSQLNHLLFHRHFLRLSETDADIIFRPQHRLHNGVLYAGFVLSDHRMSVLESWEGVAGWVLPLRKRLDFWVWHNGDCYRLEFLFEDILESHGYCLGEDAKLNALLLKMKFGPRIYKKKTGADVAAKFRGDRYRFCKEDFEFLWVRTTDFSPLKSIGHSTSFCWEIVEEHLALDVFKSFPLYKENLRDLALEDGEEFCSSTEAVPLVKRASQSKLPYEALFQLNSLVHTQKISLASVDDELIDLLAGLDEETRAVIFLKLHKMSFTCYEPLKFVKTQLHVLSNKKKGLPQSSQKRLTDSNIMSCHRALITPTKIYCLGPELETSNHVVKHFASHASDFMRITFVEENWNKLPTNAVSTGVQKGLFSKPLKTEIYKRILTILRDGIVIGSKRFEFLAFSASQLRSNSVWLFASNDNLKAADIREWMGCFNNIRSVSKCAARMGQLFSSSMQTFEVVSQDVEIIPDVEVISDGVSYCFSDGIGKISQSFARQVAQKLKLDHTPSAFQIRYGGFKGVIAVDRRSFRKLSLRSSMLKFESKNSMLCVTKWSESMPCFLNREIISLLSTLGVKDEVLLAMQHDQLDLLGRMLTDSKAALEVLESLNGADSKSILVKMLHEFNEPNSEPYLSMMLKAYYAYQLSDLKSRCRIFVPKGRVLVGCLDETGLLNYGQVFVRITVTKTREKFGDENLRKVDGDDNTCIIVGKVVVTKNPCLHPGDIRVLDAIYSEELEEKGLRDCLVFPQKGHRPHPNECSGGDLDGDLFFISWDKDLIPCQTEAPMDYTGRRPRIMDHKVTLEEIQQFFVDYMINDTLGAISTAHLVHADREQDKAKSRKCLELAELHSMAVDFAKTGAPAAMPRVLKPREFPDFMERVDKPMYISKGVLGKLYRAIIESQMQIRYSFVWSEKHAEEAYDRSLEVNGFEAFLETASTHKEMYAEKMSSLMDFYGAETEDEMLLGNLQNRASYLQRDNRRYGDMKDRILLSVKNLQREAKEWFETSCEPHEYKPMASAWYHVTYHPSYYCRESPCFLSFPWIVGEILLQIRSVSKGVHK

SEQ ID NO: 272 - protein, 941 aa, Glycine max
MKFGPRIYKKKTGADVAAKFRGDRYRFCKEDFEFLWVRTTDFSPLKSIGHSTSFCWEIVEEHLALDVFKSFPLYKENLRDLALEDGEEFCSSTEAVPLVKRASQSKLPYEALFQLNSLVHTQKISLASVDDELIDLLAGLDEETRAVIFLKLHKMSFTCYEPLKFVKTQLHVLSNKKKGLPQSSQKRLTDSNIMSCHRALITPTKIYCLGPELETSNHVVKHFASHASDFMRITFVEENWNKLPTNAVSTGVQKGLFSKPLKTEIYKRILTILRDGIVIGSKRFEFLAFSASQLRSNSVWLFASNDNLKAADIREWMGCFNNIRSVSKCAARMGQLFSSSMQTFEVVSQDVEIIPDVEVISDGVSYCFSDGIGKISQSFARQVAQKLKLDHTPSAFQIRYGGFKGVIAVDRRSFRKLSLRSSMLKFESKNSMLCVTKWSESMPCFLNREIISLLSTLGVKDEVLLAMQHDQLDLLGRMLTDSKAALEVLESLNGADSKSILVKMLHEFNEPNSEPYLSMMLKAYYAYQLSDLKSRCRIFVPKGRVLVGCLDETGLLNYGQVFVRITVTKTREKFGDENLRKVDGDDNTCIIVGKVVVTKNPCLHPGDIRVLDAIYSEELEEKGLRDCLVFPQKGHRPHPNECSGGDLDGDLFFISWDKDLIPCQTEAPMDYTGRRPRIMDHKVTLEEIQQFFVDYMINDTLGAISTAHLVHADREQDKAKSRKCLELAELHSMAVDFAKTGAPAAMPRVLKPREFPDFMERVDKPMYISKGVLGKLYRAIIESQMQIRYSFVWSEKHAEEAYDRSLEVNGFEAFLETASTHKEMYAEKMSSLMDFYGAETEDEMLLGNLQNRASYLQRDNRRYGDMKDRILLSVKNLQREAKEWFETSCEPHEYKPMASAWYHVTYHPSYYCRESPCFLSFPWIVGEILLQIRSVSKGVHK

SEQ ID NO: 273 - protein, 1204 aa, Glycine max
MDLEGSEKDSVVTQISIGGFGSEVKASDLVNYLEDKIGLVYRCRLKTSWTPPESYPEFNIIDTANIRRTDNYKKVEPHAFVHFASPESVTAALNASGCCDLFLKNQPLKVSCGPENPYFLNQRRRTTTPFKMSDVLVEIGTLVSPGEFFVSWRGPDKGVKFLVDPFDGMCRFCFSRDTAFSFKGIEKKAVIKCDFQVGFLVRDINEIKRYNDTSYLVVLLHLASSPWVWYRTADDDIEESVPFDLLDDDDPWIRTTDFTPSGAIGRCNFYRISIPPRHGAKLMKAMLYLKGQRVQMQELALKQTLRTLNEPDFGVPMSDAFFYIHFQKDIAFDIMFLVNAIVHKGIFNQHRLSDRFFELLKNQPKELNVAALKHLCSYKRPVFDATKRLKIVQEWLLRNPKLYQISKQLDDIVEVRRLVITPSKAYCIPPEVELSNRVLRKFREVSDCFLRVTFMDEGMQTINVNALNYYVAPIVKEITSNSFSQRTKIYKRVKTILEQGFYFCGRKYSFLAFSSNQLRDRSAWFFAEDKIRCDDIRNWMGKFNQRNVAKCAARMGQCFSSTYATVEVAANEVNSMLPDVERNNYIFSDGIGVITHDLAREVAEKLKLDNVPSAYQIRYAGFKGVVASWPAKGDGVRLSLRPSMNKFQSTHNILEICAWTRFQPGFLNRQIITLLSALGVPDEVFWQMQEAMLLKLNQMLVDADIAFDVLTKSCAEHGNAAAIMLSCGFSPLTEPHLRGMLTSTRAAQLWGLREKSRIFVSSGRWLMGVLDESGVLEQGQCFVQVSTPSLENCFSKHGSRFSETKNLHVVKGFVIIAKNPCLHPGDVRVLEAVDAPDLHHLNDCLVFPQKGDRPHTNEASGSDLDGDLYFVTWDENLIPPSKRSWIPMEYAPQESKLKTRQVMTRDIIEFFVRNMVNEHLGAICNAHVVHADSSDYGALDEKCIHLAELAATAVDFPKTGKLVTMPPHLKPKLYPDFMGKERHQSYRSKKILGRLYRRIKDAYDEDIDAPYLNFVTGDIPYDKDLEVPGSADFIADAWEQKCSYDGQLSGLLGQYKVKREEEVVTGQIWSMPKYNSRKQGELKERLKHSYSALKKEFRHTFEKLNSDVGELSEEEKNLFYEQKASAWYQVTYHPEWVKKSLDLQDKSSENQEADSLGSTVMLSFPWIAVDYLARTKIRQRHQRCGNFDSTKPVDSLAKYLSERL

SEQ ID NO: 274 - protein, 1204 aa, Glycine max; identical to SEQ ID NO: 273

SEQ ID NO: 275 - protein, 1204 aa, Glycine max
MDLEGSEKGSVVTQISIGGFGSEVKASDLLNYLEDKIGLVYRCRLKTSWTPPESYPEFKIIDTAKIRRTEDYKKVEPHAFVHFASPESVTAALNASGCCDLFLKNQPLKVSCGPKNPYFLNQRRRTTTPFKMSDVLVEIGTLVSPGEFFVSWRGPDKGVKFLVDPFDGMCRFCFSRDTAFSFKGIDKKAVIKCDFQVGFLVRDINEIRRYNDTSYLVVLLHLASSPWVWYRTADDDIEESVPFDLLDDDDPWIRTTDFTPSGAIGRCNFYRISIPPRHGAKLMKAMLYLKGQRVQIQELPLKQTLRTQNEPDFGMPMSDAFFYVHFQKDIAFDIMFLVNAIVHKGIFNQHRLSDRFFELLRNQPKELNVAALKHLCSYKRPVFDATKRLKIVQEWLLRNPKLYQISKQLDDIVEVRRLVVTPSKAYCIPPEVELSNRVLRKFREVSDCFLRVTFMDEGMQTINVNALNYYVAPIVKEITSNSFSQKTKIYKRVKTILEEGFYFCGRKYSFLAFSSNQLRDRSAWFFAEDKIRCDDIRNWMGKFNQRNVAKCAARMGQCFSSTYATVEVAANEVNSMLPDVERNNYIFSDGIGVITHDLAREVAEKLKLDNVPSAYQIRYAGFKGVVASWPAKGDGVRLSLRPSMNKFQSTHNILEICAWTRFQPGFLNRQIITLLSALGVPDEIFWQMQEAMLLKLNQMLVDADIAFDVLTKSCAEHGNAAAIMLSCGFSPLTEPHLRGMLTSTRAAQLWGLREKSRIFVSSGRWLMGVLDELGVLEQGQCFVQVSTPSLENCFSKHGSRFSETKNLHVVKGFVVIAKNPCLHPGDVRVLEAVDAPDLHHLNDCLVFPQKGDRPHTNEASGSDLDGDLYFVTWDENLIPPSKRSWIPMEYAPQESKLLTRQVMTRDIIEFFVRNMVNEHLGAICNAHVVHADSSDYGALDEKCIHLAELAATAVDFPKTGKLVTMPPHLKPKLYPDFMGKERHQSYRSNKILGRLYRHIKDAYDEDIEAPYLNFVTGDIPYDKDLEVPGSADFIADAWEQKCSYDGQLSGLIGQYKVKREEEVVTGQIWSMPKYNSRKQGELKERLKHSYSALKKEFRYTFEKLNSDVGELSEEEKNLLYEQKASAWYQVTYHPEWVKKSLDLQDKSSENQEADSLGSTVMLSFPWIAVDYLARTKIRQRHQRSGNFDSTKPVDYLAKYLSERL

SEQ ID NO: 276 - protein, 1204 aa, Glycine max; identical to SEQ ID NO: 275

SEQ ID NO: 277 - protein, 638 aa, Glycine max
MSSKRGGGRPVTVANNDMSKGKSISEAHPKVEQLTQGIADTKLNSGQDDGEWEVYARKSKNKAGSSAAKPWAPPAHNSNPRAWGNAEMAQKPGIRGHGGLGRSSGNPWQTQNANFRRPAGRGNGRPQLATSGYESNYVPNPAIRPPLEHGWNWQSRPGALQSNARDEISPEDLQKNDDVDDDDGEEDSDAFEDTDDDLMSDDYDSDASQKSHETRKKIKWFKKFFEILDGLTVEQINEPERQWHCPACQGGPGAIDWYRGLQPLVTHAKTKGSKRVKIHRELAILLDEELRRRGTSVIPAGEVFGKWKGLKEEEKDHDIVWPPMVVIQNTKLEQDENDKWIGMGNQELLDYFSTYDAVRARHSYGPQGHRGMSVLIFEASASGYLEAERLHKHFAEQGTDKDSWFSRPILYLPGGNRQLYGYMATKEDMDFFNRHSQGKSRLKYDIRSYQEMVVHQIRQMNEDNQQLLYFKNKAVKGAKHTKALEESIGIMSEKLRKTMEENRIVRRRTKMQHEETKEEMYMQEQFFKDQIKIIHDSRDAKEEDFERMQQEEREKVKQSSTTGHVNAEEYRLKVEEYLKFVEVQDKEMENFVAEKEKLLHAHGTGYAAMKRRHWEEEVQYEQKFDEELANLMEKYSPS

SEQ ID NO: 278 - protein, 638 aa, Glycine max; identical to SEQ ID NO: 277

SEQ ID NO: 279 - protein, 645 aa, Glycine max
MSLKRGGGRPVTVANNDMSKGKSISEPQPKVEQLTQGIADTKLNSEQDDGEWEVYARKSKNKAGSSAAKPWGPPVHNSNPRAWGNAEMVQKPGIRSHGGVGRSSGNPWQTPNANFRRPAGRGNGRPQLGTSGYESNYVTPNPVIRPPLEHGWNWQSRPGAMQSNVRDEISPEDLQKNYGVDDDGEEEESDDLEDTDDDLMSDDDDSDASQKSHETRKKSKWYKKFFEILDGLTVEQINEPERQWHCPACQGGPGAIDWYRGLQPLVTHAKTKGSKRVKIHRELAILLDEELRRRGTSVIPAGEVFGKWKGLKEEEKDHEIVWPPMVVIQNTKLEQDENDKWIGMGNQELLDYFSTYAAAKARHSYGPQGHRGMSVLIFEASASGYLEAERLHKHFAEQGTDKDAWFNRPILYLPGGNRQLYGYMATKEDLDFFNRHSQGKSRLKYDIMSYQEMVVHQIRQMNEDNQQLLYFKDKAVKGAKHTKALEESIGIMSEKLRKTMEENRIVRRRTKMQHEETKEEMYMQEQFFKDQIKIIHDSRDAKEEDFEKMQQEEREKVKQSSSTGHVNAEEYRLKVEEYLKFVEVQDKEMENFVAEKEKLLHAHGMGYAAMKRRHWEEEVQYEQKFDEELANLMEKYSPLEKFNGI

SEQ ID NO: 280 - protein, 645 aa, Glycine max; identical to SEQ ID NO: 279

SEQ ID NO: 281 - protein, 611 aa, Glycine max
MADDGADPFPKLTSVYRVSGSKNNKLSWNVANSQQSVDSSVNNSRQLQSISDGSASRSWFSQNSRPNAWEVPSVIQKLRLGKRGNDGLTNNSNLQDKSNSPDALALTGSGILNDSKLPPESAISPTSETCLNSSVDVVDTTTSKDLKNVECKDERIPEPHCEDNGSDIVFDSDDDCFLDNIDLDTGERSHEQCKKSKWLRNFFDKLNALTNEEISSLDRQWHCPACQGGSGAIDWYKGLQPLLDHSRTIQTTRARLHRMFAETLEEECFRRRAPLTTVGEVHNIWEGLDKKVKDHEIVWPPMVIIMNTRYEQDESNKWNGMGNQELVDCFSDYAALKARHSYGPQGHRGMSALIFEETTAGYLEAVRLHKHFKEQGRDREAWDCCQNPFLPGGKRQLYGYLASKEDLDIFNKHSGGKTKLKFEMRSYQEMVERKIKHINDDSRKLDYYKSMVAKEQIKSQVGADSLCKSSEKLSMTTEKNRVDQQDKEMDALEKNFQSQIQDIQQAIAAKEDKFVKLQLQAMQEKVKESCKESSEKEDKVENISSFLKPQDKEMKQFEAEREKIKKIHEEKKLALKKKQWQEQVELEKELENELTQLMDKYNCNQSQEKNC

SEQ ID NO: 282 - protein, 611 aa, Glycine max; identical to SEQ ID NO: 281

SEQ ID NO: 283 - protein, 611 aa, Glycine max; identical to SEQ ID NO: 281

SEQ ID NO: 284 - protein, 611 aa, Glycine max; identical to SEQ ID NO: 281

SEQ ID NO: 285 - protein, 687 aa, Glycine max
MPSQLKVHLAISPFVLLHTTAGDRLRISEKRNSKRGCERPFTMADIGDSSSKGKNVLESLPKIEQLTQGVADVNIESGQDDGEWVVYAKKSKNRARSTTVKPWSPPVHNSRPTGNTKMAHKPVTRNDGGVGRASGSGNPWQSQNANFKRPAGRGNGRPQLTASESESSNNVTSNPVIRPPLEHGWNWQSISGSKQSKSVDDSLVKGEITEESPMKNDSVDDEGDEEEGFDAMEDTDDDLMSDDYDSDTSQKSHETRKKSKWFKDFFENLDGLSIEKINEPERQWHCTACRGGPGAIDWYRGLQPLITHAKTKGSKRVKIHREFAELLEEELRKRGSAVIPPGEVFGKWKGLKDEEKDHEIVWPPMVVIQNTRLEQDENDKWLGMGNQELLNYFSAYDAVKARHAYGPQGHRGLSVLIFEASAIGYLEAERLHKHFAEQGTDRDAWFSHHRRLFLPGGRRQLYGYMAIKEDLDFFNRHCQGKSRLKYDMRSYQEMVVNQLRQMNEDNQLLIYLKDRDAKKQKQTKALEESLGIVTEKLRRTMEENRIVRLRTKMQHEENKEEMYMQEEFFKEQIRIIHDSRAAKEEEFERMQQEKREKVKPSSTSPLNEEEGRVKVDEYLKFVEFQDKEMENFVAEEEKLRQAHKDNVDAMTRRHWEEKVQLEERFNEELAKLMEKYSLSHPEKSNGI

SEQ ID NO: 286 - protein, 609 aa, Glycine max
MADDGADPFPVLTSVYRVSGSKNSQLGWNVANSQQTVDSSVNNSRQLQSISDGSAPRPWFSQNFRPNAWEVPGVIQKLRPAKRGNDGLALTGSGILNDKLPPESVISPTSETERGTGLNSSVGVVTTTSKDCENVECKDKDKRIPEPQCENNNDQIVDNGSDIVFDSDDDCFLDDIDSDTGERSHEQCKKSKWLRNFFDKLNALTNEEISSLDRQWHCPACQGGSGAIDWYKGLHPLLDHSRTIQTKRARLHRMFAETLEEECFRRRAPLTTVSDVHDIWEGLDKKVKDHEIVWPPMVIIMNTRYEQDESNKWNGMGNQGLLDCFCDYAALKARHSYGPQGHRGMSALIFEESTAGYLEAVRLHKHFKEQGRDREAWDCYRNPFLPGGKRQLYGYLASKEDLDIFNKHSRGKTKLKFEMRSYQEMVESKIKHINDDSRKLDYYKSMVAKEQIKSQVGADSLLRLSEKLSLTTEENRVDQQNKEMDALEKNFQSQILDIQQAIAAKEDKFVKLQQAMQEKVKESCGESSEKEDKVENISCFLKPQDKEMKQFEAEREKIIKIHEEKRLALKKKHWQEQVELEKELENERTQLMDKYTCNQTQEENCYVDH

SEQ ID NO: 287 - protein, 716 aa, Glycine max
MNSLFSPENLPPPPGIPIPATIAAASTTTPNPILIPKLEPFDEWLNTHTPQQQQQSQDPNSSNGSLDLDLKLFGDESPEDFSGDPNLLSDFNRLSQLFRTAFSNNNAVPDPITQGIQQLGNDAVSNPFAKPPQNETTVVPPPSFQNGTVSDPGMLLQQQQQYPNGAVSDPDSRAIVPVPEDGRSSSVAVTTPRQPRRCKELVRLMDVGGPEQRHFRDVVRRTRMLYDSLRVLATVEDEGRVDARRGRSDLRASAVMRNCGLWLNRDKRIVGAIPGVCIGDVFLYRMELCVVGLHGQPQAGIDYLPASMSSNGEPIATSVIVSGGYEDDVDEGDVIIYSGHGGQDKHSRQVFHQKLEGGNLAMERSMHYGIEVRVIRGVRYEGAASATGRLYVYDGLYRIHECWFDVGKSGFGVYKYKLCRIDGQAKMGTVVMKEALMLRKDPLSFKPMCCLSLDVSNRKENVAIRLFNDIDRNYDPLQYEYLVKTNFPQFVFHQSGRGTGCECVDGCVEGCFCAMKNGGDFPYNQSGILLRGKPLVFECGPFCHCPPHCRNRVTQKGLKNRLEVFRSRETGWGVRSLDLIQAGAFICEYTGVVLTRDQAQLLTMNGDSLIYPNRFTDRWAEWGDLSMIDSNYVRPSYPSIPPLDFAMDVSRMRNVACYMSHSSTPNVLVQFVLYDHNNLMFPHLMLFAMESIPPMRELSLDYGVADEWTGKLSIGN

SEQ ID NO: 288 - protein, 709 aa, Glycine max
MNFLFSRENLPPPPGIPIPATIAAANTTPNPILIPKLEPFDELLNTHTPQQQQQSQDPSFSNGSLDLDLDLDLKLVCDETPGAFSGDPSLLSDFNRLSQLFKTAFTNNNAVLDPIAQGLQQLQNDAVSDPLDGTTVVPPQSFQNSDPGMQQQQQYPNGAVSDPDSRAIVPVPEEGRSSSVAVTTPRQRRFKELVRLTDVGGPEQRHFRDVVRRTRMVYDSLRVLATVEDEGRVDARRGRSDLRASAVMRNCGLWLNRDKRIVGAIPGVCIGDVFLYRMELCVVGLHGQPQAGIDYLPASMSSNGEPIATSVIVSGGYEDDVDEGDVIIYSGHGGQDKHSRQVFHQKLEGGNLAMERSMHYGIEVRVIRGVRYEGAASATGRLYVYDGLYRIHECWFDVGKSGFGVYKYKLCRIDGQAKMGTVVMKEALMLRKDPLSFKPTCCLSLDVSNRKENVAVRLFNDIDPNYDPLQYEYLVKTNFPQFVFHQSGRGTGCECADGCVEGCFCAMKNGGDFPYNQSGILLRGKPLVFECGPFCRCPPHCRNRVTQKGLKNRLEVFRSRETGWGVRSMDLIQAGAFICEYTGVVLTREQARLLTMNGDSLIYPNRFTDRWAEWGDLSMIDSNFVRPSYPSIPPLDFAMDVSRMRNVACYMSHSSTPNVLVQFVLYDHNNLMFPRLMLFAMESIPPMRELSLDYGVADEWTGKLSICNE

SEQ ID NO: 289 - protein, 588 aa, Glycine max
PKPEPFWDTHIETSDELDLYSEFNRVTELFHFAFGATNVVDPFGATNVACPEQTPLVPVPQELDSAAQPDPNSPSEDVLRAIVPVPPEQQDGAVATATVPRRKQSRQKELVRVMDLSPRDEAHLRETVRRTRLIYDSLRVLTSVEEEKRVASVALRRLRGDLRAASLMRERGLWLNRDKRIVGAIPGIMVGDLFLFRMELCVVGLHGQIQAGIDFLPASMSSTGEPIATSVIVSGGYEDDMDDGEVIVYTGHGGQEKNSSRQISHQKLESGNLALERSMHYGVEVRVIRGMKYEGSAAGSGKVYVYDGVYRIVDCWFDVGRSGFGVYKFKLWRIEGQAKMGSAILKEARNVRRSELDLNPTSADMANRKENVAVRLFNDFDDDRGPLCYEYLVRTCFPKFVFHQSGKATGCDCVDGCGDGCFCAMKNGGEFPYTLQGHLVRGKPLIFECGPFCSCPPHCRNRVAQKGLKYRLEVFRSKQTSWGVRSLDLIQAGSFICEFAGVVLTREQAQLLTMNDISLDVSTMRNVACYMSHSSTPNVWVQFVLHDHNNLMFPHLMLFAMENIPPMRELSLDYGVADEWTGKLSICN

SEQ ID NO: 290 - protein, 1125 aa, Glycine max
MGKTIELYGFPTSVNVSDVKTFVEQYTGEGTVFAIKLRHGKGRVPRAFAIIQFTTANSATSMMSRANNILRTLRYGTSYLKAREMERDIVPRPRVFLHSLDDVKLSFGCQISKGRFSVLWKKQDVIVNFGSGMRKMHFLFSHNNVQYKLELSYENIWKIELHRPRNETTRYLLIQLLGAPRVFENDVPTSTNIFDDPLFNFFKDAPDEQWIRAIDFTPESRIGQSSAICLELPNGRQLPNFRENFAYYEESERQYTLQTGVPFSQNWGLVPIVAPPLGVKISYDILFKVNSLVQHACLAGPALDGDFYRLVDPRRMPREFIEYALEKIYYSKEFCYEPTKWLTDQYKTYLESKNHPRSPAISLDTGLVYVRRVQITPCKVYFCGPEMNVSNRVLRHFREHIDNFLRVSFVDEELDKLFSTDLSSRSQNKKTEIYTRILSILKNGIVVGDKKFEFLAFSSSQLRENSLWMFAPTETGCTAAYIRKWMGNFSQIRNVAKYAARLGQSFGSSTETLSVHRDEVEIIPDVKKLTYDGNEYVFSDGIGKISLEFAQKVAKKCGYDCTPSAFQIRYGGYKGVVAVDPKSCYKLSLRKSMRKYDSDNTKLDVLARSKFQPCYLNRQLISLLSTLGIKDDVFEKKQRETVNQLNTILTDSLKAQEVLDLMSAGEITNVLKEMLICGYKPNEEPFLSMMLQTFRASKLLELRLKSRIFIPKGRAMMGCLDETRTLEYGQVFVQFSNNRLQNLSDDFFSYDLPKNYMVKGKVVVAKNPCLHPGDVRVLQAVDVPDLYHMVDCVVFPQKGPRPHPNECSGSDLDGDIYFVCWDHELIPSRPIDPMDYTAPATVELDHDVMIEEVEEYFANYIVNDSLGIIANAHTVFADKEHLKAMSDQCVKLARLFSTAVDFPKTGVPAVIPPELHVKEYPDFMEKPDKPTYKSHNVIGKLFREVKEISTSAGSITSFTKLVARDSYDHEMEVDGFMDYVDDAFYHKTNYDYKLGNLMDYYGIKTEAEILGGNIMKMSKSFNKRRDAEAINMAVRSLRKEARAWFNENSSGDVDSGSSDVYAKASAWYHVTYHPSYWGCYNEGMNRDHYLSFSWCVYPLLVQIKKEKLSIRRSSLEYSFSGLRLS

SEQ ID NO: 291 - protein, 1125 aa, Glycine max; identical to SEQ ID NO: 290

SEQ ID NO: 292 - protein, 1125 aa, Glycine max; identical to SEQ ID NO: 290

SEQ ID NO: 293 - protein, 1636 aa, Glycine max
MPDGESSVVVAGGQASMEPSLSVSNQLQSLSLSQDKNHDDSVKKDPRKIARKYQLELCKKAMEENIIVYLGTGCGKTHIAVLLMYGMGHLIRKPQKNICVFLAPTVALVHQQAKVIADSTNFKVGTYCGSSKRLKRHQDWEQEIGQYEVLVMTPQILLHNLSHCFITMEMIALLIFDECHHAQVKSNHAYAVIMKVFYKSNSSKVPRIFGMTASPVVGKGASSEANLAKSINSLEHILDAKVYSVEDKELQSFVTTPVINIYHYVSTASGETSLYLKIEEIKRQCIANLGRSIEDHQKRMNAKKLLNRMHDNVIFGLQNLGIWGALQASHILLSGDRSERHELVEAEGNSSDDSLCDKYLAQAAELFTSQCMIGDRVTDLSSVEILKEPFFSAKLLRLIGILSNFRLQKNMKCIIFVNRIVTARSLSYILQKLKLLRQWRSDFLVGVHAGLKSMSRKTMNIIVDKFRSGELNLLVATKVGEEGLDIQTCCLVIRFDLPETVASFIQSRGRARMPQSEYAFLVDSGNKKELDIIDGFEKDEYRMNMEITFRTSKETYIIPEERIFRVDSSGASVSSGYSISLLHQYCSKLPHDEYFDPKPCFYYLDDSGGISCHITLPSNAPINQILGTPQLSMEASKRDACLKAIEELYNLGTLSDCLLPKQDDAEPEAQVSGSSDEDECEDAISRGELHEMLVPSAFGQSWINEDNIVRLNSYYIKFCPYPEDRVYKEFGLFIMVRLPMEAEKLELDLHLAHGRSVMTKFVPFGVVEFDKDEIKMAENFQEMFLKIILDRLEFVSEFVDLGMGAESHTGTSTFYLLLPVVLQEYGNAMKVDWKTVKRCLCSPIFRHPADTMDKKVFPLDIHLQLANGYRSVRDVENSLVYAPHKKNFYFVTNVNYQKNGYSPHNDSGTSSYVDYFIEKFSIHLKCPEQPLLHVKPVSNLHNLLHNRKHEDAEPQELDEYLIYLPPELCELKIIGFSKDIGSSISLLPSIMHRLGNLLVAIELKHRLSSSFPEAAEISALRVLEALTTEKCQERFSLERLEVLGDAFLKFAVARHFFLMHDSLHEGDLTKRRSNAVNNSNLFKLAIKRNLQVYICDQTFDPTQFYALGRPCPRLCSNETKESIHFCLNSVKEQGKVTETQCNKNHHWLHRKTIADVVEALVGAFLVDSGFKAAIAFLSWIGIQVDFEASQVVDICIASASYLPLSSEVDIPSLEGKLGHHFFHKGLLLQAFVHPSYNKLGGGCYQRLEFLGDAVLDYLITSYVFSAYPKLKPGQLTDLRSLSVNNKAFACLAVDRSFDKFLLCDSSGLSEAIKKYVDYIRRPVSDNSIKEGPKCPKALGDLVESCVGAILLDSGFNLNKVWKIMTSFLDSIMKFSSSLQLSPVRDLRELCQSHNMELEFLPVPSKLTKRFSVEAKVSGNGVCETASATGQNKKEACRIASLLLFSKFKAQGWKAKSKTLEEVLESTSKMEPKLIGYDETPIDVTDTNKHIVVNADPYNKSNPEIRPMQETDEICSPCVKPFGQRLQSSAKGKLSQIFENRDCSSDLSGTGTARSRLYELCASYCWKPPSFECCKAEGPDHLKQFTCKVTLEIEEAQNLILEFVGEPLSKKKDAAESAAEGAFWYLQHEGYLPSSGN

SEQ ID NO: 294 - protein, 1637 aa, Glycine max
MPDGESSAVAGGQVSMEPSLSLSDQLQSLSLSQVKNHDDSVKKDPRKIARRYQLELCKKAMEENIIVYLGTGCGKTHIAVLLMHEMGDLIRKPQKNICVFLAPTVALVHQQAKVIADSTDFKVGTYCGSSKRLKHHQDWEQEMGQYEVLVMTPQILHHNLSHCFITMEMIALLIFDECHHAQVKSNHAYAVIMKVFYKSNSTKVPRIFGMTASPVVGKGASSEANLAKSINSLEHILDAKVYSVEDKELQSFVTTPVINIYHYVSTASGETSLHLKIEEIKRQCIATLGRSIEDHQKRMNTKKLLNRMHDNVIFGLQNLGIWGALQASHILLSGDHSERHELVEADGNSSDDSLCDKYLAQAAELFTSQCMIGDRVTDLSSVEILKEPFFSAKLLRLIGILSNFRLQKNMKCIIFVNRIVTARSLSYILQKLKLLRQWRSDFLVGVHAGLKSMSRKTMNIIVDKFRSGELNLLVATKVGEEGLDIQTCCLVIRFDLPETVASFIQSRGRARMPQSEYAFLVDSGNKKEIDVIDGFKEDEYRMNMEVTFRTSKETYIIPEERIFRIDSSGASVSSGYSISLLHQYCSKLPHDEYFDPKPSFHYLDDSGGISCHITLPSNAPINQILGTPQLSMEASKREACLKAIEELYNLGALSDCLLPKQDDAEPEVQVSGSSDEDECEDAISRGKLHEMLVPSAFGQSWINEDNIVRLNSYYIKFCPYPEDRVYKEFGLFMMTCLPMEAEKLELDLHLAHGRSVMTMFVPFGVVEFNKDEIKMAENFQEMFLKIILDRLEFISEFVDLGMSAESHSGTSTFYLLLPVVLQEYGNAMEVDWKIVKRCLCSPIFRHPADTMDKKVFPLDIHLQLANGYRSVRNVENSLVYAPHKKNFYFVTNVNYEKNGYSPHNDSGTSSYVDYFIEKFSIHLKCPKQPLLHVKPVSNLHNLLHNRKREDAEPQELDEYLIYLPPELCELKVIGFSKDIGSSISLLPSIMHRLGNLLVAIELKHMLSSSFPEAAEISAIRVLEALTTEKCQERFSLERLEVLGDAFLKFAVARHFFLMHDSLHEGDLTKRRSNAVNNSNLFKLAIKRNLQVYICDQTFDPTQFYALGRPCPRVCSNETEESIHFCLNSVMQQGKATETRCSKNHHWLHRKTIADVVEALVGAFLVDSGFKAAIAFLSWIGIQVDFEASQVVDICIASASYSPLSSEVDIPSLEGKLGHHFFHKGLLLQAFVHPSYNKLGGGCYQRLEFLGDAVLDYLITSYLFSAYPKLKPGQLTDLRSLSVNNKAFACLAVDRSFDNFLLCDSSGLSEAIKKYVDYVRRPVSDNGIKEGPKCPKALGDLVESCVGAILLDSGFNLNKVWKIMTSFLDPIMKFSSSLQLSPVRDLRELCQSHNLELEFLPVPSKLTKRFSVEAKVSGNGVCETASATGQNKKEACRIASQLLFLKFKAQGWKAKSKTLEEVLESTSKMEPKLIGYDETPIDVTDTNTAKHIVVNADPYNNSNPEICPMQLTDEICSPCVKPFGQRLQSSAKGKLSQIFENRDCGSDSSGTGTARSRLYELCAAYCWKPPSFECCKKEGPDHLKQFTCKVTLEIEEAQNLILEFVGEPLSKKKDAAESAAEGALWYLQHEGFLPSIGN

SEQ ID NO: 295 - protein, 1635 aa, Glycine max
MPDGESSAVAGGQVSMEPSLSLSDQLQSLSLSQVKNHDDSVKKDPRKIARRYQLELCKKAMEENIIVYLGTGCGKTHIAVLLMHEMGDLIRKPQKNICVFLAPTVALVHQQAKVIADSTDFKVGTYCGSSKRLKHHQDWEQEMGQYEVLVMTPQILHHNLSHCFITMEMIALLIFDECHHAQVKSNHAYAVIMKVFYKSNSTKVPRIFGMTASPVVGKGASSEANLAKSINSLEHILDAKVYSVEDKELQSFVTTPVINIYHYVSTASGETSLHLKIEEIKRQCIATLGRSIEDHQKRMNTKKLLNRMHDNVIFGLQNLGIWGALQASHILLSGDHSERHELVEADGNSSDDSLCDKYLAQAAELFTSQCMIGDRVTDLSSVEILKEPFFSAKLLRLIGILSNFRLQKNMKCIIFVNRIVTARSLSYILQKLKLLRQWRSDFLVGVHAGLKSMSRKTMNIIVDKFRSGELNLLVATKVGEEGLDIQTCCLVIRFDLPETVASFIQSRGRARMPQSEYAFLVDSGNKKEIDVIDGFKEDEYRMNMEVTFRTSKETYIIPEERIFRIDSSGASVSSGYSISLLHQYCSKLPHDEYFDPKPSFHYLDDSGGISCHITLPSNAPINQILGTPQLSMEASKREACLKAIEELYNLGALSDCLLPKQDDAEPEVQVSGSSDEDECEDAISRGKLHEMLVPSAFGQSWINEDNIVRLNSYYIKFCPYPEDRVYKEFGLFMMTCLPMEAEKLELDLHLAHGRSVMTMFVPFGVVEFNKDEIKMAENFQEMFLKIILDRLEFISEFVDLGMSAESHSGTSTFYLLLPVVLQEYGNAMEVDWKIVKRCLCSPIFRHPADTMDKKVFPLDIHLQLANGYRSVRNVENSLVYAPHKKNFYFVTNVNYEKNGYSPHNDSGTSSYVDYFIEKFSIHLKCPKQPLLHVKPVSNLHNLLHNRKREDAEPQELDEYLIYLPPELCELKVIGFSKDIGSSISLLPSIMHRLGNLLVAIELKHMLSSSFPEAAEISAIRVLEALTTEKCQERFSLERLEVLGDAFLKFAVARHFFLMHDSLHEGDLTKRRSNAVNNSNLFKLAIKRNLQVYICDQTFDPTQFYALGRPCPRVCSNETEESIHFCLNSVMQQGKATETRCSKNHHWLHRKTIADVVEALVGAFLVDSGFKAAIAFLSWIGIQVDFEASQVVDICIASASYSPLSSEVDIPSLEGKLGHHFFHKGLLLQAFVHPSYNKLGGGCYQRLEFLGDAVLDYLITSYLFSAYPKLKPGQLTDLRSLSVNNKAFACLAVDRSFDNFLLCDSSGLSEAIKKYVDYVRRPVSDNGIKEGPKCPKALGDLVESCVGAILLDSGFNLNKVWKIMTSFLDPIMKFSSSLQLSPVRDLRELCQSHNLELEFLPVPSKLTKRFSVEAKVSGNGVCETASATGQNKKEACRIASQLLFLKFKAQGWKAKSKTLEEVLESTSKMEPKLIGYDETPIDVTDTNTAKHIVVNADPYNNSNPEICPMQLTDEICSPCVKPFGQRLQSSAKGKLSQIFENRDCGSDSSGTARSRLYELCAAYCWKPPSFECCKKEGPDHLKQFTCKVTLEIEEAQNLILEFVGEPLSKKKDAAESAAEGALWYLQHEGFLPSIGN

SEQ ID NO: 296 - protein, 1598 aa, Glycine max
MPDGESSAVAGGQVSMEPSLSLSDQLQSLSLSQVKNHDDSVKKDPRKIARRYQLELCKKAMEENIIVYLGTGCGKTHIAVLLMHEMGDLIRKPQKNICVFLAPTVALVHQQAKVIADSTDFKVGTYCGSSKRLKHHQDWEQEMGQYEVLVMTPQILHHNLSHCFITMEMIALLIFDECHHAQVKSNHAYAVIMKVFYKSNSTKVPRIFGMTASPVVGKGASSEANLAKSINSLEHILDAKVYSVEDKELQSFVTTPVINIYHYVSTASGETSLHLKIEEIKRQCIATLGRSIEDHQKRMNTKKLLNRMHDNVIFGLQNLGIWGALQASHILLSGDHSERHELVEADGNSSDDSLCDKYLAQAAELFTSQCMIGDRVTDLSSVEILKEPFFSAKLLRLIGILSNFRLQKNMKCIIFVNRIVTARSLSYILQKLKLLRQWRSDFLVGVHAGLKSMSRKTMNIIVDKFRSGELNLLVATKVGEEGLDIQTCCLVIRFDLPETVASFIQSRGRARMPQSEYAFLVDSGNKKEIDVIDGFKEDEYRMNMEVTFRTSKETYIIPEERIFRIDSSGASVSSGYSISLLHQYCSKLPHDEYFDPKPSFHYLDDSGGISCHITLPSNAPINQILGTPQLSMEASKREACLKAIEELYNLGALSDCLLPKQDDAEPEVQVSGSSDEDECEDAISRGKLHEMLVPSAFGQSWINEDNIVRLNSYYIKFCPYPEDRVYKEFGLFMMTCLPMEAEKLELDLHLAHGRSVMTMFVPFGVVEFNKDEIKMAENFQEMFLKIILDRLEFISEFVDLGMSAESHSGTSTFYLLLPVVLQEYGNAMEVDWKIVKRCLCSPIFRHPADTMDKKVFPLDIHLQLANGYRSVRNVENSLVYAPHKKNFYFVTNVNYEKNGYSPHNDSGTSSYVDYFIEKFSIHLKCPKQPLLHVKPVSNLHNLLHNRKREDAEPQELDEYLIYLPPELCELKVIGFSKDIGSSISLLPSIMHRLGNLLVAIELKHMLSSSFPEAAEISAIRVLEALTTEKCQERFSLERLEVLGDAFLKFAVARHFFLMHDSLHEGDLTKRRSNAVNNSNLFKLAIKRNLQVYICDQTFDPTQFYALGRPCPRVCSNETEESIHFCLNSVMQQGKATETRCSKNHHWLHRKTIADVVEALVGAFLVDSGFKAAIAFLSWIGIQVDFEASQVVDICIASASYSPLSSEVDIPSLEGKLGHHFFHKGLLLQAFVHPSYNKLGGGCYQRLEFLGDAVLDYLITSYLFSAYPKLKPGQLTDLRSLSVNNKAFACLAVDRSFDNFLLCDSSGLSEAIKKYVDYVRRPVSDNGIKEGPKCPKALGDLVESCVGAILLDSGFNLNKVWKIMTSFLDPIMKFSSSLQLSPVRDLRELCQSHNLELEFLPVPSKLTKRFSVEAKVSGNGVCETASATGQNKKEACRIASQLLFLKFKAQGWKAKSKTLEEVLESTSKMEPKLIGYDETPIDVTDTNTAKHIVVNADPYNNSNPEICPMQLTDEICSPCVKPFGQRLQSSAKGKLSQIFENRDCGSDSSGTGTARSRLYELCAAYCWKPPSFECCKKEGPDHLKQVHRTFTCICLLFHF

SEQ ID NO: 297 - protein, 1584 aa, Glycine max
MPDGESSAVAGGQVSMEPSLSLSDQLQSLSLSQVKNHDDSVKKDPRKIARRYQLELCKKAMEENIIVYLGTGCGKTHIAVLLMHEMGDLIRKPQKNICVFLAPTVALVHQQAKVIADSTDFKVGTYCGSSKRLKHHQDWEQEMGQYEVLVMTPQILHHNLSHCFITMEMIALLIFDECHHAQVKSNHAYAVIMKVFYKSNSTKVPRIFGMTASPVVGKGASSEANLAKSINSLEHILDAKVYSVEDKELQSFVTTPVINIYHYVSTASGETSLHLKIEEIKRQCIATLGRSIEDHQKRMNTKKLLNRMHDNVIFGLQNLGIWGALQASHILLSGDHSERHELVEADGNSSDDSLCDKYLAQAAELFTSQCMIGDRVTDLSSVEILKEPFFSAKLLRLIGILSNFRLQKNMKCIIFVNRIVTARSLSYILQKLKLLRQWRSDFLVGVHAGLKSMSRKTMNIIVDKFRSGELNLLVATKVGEEGLDIQTCCLVIRFDLPETVASFIQSRGRARMPQSEYAFLVDSGNKKEIDVIDGFKEDEYRMNMEVTFRTSKETYIIPEERIFRIDSSGASVSSGYSISLLHQYCSKLPHDEYFDPKPSFHYLDDSGGISCHITLPSNAPINQILGTPQLSMEASKREACLKAIEELYNLGALSDCLLPKQDDAEPEVQVSGSSDEDECEDAISRGKLHEMLVPSAFGQSWINEDNIVRLNSYYIKFCPYPEDRVYKEFGLFMMTCLPMEAEKLELDLHLAHGRSVMTMFVPFGVVEFNKDEIKMAENFQEMFLKIILDRLEFISEFVDLGMSAESHSGTSTFYLLLPVVLQEYGNAMEVDWKIVKRCLCSPIFRHPADTMDKKVFPLDIHLQLANGYRSVRNVENSLVYAPHKKNFYFVTNVNYEKNGYSPHNDSGTSSYVDYFIEKFSIHLKCPKQPLLHVKPVSNLHNLLHNRKREDAEPQELDEYLIYLPPELCELKVIGFSKDIGSSISLLPSIMHRLGNLLVAIELKHMLSSSFPEAAEISAIRVLEALTTEKCQERFSLERLEVLGDAFLKFAVARHFFLMHDSLHEGDLTKRRSNAVNNSNLFKLAIKRNLQVYICDQTFDPTQFYALGRPCPRVCSNETEESIHFCLNSVMQQGKATETRCSKNHHWLHRKTIADVVEALVGAFLVDSGFKAAIAFLSWIGIQVDFEASQVVDICIASASYSPLSSEVDIPSLEGKLGHHFFHKGLLLQAFVHPSYNKLGGGCYQRLEFLGDAVLDYLITSYLFSAYPKLKPGQLTDLRSLSVNNKAFACLAVDRSFDNFLLCDSSGLSEAIKKYVDYVRRPVSDNGIKEGPKCPKALGDLVESCVGAILLDSGFNLNKVWKIMTSFLDPIMKFSSSLQLSPVRDLRELCQSHNLELEFLPVPSKLTKRFSVEAKVSGNGVCETASATGQNKKEACRIASQLLFLKFKAQGWKAKSKTLEEVLESTSKMEPKLIGYDETPIDVTDTNTAKHIVVNADPYNNSNPEICPMQLTDEICSPCVKPFGQRLQSSAKGKLSQIFENRDCGSDSSGTGTARSRLYELCAAYCWKPPSFECCKKEGPDHLKQ

SEQ ID NO: 298 - protein, 961 aa, Glycine max
MSPRGGSKQQPDSRRQAPPSAAAAVPSPPGRGRGRGRGESSVPAPSLVNAPSAPPPASTIGVPSGAAPFRAALPPPAVESLTSAVEKQLTMQPSAPSSSKAVRFKERPGFGLAGEKIKVRANHFQVQVAEQDLFHYDVSINPEITSKKVSRDVMTLLVQAHREKILGNRIPAYDGGKSLFTAGSLPFESKDFVIVLKDDDEPGSSSSSSPTRKKREREYRVTIRLASRTDIHHLSQFLRRRQLDCPYETIQALDVVLRATPSERFVVVGRSFFSPSLGKPGSLGSGTEYWRGYYQSLRPTQMGLSLNINVSARAFYEPIPVIDFIESHFRANPSRPLPDQDRIKLKRVLRGVKVEVTHGKNLRRYKITGVTKEQLRKLMFTLDDNRTKSSVVQYFHEKYNIVLKHTLLPALQAGSDIKPIFLPMELCQIVAGQRYTKRLNEEQVTNLLRASCQRPRDRENSIRQVVRQSNFSTDKFVSHFGIQVREDPALLDARVLPAPMLKYHDTGRESSVEPKMGQWNMIDKKMFNAGVVEHWTCLNFSGKINREFPSAFCHKLARMCSNKGMRFNSKPLLPITSAQSSQIESALVNLHKQSITRLANQGRLQLLIIILPDFEGSYEKIKRICETELGIVSQCCQPRHVCQMKPQYLENVALKINVKVGGSNTVLNDAIARIIPRVSDRPTLILGADVTHPQPGEDSSPSIAAVVASMDWPYVTRYRGVVSAQTHREEIIQDLYNTCEDPVKGKVHSGIIRELLRAFRLSTNQKPERIIFYRDGVSEGQFSQVLLYEMDAIRRACASLQEGYLPRVTFVVVQKRHHTRLFPVDHGSHDQTNKSGNIMPGTVVDTHICHPREFDFYLNSHAGMQGTSRPTHYHVLFDENNFTADGLQMFTNNLCYTYARCTRSVSIVPPVYYAHLAAFRARCYIEVATSDSGSASGGRAANCEVRLPSVKENVKDVMFFC

SEQ ID NO: 299 - protein, 890 aa, Glycine max
MSRRGGSKQQPDSRHPAPPSAAPSPAGRGRGRGRGEFSSVPAPSPVNAPSAPPPASTIGVPSGAAPVRAASPSPAAESLTSAVEKQLTLQPSAPSSTKAVRFSERPGFGLVGKKIKVRANHFQVKVAEQDLFHYDVSINPEINSKKVCRDVMTLLVQAHREKFLGNRIPAYDGRKSLFTAGPLPFESKDFVIVLKDEDEPGSSSSAPARKKREREFRVTIRFASRTDLHHLGQFLRRRQLDCPYETIQALDVVLRATPSERFDVVGRSFFSPFLGKPGTLGSGTEYWRGYYQSLRPTQMGLSLNIDVSARAFYEAIPVIDFIQIHFRLNPSKPLPDQDRIKLKRALRGIKVEVNHGKNLRRYKITGVTKEPLRELMFTLDDKRTKSSVVQYFHEKYNIVLKHTHLPALQAGSDSKPIFLPVELCQIVAGQRYTKRLNEEQVTNLLRATCQRPHDRENSIKQVVKQSNFSTDKFVCHFGIQVKEEPALLDARVLPPPMLKYHGTGRESCVQPRTGQWNMIDKKMVNGGAVQHWTCLNFSGKTNRGLAASFCQELAKMCNNKGMRFNLDPLLPITSVHSSQVESALGNVHKQAIAKLANEGRLELLIIILPDLKGSYGKIKRICETELGIVSQCCLPRHVYQMKPQYLENVALKINVKVGGSNTVLNDAFTRRIPHVSDLPTIILGADVTHPQPGEDYSPSIAAVVASMDWPYVTKYRGVVSAQTHREEIIQDLYNTHEDPVRGKTHSGIIRELLRAFRLSTKTKPERIIFYRDGVSEGQFSQVLLYEMDAIRRACASLQEDYMPRVTFVVVQKRHHTRLFPAEHGSRDQTDKSGNILPGTVVDTQICHPREFDFYLNSHAGIQGTSRPTHYHVLFDEITSLLTSCKCLQIT

SEQ ID NO: 300 - DNA, 2769 bp, Brassica rapa
atggatgctactaccggtaatggagctgagctcgagtcagcaaatgggagtggggtttccgacgcgctgcctcctcctccaccggtcataccgcccaacgtggagcctgtgagggttcaaaccgaagttgctgtgaagaagaacctaagagtacctatggctcgtccaggctttggatcaaagggtcaaaagattcagcttttgactaatcacttcggagtcaaagttgcaaatcttcagggattcttctaccactacagtgtggcgctcttctatgatgatgggcgtcctgttgagcagaaaggggttggaaggaaagttcttgacaaggttcatgagacgtaccactcggatcttgatggcaagcagttcgcctacgatggagagaagacgctgttcacttttggagctttgcccagcaacaaaatggatttctccgtggtccttgaggaagtttcttccgccaggactaatggaaacgcaagccccaatgggaatgaagagccaagtgacggtgatagaaaaagacttcgtcagcctaaccgttccaagagcttcagagtcgagatcagttacgcagcaaaaattcctctccaagctcttgctaacgctatgcgtgggcaagaatccgagaattcacaggaggcaataagggtgttggacatcatccttcgacagcatgctgctagacaaggttgcctgcttgtgagacagtccttcttccacaatgacccgagcaactgtgaacctgttggtggtaacatcttgggatgtagagggttccattcgagtttccggacaacacaaggtggaatgtcactcaacatggatgttacaaccactatgataatcaagcctggtccgcttgttgactttgtcattgctaaccaaggtgcaaaggatccctttacggttgactggtctaaggctaaaagaacacttaagaatctgaggattaaagtcagcccctcaaaccaggagtacaggatcactggcatgagtgacaagccttgcagggaacaaacgtttgagtatagaccaaggaacgcacccaagaatgagaatggagagtctgaaaccgttgaaataacggtgtatgactacttcctcagagaacggaacctagagttgcagtactctgcggatttgccttgcgtcaatgttgggaggccaaagcgacccacctatatcccccttgagcactgcacattgattccccttcagaggtacacaaaggctctgaacactttccaaagatctgccctggttgagaaatctagacagaagccgcaagagaggatgaatgttctgtcaaaggcgctgaaagtgagcaactatgacgctgaacctctcctgcgttcatgtgggatttctatcagctccaactttactcaggtggagggtcgtgttctgccagctcccaagctgaaaatgggacgtggagatgaactgtttccgagaaatggtcgctggaatttcaacaacaagcaatttgtggagccaaccaagattgataaatgggctgtagcaaatttctctgctcgctgtaacgtgcgtcaactggttgatgatctaatccgaattggtggaatgaaaggaattgaaattgctgccccatttgatgtgtttgaggagggtcatcagtttcgccgtgctcctcctatgattcgtgtagagaagatgtttgaagagatccagtctaagctccctggtgctcctcagttccttctgtgtctcctccccgaaaggaagaactgcgacatctacgggccatggaagaagaaaaacttaactgaatacggcatcgttacacaatgcatggctccggtgaggcagcctaatgatcagtatcttaccaactgtcttctgaagatcaatgcaaagcttggtggcctcaactccatgttgagtgtggagcgtactccagcctttaccgtcatttccaaggttccaaccatcatccttgggatggatgtttcacatggatctcctggacagtctgatgttccctccattgctgcggtggtgagttcaaggcagtggcctctagtctcgaaatacagagcatctgtacgcacacagccttcaaaggctgagatgattgagtcactcgtcaagaaaaatggaactgaagatgatggcataatcaaggagttgctggtagatttctacaccagctcgggtaagagaaagccagagcatatcataatcttcagggatggtgttagtgaatctcagttcaaccaggttctgaacattgagctcgatcagatcattgaggcctgcaagcttctagatgagaactggaacccaaagttcctcttgttggtggctcagaagaatcaccacaccaagtttttccagccaaactctcctgacaacgttcccccagggactatcatcgacaacaaaatctgccacccaaagaacaacgacttctatctctgtgcccacgctgggatgattggaacaacacgtcctacgcattaccacgtcctgtatgatgagattcatttctcacctgatgagcttcaagagctcgtccactcgctctcttacgtgtaccaaagaagcacaaccgccatctctgttgttgcaccgatctgctatgcgcacttggcagctgctcagctaggaacgttcatgaagtttgaagatcagtctgagacgtcctcgagccatggtggcgtgacagctccaggaccagtctctgttgcgcagctccctaaactcaaagacaacgtcgccaactccatgttcttctgttag

SEQ ID NO: 301 - DNA, 1842 bp, Brassica rapa
atgaggaaccacaactacaactccttgaacaacgtgaacgcacctggaaatgatgcatggtctgattcggatcgtggctcaagttctttccggacgcgaagcccaggtgctgttctgcctctctccgcttcatttgggagaatgactactctagtcccgttccccgaccttaatctcatgccggattccccaccccccgaaacctcctccaacacaagaatcaccgccgtacggtcattggctccgacactaggtgttgagagaaactccctcgcgatcttccccgtaccgggtcacgaaaaccaccatgctcgggtggttcaaacactccaccaagacaaccaggaacttgcccggtatgtcttcaaacggactcgaatgatctacgactctctcctgcttcagctcactgtggagtacggacctaatcccaagccagccgtcaatgtcagggcttcgaaactgatggaagaacgtgggttgtggctgaacaagggccaacacttggtaggtccagtccccggggttgagatcggggacatattcttttaccgcaaggagctttgcatgtacggcttacaccgccattcacaagccgggattgaatacacaaaggctaggctaagctcctttggcgtgcctatagcaaccagcatcatcgcatcgggtggctacgaggacaatgaggacagaggagatgtactggtttattcgggccagggtggtcgggacaaatccgggcagcaacgtcagcaccagaagctagtacgtgggaatcttgctatggtacaaagcatgcaactcggtgtcccggtacgcgtcattcgcgggtttcactacaaaaacgaagtcagctcgaatgtgttcatctacgacggcctgtacaggatcgtaaagtccagccgtgttagaaagtcagggtttgatatcttcaagtttacacttgttagaatccaaggacagcccgagatgggcagtgcaagactgatgcgtgcgctaacacttagaaacacaccattggcttggatgcctgctgggtatataagctttaacctttatggtaaaaacgagggtgtcccggtgtatctgtataacgacattgactatgaccgctcaccgctgaactatggctacatctcgcaatctgacattagtagtgtgattcttgctcaaggagggaacaacggtggatgcgattgtaacctctcatgcactgatgattgtatatgcgtgaggaagaatggtggtgagcttccttacagcccttatggatctttgttgagagggaaacacgttattttcgaatgcggggttacttgcaagtgcacttctggttgcacgaaccgtgtcgcgcaaagggggttgatgaagaagatggaagttttccgaaccagggaagctggttggggtgttaggtcgctggatttgattcacgcgggcgagtttatctgtgagtatgctggtactgtggtcacaaaagagctaggggagattatgtcgatgaacggggatggtctggtctatccgggacggtttgctgcaaactggaagttgtggggtgatttatctgatgtttacccgggtaatgtcccgccgagttatcctactattccgccagttgattatgcaattgacgtgtcgagggtgagaagcgtggctgctttcattcgtcacagcagagaaccaaatgtgatggctcagtttgtgttccatgaccataacaacttgaagtttcctcgcgtcatgctttttgcactggagaacatctcaccgttaaccgagctaagcctggactatgtggtggtcgatgaagtggacgagagactcgccatccgtggctga

SEQ ID NO: 302 - DNA, 1896 bp, Brassica rapa
atgacttctcacatacctatggtgatccctaagccggagccagtcactgattcctccccacaaactccgattccaccctcatccttcttcaatttcaacaccaccaccacccaatctcccctcgaacctaacttgtacaccgagttcaccaacgtcgccgagactttccgctccgccttcgcacagcgcctcaaacgccacgaggacgtcacggtcctcgattccctaaccggcgccatcgtacccgttcccgaggagcaagatccggatccggatccggtcagttacccttcgcagtccctcaagccgcgtaaacctcaggagcgctcgtctgagctcgtgaggatcaccgacgtcggccccgagggagagaggcagtttcgggaagtggtgaggaagacgaggatgatctacgattctctccggatcttcttgatcctcgaggagactcgtgaagtgctcggaaggaggagaggcaggcccgatagcaaagccgcctcgatgatgaaagagcgtttcctttggcttaatcgggacaaacgcatcgtcggttcgatccccggcgtccaggtcggagacatcttcttcttcaggctcgagctctgcgtcatggggttgcacggacagacgcaggctgggattgactatctcattggctcccgcagctctaacggagagccgatcgccaccagcgtgattgtctcaggtggttatgaggatgatgatgatcaaggggatgtgattatctacacgggacatggagggcaggacaagctcgggaggcaggctgagcatcagaagctcgaaggtgggaatctcgctatggagaggagtatgtactacgggattgaagtgagagtggttagaggttttaagtacgagaacgctgtttctagcaaggtttatgtttatgatgggctgtttaggatcgttgattcttggttcgatgtggggaagtccgggttcggtgtttttaaatttaggctggagaggatcggagggcaggtggagatggggacgtcggtgttgaagttcgccaagacgcttaaaaccaaccctttgtctgtgagaccgagcgggtacatcagcttcgatatctccaacaggaaggagaacgctcctgtgtatttgttcaacgacgttgatgacgatcaggagccgttgtactatgagtatctcgccactacttctttccctcgcggcatattgggtggtagtaatggtgataatgcgagtggatgcgaatgtgtcagcggttgtagcagcggctgcatctgcgagaggaagaacggtggcgagtttgcttatgattacaacgggaatttgataagaatgaggccgttggtgcatgagtgtggaccggggtgtaagtgccctccgacgtgtcggaaccgcgtgacgcagaaggggttgaggagtagactcgaggtgtttaggtcggtggagactggctggggggttcggtgtttggatatattgcacgctggcgcttttatttgcgagtatgttggggttgctttgacgagggagcaagccaacattctgacaatgaacggcgatactttggtgtaccctgctcggttttgttctgataggtggaaagattggggagatttgtctcaggtgtttccggattacgagcggccttcgtatcgtcagatccctcctgttgattatgcgatggatgtttcaaagttgaggaacgttgcttgttacataagccacagtaatgattcgaatgtgattgtacagatggtactgcatgatcacaacaatctgatgttccctcgtgttatgcttttcgctgctgagaacattccgcccatgactgagctcagccttgattatggagtctctgatgatgaatggagccccaagctcgccatttgtaattaa

SEQ ID NO: 303 - DNA, 1914 bp, Brassica rapa
atgaatactctattcgcatttccagaacttaaccgcacgccctccgccgccgcgatgatgtcactgcctccgagactacgcgtcaaggccgaaccaattgacgatcctacccctcctcctactcctactcctactccaactcccaccctcaccccctccgatatctacgccgagtactacagcctctgcgaacgtgtcgcttccgcattggctaaccgtaacaacgacctcctcgcgatcgtccccgtaccggaagaaaaacctcccctcctccactctcctccaccgatcccaaccccgccgggatcaggagacaaccgcgctctctcctcccgcctcccgccgaggttccagagaccgcatgagctcgctcgcgtcgccgacctagggcgcgaagaccatatacaccgcagagagatcctgaaacggactcgagcgatctacgactccctccgcctccatataatcgcggaggcgatgcggcttcccggtcggcggcgtaaacctagagccgattacaacgcctcgactctgatgagggagcgcggactgtggctgaaccaggacaaacacgtcgtgggttcgattcctggggttgagattggagacatgtttctttaccgtttggagctctgtgtgattggcttacacggccagccgcaagctgggattgattttctaacggctaaccgaagctcaaacggtgagccgatagctactagcattatcgtctcgggtggttacgaggacgatgaggatacaggggaggttcttgtttactcagggcacggtgggcaggacaaagtccacaggcagtgtcagcaccagaggctggaaagtgggaaccttgcgatggagaggagtatgcattacggtatcgaagttagggtgattcgtgggtttaagtatgataatgtggttagctcgaaggtgtatgtgtacgatgggttgtataggattgtacagtattggtttgatgttggcaggtcagggtttggtgtgtttaagtttaagttagttaggattgaagggcagggtgagatggggagtaggaggatgaagtttgctcaagcgcttaggactaagccgttggcggttaggcctaatgggtatataacgtttaacctttctggtggtaaggagaatgttccggtttatctgtataacgacattgattttgatcgtgaaccggaggggtatgactacattgtgagatctgcgattccctgtgtgatttctgctcgcggaggggctaacaggggctgtgattgtaactattcgtgtggtagtgattgtttttgcgcgaggaggaatggtggtgagcttccttatgatgacgacgggactctgttgaagggtaagcctgtggtgtttgagtgtggggttttgtgtgggtgtggtccgagctgtaagaaccgtgtgactcagaaggggttgagtaagacgctggaggttttcaggtccagggaaacaggttggggtgttaggacattggatttcattcaagccggggccttcatctgtgagtatgctggggtggttctcacaagagagcaagccaagattgtatcaatgagtggggatcctcttctctatccgggtcggttcacagagaaatggagtagtttgggtgatttatctcaagtgtacccggagtatgttcagccgagttatccttctctgccgccggttgattttgggatggatgtgtcgaagtttagaaacgtggcttcttacattagtcacagcaaagaatcaaatgtgatggcgcagtttgtattgcatgaccatagtaacttgatgtaccctcgggtcatgctttttgccctggagaatatctctccgttgaccgagctaagcctggactatgggttggacgataagctggaagagcggctcgccatctgtaattga

SEQ ID NO: 304 - DNA, 1821 bp, Brassica rapa
atgggttcaaggggtgataagggaaagaacgtctcttcgggtggctctaacgcagaggttgaacagctggcgaaaggcttttcggagacgaagctgggtccttcacaagacggtggaggagagtgggaggtcatctccaaacggaacaagaacaagcctggaaacgctgctgggaagtcatgggccacagctcctaaccagaaccctcctagagcgtggggtggtcagcagcagcagcaagggaggggtaacaatggctacgggagaggaaggggaacgcaagtctctactggtcgcggagctgggcgtggacaagcgatgaacagagggtatggtggtgcttcggctcctgttgctcgacctcctctggaaggaggatggaattggcagtctagaccgggtgctgctcagcagactgtgactgaggaggttccagaggtggatgatgatgatgtttctgagggagaggaggaggatgattgcgatgctttggatgattctgatgaagacctggcgagtgatgactacgactccgatgtgagccagcaaagccatgggacgaggaagcagaacaagtggtttaagaagtttttcgacagcttggatagcttgtctatcgagcagataaacgagccgcagaggcagtggcattgccctgcttgccagaacgggcctggtgctattgactggtacaaccttcagccgcttctagctcacgcgaggacaaagggagctagacgtgttaagctccacagggaactggctgaggttctggacagggatctgcagatgaggggagcatctgtcattccctgcggtgaaatttacgggcagtggaagggtttgggtgaggaggaaaaggatcatgagattgtctggccgccaatggttgtcattatgaatactaaactggacaaggacgagaatgacaagtggctaggcatgggcaacccggagctgctggagtactttaacgagtatcctgctattagagcacgccattcgtatggtccgcaggggcatcgtgggatgagtgttctgatctttgagagtacagcgactggctactttgaggctgaccgcctacacagggacttagctcaaaaggggttagatagagacgcatgggagcgtcgccgcagttggttttctggaggtgttcgccagctttatggcttccttgcgatcaagcgagatttggatttattcaatcagcattgtcaagggaaagcaaggctcaagtacgagatgaaatcgtaccaggagtatgttgtgaaggagctgaggcagatagctgaagacaatcagcagctgaactggttcaagaacaagctgacgaaacagaacaagcacgccaaggtgcttgaggaatcgctgggaattttgagcgagaagctgcgtaaaactgcagaagataaccgtatcgtgagacagagaacaaagatgcagcatgagcagaacagagaagagatggattcacaagacaagtttttcaaagagtccatcaagcagatacatgagaaaagagacgcaaaggaagaaaacttcgagatgctgcagcagcaggagcgtgctaaagttgttgatttgcgaaagagggctgaggaggtatccagcttcatagagtgtcaagagaaagagatgaaagagtttgtggaggagagggagaagctgatagaagagcaggagaagaagatggcagagttgaagaaaaagtatttcgaggagatgcttgatctagagaggggatttgataaggcgttggagcagctcatgagcaagcacggcctccacgatgcagatgacacagatgactactag

SEQ ID NO: 305 - DNA, 3597 bp, Brassica rapa
atggggtcagagggaaacatgaagaactcggttgtgacacaagtaagcattggtgggtttggggagtcaactactgcaaaagagcttacagattaccttgaagaagaagtaggactcgtttggcgatgcagattaaaaacttcttggactcctcctggttcttatcctgatttcgagatcactgacacttcaaacatccccacatttgatggttacaagagagtggagcctcatgcgtttgtccatttcgcggtccctgagtcagcaggtcgtgcaatggatgctgcggggcagtccaagctcatcctcgacggccagcctttgaaagtcagcttggggcctaagaacccgtacacacttaaccagagaagaagaacgacaacaccttataagctgactggtgtttcgattgagattgggaccttgattgcccgggatgagtttcttgtttcttggagagctgaaggggttgatttcctcgtagacccttttgacaacacctgcagattttgcttcacaaagagcactgccttctcgttgaaggacacaatgatgtatgctgtgatcaactgtgattataagttggagttattggtgagagacatacgaacagtaaggcagtatagaactctggatggctatgtgctactcttgcagctggcttcatcaccccgtgtctggtacagaactgctgatgatgatatatatgaaactgtccctgtcgatctcttggatgatgatgacccttggatccgtaccactgattttacccaagctggggccattgggcggtgcctttcatatcgagtgctcatctctcctcggtatgagaagaaaatgaatacagcattggactatctaagggcgcggagagtgcaagaggaacgtgtgaggtggcctcccaggattcgtgatgagccctgttttggggagcctattacagatcatttcttctgcattcaccacagggaaggaatctcctttgagatcatgttcctggtaaatgcggtgctgcacagaggggtttttaaccagtttcacttgactgagcgcttctttgatcttcttagaaaccaacccaaggatgtcaacattgcttctctcaagcatctctgtacctataaacgacctgtttttgatgcgtacaagaggctgaagcttgttcaggaatggattcagaaaaatccaaagcttttagggagtcacgtacagttggatgatatctctgagatcagaaggctagcgatcactccaaccagagcgtattgcctacccccagaagttgagctctccaacagggtactcaggaaatacaaagcattgtctgatagatttttgcgcgtaactttcatggacgaaagcatgcagaccatgaactcaaatgttctttcttactttgttgctccgattgtgaaggaccttacatcaagctctttctctcagaagacccacgttttcaaaagagtgaagaccatattaaccgatgggtttaaactatgtggtagaagatacagttttctagcattctcggccaatcagctcagagaccgctctgcatggtttttcgctgaagacgggaaaacaagagtgtcggatataaagacatggatggggaagttcaaagacaagaatgtggcaaaatgcgctgctaggatgggcctgtgcttctcctccacatacgccactgtggatgtcatgcctcacgaggttgacaccgagcttccagaaatagagagaaatgggtatactttctctgatggaattggtacaatcacacctgatctcgcgttagaaataatggagaaacttaagttggattcgcactgcagcccttgtgcttaccagatacgttacgccggtttcaaaggagttgttgctcgttggccatcaaaagatgatggaatccggttagcccttcgacacagtatggataagttccactctaagcatacaatcctggagatctgttcatggaccaggtttcaacctgggttcttaaaccggcagataattaccctcttatctgtgcttggtgttccagacgaaatattctgggatatgcaggaaactatgctctgtaaactgaaccgcatccttgatgacacagatgtcgcatttgaagttcttacagcatcatgtgctgaacagggaaacactgcagctatcatgctaagtgcaggtttcaaaccaaaaactgagccacatctacggggaatgctgtcttcagtcaggattgcacagctctggggtctcagagaaaaatctcgtatttttgttacgtcaggaaggtggctaatgggttgcttagacgaagcaggggtacttgaacagggccaatgctttatccaagtctcgaaaccgtctatagaaaattgtttctccaaacatgggtctcgttttaaggagacgaagacagatctgcaagtagtgaaaggttatgtagccattgctaagaatccttgtcttcacccaggggatataaggattctagaagctgttgatgtacccgagctgcatcacatgtatgactgcctactttttcctcagaaaggcgagaggccacatacaaacgaagcttctggcagtgaccttgatggcgacctgtactttgtggcttgggatcagagactcatccctcccagcagaacaagctttcccgcgatgcaatatactgcagctgaagaatcgagtaagggccgtcctgtcaaccaccaggacataatagagttctttgtcaaaaacatggcgaatgagaatctgggtacaatatgccatgcacacgtcgttcatgctgataggagtgagtatggagccagggacgaagaatgtttgctactggcggaactagctgcaacagcagtcgatttcccaaagacagggaagctggtgacaatgcctttccacctgaaaccgaaactctaccctgatttcatgggaaaagaagagtaccagacttacaggtcggagaagatcttgggtcggctttacagacgtgtaaaagaggtttacgacgaagatgcagaagcttcctcagaagaaaactcagacccgagtgacatcccttatgacactgatctcgaagtaccaggatttgaagattttgtccctgaggcatggggtcacaaatgtagctatgacgggcagctaattggtcttctcgggcaatacaaggtgcaaaaagaggaagagattgtgacgggtcacatctggtccatgcctaaatacacaagtagcaaacaaggcgagctgaaagaaagactgaagcattcttataactccctgaagaaagagctgaggaaagtattcgaggaaacaaaaccggagcacgagagtctcagcgaagaagaaaagaacgtcatgtatgagaaaaaagcttcagcttggtatcatgtcacttaccatcccgagtgggtgaagaagtctacagagctgcaagaacctggtgagtcgtctggtcatgcggtgatgctgagctttgcttggatcgcagctgattatcttgcgagaattaaagtccggtcaggggaaatgggaatgaaaatggactcggccaaacctgttgatgctttggctaagtatctttctcaacgtctctaa

SEQ ID NO: 306 - DNA, 3369 bp, Brassica rapa
atggtctcagagataacgcgatcgacggttaaactcaccaacgtccctcaaaccatagttgccgacgaactcctccgcttcctagagctccacctcggcgcagactccgtattcgccctcgaaatcccgacctctcgcgataactggaagccacgcgacttcgccctcgtgcagttcacctccctcgaagccaagtctcgcgctcagcacctctcctcccagaccaagctcctcttcaagtcccgtaacctaagagtctccgaagcctacgacgacatcgtccctcgccccgtagatcccaggagaaggctcgacggcgtcgttttgaccgctgggtttccggaatcggaggaagggaggttttgtgccctacagaaatgggaaggcgtgaggtgttgggttatagaggagaagcggagagttgagttttgggtttgggaatgtggtgattgttacaagtgtgaggttaggtttgaggatgtcgttgaaactgttccctcctgcgtcgatggcgtggatgagatcaatgcgtttcttctcaggctgaaatatggaccgaagatatacaaacaagtatcaggacctcatatcgccacaaagttcaaatctggccgctacagtttctgcaaggacgattttgatttcatgtggattcgctcaactgatttctctggtctaaagtcaatcggtacatccacttgcttctgtttagaagtggataacgcctcagcgatgtctgacatcttctcaagcttaccttactacagagaagacactttgagcctaaccctggtgaatgggaatacatttgcctctgctaatcaaattgtccccctcttgaatgcagctaatctggggatagagattccatatgagatccttttccaactcaattcgctggttcatgcgcagaaaatcagtcttttcgcggcttcaaatatgggattgatcagcatcctctgtggtttgagcttggaaaccgcattggtggtcctcaagaaactgcaccagcaaagatctatttgttatgatcctatctcatttgtcaaggctcagtcgcagtatgtggttaagaagacggcgcattcccctgcatcagcctataagagattgactgagcagaacataatgagttgtcagagagcctatgttacgccttcaaagatttatctgctgggtccagagcttgagactgccaattacgttgtgaagaactttgcggagcatgcctcggatttcatgagaattacttttgtggaagaagattggagcaagattccagcgaatgcgctttctgtgaactccaaggaaggctatttcgtgaaaccctttagaaccaacatctatcacagggtgttgtcaatccttggagaagggatcaccgtcgggcctaaaaagtttgagttcttggctttctcagcgagccagctgcgaggaaattctgtctggatgtttgcttctaacgagaaagtgaaagctgaagatataagagaatggatgggttgttttcgtaagatccgaagcatttcgaaatgtgctgctaggatgggccagttgttcagtgcttctcggcagacacttaatgtccgtgcgcaagatgttgagcagattcctgacatagaagtgactactgatggtgctgactactgcttctccgacggcatagggaaaatttcgttggcatttgctaagcaagttgcacagaagtgtggactgagccatatcccttcagcgtttcaaattcgatatggtggctacaaaggcgtgattgccgttgaccgcagttccttcagaaagctgtctctgcgtgatagtatgctaaagttcgattcaaacaacaggatgctcaacgtgaccaggtggacagagtcgatgccttgcttcttaaaccgggagatcatttgccttttgtcgactctcggaatagaagatgcggtgtttgaggcgatgcaagcggggcatctatctatactggggaacatgcttgaagaccgccatgcggcactgaacgttctgcagaaattgagcggagaaagttccaagaatcttctagttaagatgctgctacaaggatacgcaccgagttcagagccttacctctcaatgatgcttcgtgtgcaccacgagagccagctttctgagctaaagagtaggtgcaggatacttgtaccgaaaggacgtatcttgataggttgcatggatgaaatgggtatactggagtatggccaagtgtacgttcgtgtaacactgactaaagcggaattggaatctcgcgagcagagctacttccgcaagattgatgaggaaacatctgtggtggttgggaaagtggttgtgacgaaaaacccatgccttcaccccggagacatcagagttcttgacgcaatatatgaggtcaattttgaacaaaagggttttctcgattgcatcgtctttcctcagaagggagaaaggccacatccaaatgaatgttctggtggtgatctcgatggagaccagttttttgttagctgggatgagaagcttataccgagccaaatggaccctccaatggactacgctggaagcagacctcgtataatggatcatgatgtcaccttggaggaaatccacaaatttttcgttgattatatgataagcgacacactgggggtgatctcaactgcacatttggttcacgcagaccgtgacccggagagagcccggagccagagatgcatagagttagcgaaccttcactctagagccgttgatttcgcgaaaaccggagctccagccgagatgccttacgccttaaagcccagagagttccctgatttcctggaacggttcgagaaaccaatgtacatctctgggtccgtgtttgggaagctctaccgtgctgtgaaaagcactttagcacagagaaagccagaagacgctgagagcgaggacaagaagaagatggcggcttatgactcgacgcttgaagaagctggctttgacaactttatagagacggccaaagctcacagagacatgtacgccgagaagctgagctcgttgatgaactactacggagctgctaacgaagaagagattctcacggggattttgagaaccaaggagatgtatctgcagagagataaccggaggtatggtgatatgaaggataggattacgttgtcggttaaggatttgcagagagaggctatgggatggtttgagaagagctgcgaggatgaacagcagaggaagaagctagcatcggcttggtactatgtaacatacaacccgagctattgcgatgagaagccgagattcttgagctttccgtggatcgtaggcgacgttttgctggggataaaggctgaaagtgcggagagatag

SEQ ID NO: 307 - DNA, 3510 bp, Brassica rapa
atgactgatatagacattgaagagattgaggccgccggggaagtcgatttacgcgacctaggggatccttttctccagagcttctgcaagaaagctgcgacgtccttcttcgacgagtacggcctcgtcagccaccagctcaactcctacaacttcttcatcgagcacggtcttcagagcgtgtttgagtcctccggtgagatgctcgttgagccgtcctttgatcctacgaagaacaaggaccatgagtggagatacgcgacggtgaagttcggagaagtcagcgtggataagcctaccttgtactctgatgataaggagcttgtgtttctcccgtggcacgctaggcttcagaacatgacctactctgccaggatgaaagttaatgtcgatgttgaggtgttcgttaagaaagttgttaaaagagacaagttcaagacgggacaagacgaatacgtcgagaagcagatattgtctaagaaaacgcaggacatcccaattggtaggatacctgtgatggtgaagtctgtgctttgcaacacaacggagaaagggaagcatgtggaaagctacagaaagggggagtgtgcatttgaccagggtggatactttgtgataaaaggagctgagaaggtctttattgctcaagaacagatgtgcacaaagagactttggatttctaattcaccatggaccgtctcctacaggtccgaaaccaaaaggaatcgtttcattgtgcgtctatcagagaatcagaaagctgaagactttaagagaaaagagaaagtactgacagtgtacttcctgtcaactgagatcccagtctgggtcctgttctttgcgctgggtgttgcgtcagacaaagaggctgtagatctaattgctttcgatggtggtgatgcaagtattaccaacagcgtcgtagcttcgatccaggaagctgattcggtttgcgaagattttcgccatgggaggaatgctctggcatatgttgaacagcagataaaaggcacaaaattcccacctggtgagagtgtggatgaatgcctaagtctgtacctgtttccaggcctcaagagtttgaagcagaaagcacgtttcctgggctacatggtgaaatgcctttttagcgcatatgctgggaaaagaaagtgtgagaacagagacaactttaggaacaagaggatcgaactagctggagagctgctggaaagggaactaagggtgcatttggcgcatgctagaagaacaatgaccaaagccatgcagagacacctcacgggggatggcgatctgaagcctatcgagcactacttggatgcttccattataacaaatggacttagtagagccttctccactggagcatggtgtcatcctttcaggaagatggaaagggtttcaggtgttgtcgctaatctgggtcgtgcaaatccactccagagtttgattgatctgcggagaacgcggcaacaggtcctgtataccggcaaagttggagatgctagatatccgcatccctctcactggggcagagtatgctttttgtcaaccccagatggcgaaaattgtggtcttgtgaagaacctgtctctccttggacttgtcagcactcaaattatggagcctgtggtggaaaaactcttcgatagtggaatggaagagctggtggacgataccagtacaccactgagcgggaagcacaaggttctcctcaatggagactgggttggagtatgttcagattctgactactttgttgcggagttaaaaagcaggaggcgtcaaagtgaattacctcgtcagatggaaattaagctagataaagatgacaaggaggtacggatttttactgacgctggcagacttctccgtcccctcatggttgtggaaaatctccacaagttgaagcaaagtaaaccatcgaagtacacctttgagcatcttcttgaccaagggattctcgagctgatcgggattgaggaagaagaagactgtaccacagcatggggaaccaagcagcttctgaaacagcagaagagttacactcactgcgaactggatttgtccttcctgttgggtgtgagctgtgcgattgtgccgtttgcgaatcatgatcatggtaggagagttctctaccagtcccagaagcattgccagcaagccattgggttctcctcaacgaaccctaacatccgctgtgataccctgtcccagcagctgttctatccccagaagccacttttcaagacaatggcgtcagagtgtcttcagaaggatgtgttgttcaatggtcagaacgcaattgttgctgtgaatgttcatctcgggttcaaccaggaggactccattgtgatgaacaaggcttcgctggaacgtggtatgttccgttcagaacagatcaggagctataaagctgatgttgacagtaaagactcggagaagaggaaaaagatggacgaggttgttcagtttggaaagacacacagcaagattggcagagtagacagcctagatgatgacgggttcccctttgttggtgctaatatgcacagtggtgatattgtcattggcagatgcaccgagtctgggactgatcacagcgtgaaactgaagcacactgagagagggatagtgcagaaggtggttctatcatccaatgacgatgggaagaattatgctactgtttctctgagacaggttcgttctccatgtcttggagataaattttccagtatgcatggccagaagggtgttttaggctatatagaggagcaggagaattttgctttcacgaatcaaggcatagttcctgacatcgtgatcaacccgcatgcattcccttctcggcaaacaccgggccaactcttggaggctgctctgtccaaaggaatagcttgtcctatgcaaaagaagaagggcaagtctgatgcatactccaaagtgacacgccatgccactcctttctccactcccagtgtcgatgacataaccgaccagcttcacagggctggcttttcaagatcgggaaacgaaagggtctacaatggaagaacaggagagatgatgcgttcactcatcttcatggggccaaatttctaccagagactcatccacatgtcggaggacaaagtcaagttcaggaacaccggaccagttcacccactcacgcgccagccagttgcagacagaaagaggttcggtggaatcaagttcggagagatggagcgagactgcctgattgctcacggtgcatcagcgaacctgcacgagcgtctgttcactctgagtgactcttcacagatgcacatctgcaggaactgtaaaagcgcagcgaacgtgatagagagggtggcgagcagtggaagaaggatcagaggaccgtattgcaggctgtgcgagtctccggactatgtggtgatggtgaacgtgccgtatggagctaagcttctgtatcaggagctgttcagtatgggcatctgtctcaacttcgaaaccaacctctgctga

SEQ ID NO: 308 - DNA, 1437 bp, Brassica rapa
atgcctatgagctcgtgggtttgccattttcacatctccaagaaagttctgaagcagaaacaactggatgtcgaatctgttgtctcttcattaaacaagcagtatgcaaacaggaagaaagagctgaagcttgatgtaattgatttggagatacaaagcacaaaccactgttcttgggatgataagtcaatggaagatgatagattctgcatcacagttactgttcttgaagcctccacacacggttctttggaacttgatgctattcgacttgtcttgatcccttttcttctcgactctccggtgaaaggctacggagagattaaaaaggtggagatcttatgggctgacagaccaaaagcgccgaaaaggaacaagaaacatatggcgggtgagcttttcgtgaaggttacaatgcatggagttcgtggcaaaaagaacatctggagcgctcttcttgaaacctgtcttcccattatggatatgatcgattggacaagaagccatcctgataatatccgacaatgctgctcggtttatggaattgacgctggacgtagcatcttcctagcggatttggagtctgctgtggctgatactggtaaggggatgctgcgagaacatctgcttcttgtagcggattgtctctccgttacgggagagtttgtggcattaaaccccaaaggttggagtaaacaaagacaggctgaatccactcctgcaccttttactcaagcttgcttctcgagcccaagtcaatgctttctcaaagctgctaaggaaggtgttacagacgagcttcaaggatctatcgacgcattagcttgggggaaagttccttctttcgggactggagatcagttcgaaatcatcatctccccaaaggatcatgggtttagtagtacaccagtaaaagtgtatgactttctgagtagtacagcaacgcttccaaagagaaaggcaagctccttgcccaaatcagacaacttcacggtccagccgttccccttactcgatactgctctctccaaagcagtgaagacactcgatgggaaaggactcaccaggtcgcagctcagaacgatctttacatgggacgacattgaaaagctttcccggtcactgaaacgtattctctacaattacgagatcgatgctacgttgaatgagagggatgaaagacttttgatgatggctcttctctttcaccccaacagagatgagaagctaggaccaggcttccaaggaatcaaggtggctaattctaagcatgggaatgctcgttgcttcgaggtggtgagaacagacggaacaacagaagatttctcttaccataagtgtgtgttgggagcgacagagatcattgcccctaagagagttaacttctacaaggccaagtaccttagaaacggtacggtgcaggccggtgctatctaa

SEQ ID NO: 309 - DNA, 4332 bp, Brassica rapa
atggaggaaaaatgcgaggagcttgaggtgcccatggggactctaaagtcaataagctttagcatttcgaataacaaagaccgaaaaaacatgtctgtcatggaggttgaagcagcgaatcaagtgactgattcccggttagggctcccaaatcgggatgatatatgcaaatcatgtggcagcaaagatagaaaagtttgtgaagggcattttggggttataaacctcaggtacccggtgattaacccgcatttacttaaggaggtagctacattgttgaacaagttctgccctggatgtaaatacacgaagaaaaaacagtctcagtctcagtcaaatacagattaccctctaatgaagttcagggtaacaacaaaagaagcctttaggcgatctggaatcgtttgtgaagtgagtgaagacaatgtgttgaagctcagtaaacggggactatcagcattacctccagattattgggattttatgcctaaagacccaaatatcgacgaaagctgtttgaaaccaagcaggcggattctaactcacgcacaggtttatgcactgttgagtgggattgatgagagggtgatcaggaaggagatccccatgttcgactctcttcctctggcatcttttccagttacaccaaacggtcatcgtgtatccgagatggtcactcagttcaccgggcctcgactagtttttgatgaacggactcgtatctacaagaaactagttggctttgaaggaaatggtcttgagttgagttcacgtgtgatggaatgcatgcaatactcaagactcttttcggaaaacgtgtctccgagtcaagaatccgcgaacccttaccagaagaagtcagatactcccgagctacgcggtctaaggttcatgaaagatgtgcttctcggcaaaagaagcgaccacacgttccgcacagtggttgtcggcgacccttctctcaagctcaacgagatcggcatacctcggagtatcgcagagaggcttcaagtatccgagaatctcaacgactggaacagagatcgtctcgtcacttcctgtttccacaagctcctcgagaaaggagagactcacgtgaggagaggaggtcgcttagttggtatcagagccatcgacgatctccaaacgggagacagcttcttacgcacgttaaaggatggagacacggtgctgatgaacagacctccttccattcatcagcactcgctcatcgcaatgtctgttaaagtcctccccactacctccgttgtctctttaaaccccatctgttgcttaccctttcgtggtgacttcgatggagactgtcttcacgggtacgttcctcagtctatccaagccaaggctgagctcgaggagcttgtggctttggataagcagcttgttaacagacagaacggtcgtaacttgctttcgttaggacaggacagcttgacggctgcgtatctggttaacgtcgagacgaactgttttctgaaccgagctgagatgcagcagcttcaaatgtattgcccctttgagcttcctcggcctgcgatcatccgaggttcgtctacgagcagtgagccgcaatggacggggaagcagctgtttgggatgcttttccctcccgggttcgagtacgcttaccctctgaataatgtggttgtaaccaacggggagcttttgtcttcttccgatgggtctggttggttgcgtgacggagaaggaaacttcatccagggtttgatgaagcacgataaagagaaagttcttgatataatcttctcggctcaagagatgctctctcagtggttactgaatcgaggactgagtgtttctttatctgatttgtacttcgcatctgataaacactctcggagaaacttgacggaggagattagttacggcttgcaagaagctgagcaagtctgcaacaagcagcagctcatggtcgagtcccgcagagacttcctcgcggtcaacggagaagaagatacggtcgtcgctgatgatttggagctgttctgctacgagagacagagatcagctaccttaagcaagctcgcggttagtgccttcaaggacgcgtatagagacgtccaggctctggcgtatagatacggagaccagtcgaacgcgtttctcgtcatgtccaaagctggtagcaaagggaacatggggaagctcgctcagcacagtatgtgcattggtcttcagaactcttctgttgcgttgtcctttgggttcccacgtaagctgacttgcgcctcgtggaacgaccccaacagcccgcttcgaggcgcaaggggagaagaccgaacggctcatgagtcttttgttccctttggtgtcgttgagagttcgtttctgacgggtctgaatcctttggagtcttttgttcattccgtgacgagccgagacagctccttcagcggtaatgctgatcttcccgggacgcttagcaggaagctgatgttctttatgagggatatatacgctgcttacgacgggacggtgaggaactcgtttggtaaccatttggttcagtttcgttatgagagtagtgatgatgcagaagaggacatgactggtgaagcagttggatcactttctgcttgtgcgatcaccgaggctgcttacagcgctcttgaccagcccattagccttcttgagacttcgcctcttctgaatcttaagaatgtgttggagtgtgggtcgaagaaaggtctgaaagaacagacaatgtctctgtacttgtctgaaacactttctaagaaaaagcacgggttcgaatacggggcactggacatcaagaggcacttggagaaactgtgtttctcagagattgtttcaacattctctccgaggactaacacaaggatgcctatgagctcgtgggtttgccattttcatatctccaagaaagtactgaaacagaaccagctggacctcgaatctgttgtctcttcattaaacaagcagtatgcgaacaggaagaaagaactgaagcttgatgtaatagatttagatatacaaagcaaaaaccactgctcttgggatgataaggcaatggaagatgatagagtctgcatcacagttactgttctcgaagcctccaggcacgattctttggagcttgatgctattcgccttgtcttgatcccttttcttctcgactctcctgtcaaaggctaccgagagattaaaaaggtggatatcttatgggttgacagaccaaaagctccccagaggaacaagaaaggcttggcgggtgagcttttcttgaaggttacaatgcatggagttcgtggcaaaaggagcttctggagcgctcttctcgaaacctgtcttcccattatggatatgatcgattggacaagaagccatcctgataatatccgacagtgctgctctgtttacggaatagacgctggacgtagcatcttcctagcggatttggagtctgctgtgtcggatacgggcaaggcgatgctgcgggaacatctgcttcttgtagctgattccctctcagtcaccggagagtttgtggcgctaaaccccaaaggctggagtagacaaagacaggccgagtctactcctgctcctttcgctcaagcgtgcttctcgagcccaagtcagtgctttctcaaagcagctaaggaaggtgtcacagacgagcttgaaggatctatcgacgcattggcttggggcaaagttccttcttttgggactggagatcagttcgagatcatcatctcccctaagaatcatgggtttagtacaccggtggtagacgtgtatggctttctcagtaggacggccacgcttccaaagagaaaggctgtccgtgcaacaagctcctccttgcccaaatcagacgagttcacggtccagccattccccgtgctcgacacggctctctcgaaagcagtcaagacactcgatgggaaaggactcaccaggtcgcagctcagaatgatctttacatggaacgacatggaaaagctttctcggtcgctgaagcgcattctctacaattacgagattgatgctacgttgaatgagttggacgggagacttctgatgatggctcttctcttccatcccaacagagatgagaagataggaccaggcttcaaaggaatcaaggtggctaattctaagcacgggaatgctcgttgctttgaggtggtgagaacagacggaacaactgaagatttctcttaccacaagtgtgtgttgggagcaacagagatcattgcccctaagagggttaacttctacaaggcgaagtaccttagaaacggtacggtgcagcccggtgctatctga

SEQ ID NO: 310 - DNA, 6180 bp, Brassica rapa
atggaggaagcatcttcatcagatattctagaagcagagattgttggaatctcattcgctcttgctactcatcgtcagatccgtctagcatccattagtgacgctgggatcaaccatgctagccaactctctaacgcattcttggggttacctctggagtttggtaaatgtgaagcttgcggtgccactgagcctgataaatgtgaaggtcattttgggtatatacatctgccagtgcctatataccatcccgctcatgttagtgagttgaaacagatgctgagccttctctgcttgaagtgtctcaagataaagaagattaagagcacaagttctgggcttgcggagcgcttactaggcgtctgttgtgaggaagcttcgaacatcacaattaaagataaatcatcagatggtgcctcatatcttcaactgaagctcccatctagaacaagacttcaggagggcttctggaatttcctggaaagatacggttaccgctatggaagcgaccatacccggcccctgctagcaagagaggtaaaggaaattttaagacggattcctgaagagacaagaaagaagctcacagcaaagggacatattcctcaagaaggatacatcttagagtatcttccagtcccgcctaactgtctgtcagtgccagaagtttctgatggttccaactccatgtcagtggatccgtctagaatcgagctaaaagacgttctcaggaaagtggtagcgatcaacaactctaggtctggtgagacgaactttgagtcgcatagagctgaagccaatgaaatgtttagagtggtggatacctatcttcaggtgaggggtactgcaaagccaacaagaaacattgacatgagattcggggtgtccaagatctcggacagttcctcctcaaaagcttggacagaaaagatgagaacacttttcattcggaaaggttcaggcttctcttctcgcagcgtcatcactggagatgccttcaggaatgtgaatgaggtggggatccctatggaaattgcacatcggatcacatttgaggagagagttagcgtccacaacattggatatctacaagagttggtggacaacaagatgtgcttaagctatacccaaggttctactacctattctctgagggacggttccaaggggcatacagtccttaaacccgggcagattgtgcatcgcagggtcatggatggagatgttgtgtttatcaaccgtcctcccacaacacataagcattctctgcaagcacttcgagtgtatgttcatgaagacaacacggtgaagatcaatcccctgatgtgtagccctctcagtgctgattttgatggtgattgtgtccatctgttctacccccagtctctcacagctaaggcagaggtactggagctcttttcagtggataagcaacttcgcagctcacatactgggcagctgattctgcagctgggtttggattctttgctgtctctgagggttatgatggagcaggtgtttttggacaaagcatctgctcaacagttagctatgtatggctctcgatctctcccaccaccagctgtagtgaagtccagtaaatctggcccggcttggacatttttccagatattgcagcttgcctttcctgagcgtcttagttgcagaggggacgggttcatagttggtggaagtgatttgctgtcctttgattttggggttgatgcgttggcgtctataatcaatggaattgtaaccgcaatcatggtggagaagggtccaaaggaagcactggcattctttgattcactgcagccgctactgatggaacatctagatcctcagggatttagtttaagtctggaagacttgtccatgtctagggaagacatgggagttattcacaatctcatcgtccgggagatttctcctatggtgtctaggttgaggttatcgtatgaggacgaactccaactagagaacagcatccagaaagtgaaggaagtggctgctaatttcatgctgaagtcgtattcgatgaggaacttgatcgacatcaagagcaactcagcaataaacaagctggtgcagcagattggcttcctgggtcttcagctttcagacaagaagaagttgtacacgaagactctggtggaagacatggctcagttttataagaaaaagtatgtcagtacttcttcctctggagattttggaattgtgaagggctgcttttttcacggacttgatccttatgaagagatggctcattcagttgcggcaagggaggtaattgtccgctcttcaagggggttagctgagcctgggacgctcttcaagaatcttatggctgttctgcgagacatagtcatcaccaacgatggaactgtaagaaatacatgcagtaactccatcgtgcagttcaagtatgagctgagttctgacaatgagaatcaaggtttatttgaagcgggagaccctgttggagtattggcagctaccgccatgtcaaatcccgcctataaagcggtgcttgattcttccccaaatagcaactcttcatgggaactaatgaaggaagttctactctgcaaagtcaacttccagaacaccaccaatgatcggcgcgtgattctttatctgaatgaatgccgctgtgggaaaaagtactgccaggagaattctgcttacacagttaggaacaagctgaagaaagttagtctgaaagatactgcagtggagtttctagtcgaatacagaaagcaacaagcgatttcagaaatttttggaatggatatatgcctacatggccatattcatcttaataagacattgttggaagggtggaacatcagcatgcaggacatacttcagaggtgcgaggatgcaatcaactcactagtccaaaaaaagaagaagaaagctgaggactttaagaaaatgaatttgtctgtcagtgaatgctgctctttccgaggtccaggctcgagcaaagattctgatatgccgtgcttgatgttttcctcctacaatgccactgatcctgatctggaaagaactctggatgttctctgcaatacaatatacccagttctgctcgaaacagtgatcaaaggtgatccacggattgcctcagcaaatataatctggaatagtccagaaacgacaacctggatccggagtcgtcatgcatcccgccgaggggaatgggtattggatgtcaccgttgaaaaatctgatgtcaagcaaagtggtgatgcatggagggttgtgattgactcatgtctttcagttcttcatctaatagacacaaaacggtcgatcccatattccataaagcaagttcaagagctgcttggtttgtcctgcgcctttgagcaagctgttcagcgtctctcagcttcagtgagaaaggtctccaaaggagttctgaaagaacatatcattctcgtggcaaacaacatgacctgttcaggggatatgctaggtttcaattctggaggttacaaggctttgactcggtccttgaacatcaaagctccattcacagaagcaactcttattgcgccaaggaaatgtttcgagaaagcagctgagaaatgccataaagattctctatcaacagtagttggatcttgttcttggggaaaacgcgtggatgttggtacaggttcacagtttgagcttctatggaacaaaaaagagactggtctggagaatgatgatgaaactgatgtattcagctttctccagatggtaagatccaccaaaactgcagatgcatacgtttcttcccctggttttgatgtcacagaggaagaaatggctgaatgggctgagtctcctgagcgagactctgctcttggagagcccaagtttgatgacagtgctgagtttcaaaatctacttgatgaaggcaaggcatcggaatccaagtgggacaacggttctctttgggagaatggttgcagtagtggctcagaatggggagtctcgaaaaacgcaggtggtgaggagaacacgcagtctggttggggaaaggctgcaaacattgagaaggaagatgcttcgtctggttggaacagtaaaaaggatgctcaagaagctaccaatacagattcatggggcgcttggggatcaaagacaaaagatgatgctgaaaatgcaacaccgaactggggaacaaaaccagctcaaaatgattctgttgtcatagaaaacggcgagccttcttctgacgtttggggacccaaagctgtttcagacaaaccttggggtaaaaagaactctgaaactgagccagctcctgctgcatggggtaaaacgaactctgaaagtgaatcagctgctgctgcttggggctctactaacaaaaagaacacgggaactgaatcagacgctgctggttggggctctactaacaaaaagaacccggaaactgaatcagatgctggtgcttggggttctggggccaaaaacaaagaaacagaaccagctcctgctgcatggggttcctggggcaaaaagagctcagaagctgtatcaggtggtgcggattggggtaataggggcaaacgggtttctgaaactgaatcaggtgctggtggttgggcttcccggaacccgagcttggaaactcagtcaggtggtgctacttggggttccagggataaatctaaatttgaaactgaatcaggtggtgctgcttggggctcgcaggctaaaaataattttgagagtgagtcaggctcgggtgctgctgcttggggtaagaagaaaccagaaactgaatcaggtggtgctgcttggggttctcaggctaaaaacaaatctgagattgagtcaggctcaggtgccgctgcttggggtacttgggacaagaagaaatcagaaaccgaatcaggtggtggtgcttggggttctcaggctaaaaagaactctgaaactgagtcaggcgcaggtgcttctacttggggtgcttgggacaagaagaaaccagaaactgaatcaggtggtgatggtgctgcttggggttctcaggccaaaaataattctgaaactgagtcaggctcaggtgctgctgcttggggtaagaagaaaccagaaactgaatcaggtggtggtgctgcttggggttctcaggccaaaaagaactctgaaagtcaattaggtgctgctaattggggttctaaggacacaaacaattcggaaaatggatcagattctgctgcttggggtaaaaagaagaattcagaagctgaaccaacttctgttgcttggggttcttggggacagccaagcccccctgcttcagacaaggatgcccaagaagatgatggaaacccgtgggtatcattgaaggcgaccaacagcggagagaaggaagggaatgagacaagtcagtggggagttccaaacaagagatatccatctgctggctcacagtcacagggtggtggtggcggcgcagattggaagaggaaccgtcctcctaggacccctggatctgagagtattatgggtccaatgttcacagcaacaagacagcgcgtagacatgttcacctctgaggagcaagagcttctctccgatgtcgatccagtcatgagaagactcaggaaaataatgcatcagtccgggtacactgatggagaaccaatctcggatgaagacaagacatatgtactggagcagattttgaactaccatccagagaaagatgctaagcttggtcccggtcttgatttcatcacggttgataagcacacaacgttcacagagtccaggtgcttctttgttgtgtcgactgatgggacaaaacaagacttttcatacaggaagtgcatcaacaactatctggtggagaagttcccaaacctagctgaagagttcatcgcaaagtacttcagaaagagggacaatgaaaacagagacaagaacagccaagaagccacaccacctggtgaaaaagagtctcagactcagcctattgataatggaagccaagactcccagcctcagtctattggtaatgaagatggcgacactcagcctcagtctcaagctgaagacactcagcctcagtctcaaattgaagacactcagcttcagtctcaagttgaagaatctcagcctattggtaatggaggtgaggactatcagacagagcctcagggttag

SEQ ID NO: 311 - DNA, 3099 bp, Brassica rapa
atggatgatggaaactcatggatgattgagtatgattcatcaatggtatcgatttcaatacatacagatgtggcctggtatcgacttgggaaaccatcaacgcaataccccccttggcgtgaacctactctgaaaacagcaagggttgcgaaaagcattatttccttgctggtgaagcaagcaagaatggctaggctttcatttcgagatgtcatcaaaaaagtttccgagttccaaaagaacgataataaagcttacatttcttctgatccctcagctgtggagagatatttggtcctccatgggcaagttattttgcagatttttgcaaaacaccctataaaggaactcaaaaagtgtgcatttattactggtcttgcaagtaaaatggaggaaatacaccacacaaaatgggcaatcaagaagaggaggaaaatattgccaacgaaacccaagaataaaatattgccaaagaaaccgaagagcaaactaaggataggtaagggatatgtggcatccaagaggagtgctatgcaagcaacaaaaactcacctggttgatagaatttggggacagtattactcagaatatggggccattggtgcagaaaatggcaaggaaaaggttcaagaggagagaaaaaatgaagaagaagatgatgtagaggaaccttcggtcctggaaacaagatgggaaggtgatattctaggaagaacatctgctggtgagcctctttatcaacaagccctcgttggaggagaggtagtggctgtaggtggtgctgtcctcttggaagtcaatgaaacttcggtcatctactttgtggagtacatgttcgaaagttcagatcactgcaaaatgctacatggaagacacctagaaagaggatccgagactgttctagggaacactgctaacgagagggaactattcctgaccaatgcatgcatgactgttcagcttaaggacataaaaggaacagtcagttttgagattcgatcaaggccatggggacatcagtataggaaagagaacaacgctgctgataagcttgaccgagcaagagcagaagagagaaaagcacaacacttgccggctgaatatttctgcaaatgcttatattcacctgtgagagggggtttctttagtcttcaacccaacaacataagtagcggtacaggatcttgcagtccatgtaagatcagggaggaggaaaaggagcggtcaaaacccaagctgaatgcaacaatgaccgggtttttcttcaacggggttgactattgcatggaggattatgcatatgtcaaccctaaatttatatataaaccgaaaaaggataagaagtttgagaggaacgttgatttaaaatccttcgttgtgtgtcaactacttgaagtagttcttccaaaggtatcgtcattaaatggtttatttgaggttatagtgagaagattttataggcctgaagatacacctttagagaaggcatattcttcaaacatccaagaagtgtattacagtgaggacgtacatattctccctccaggggcttttgaaggcaaatgtgaagtaaggaagaaacatgatatgcccttacgcaatgattatctaacattagacaatatcttcttttgtgagatgcctgtccatatcaaaccgaagttctctaccattaaagacgacacacttctcagaaagcaaaaggggaagggaatagagggtgaaactgattatgatgagttacctaaagagatgcgtctggctacacttgatatcttttccggttgtggtggcctgtctaagggactggaacagtcaggtgtatctgaaacaaagtgggctattgagtatgaagagccagcagggcaggctttcaaacaaaaccatcctgagtcaacggtttttgttaacaactgcaatgtgattcttagggctataatggaaaaatgtggagataaagatgagtgtctctctactacagaggcaaatgaacttgcagctaaacttgatgaagaacagaagcttgctctgccactgcctggtcaagtggatttcatcagcggaggacctccatgccaaggattctctggtatgaacaggttccaggaaggctcatggagtaaagttcagcgtgaaatgatactagcattcttgtcctttgctgagtatttccggccaaggtattttcttctggagaacgtgaggaactttgtgtcattcaatggagggcagacatttaaactcactctggcttctcttcttgaaatgggttaccaggtgaggtttggagtgttggaggcaggtgcatatggagttgctcaatctcgcaaaagagcttttatttgggcagctgcaccaggagaagttcttccagaatggcctgagcctatgcatgtctttggtactccagagttgaaaataaaactatccaaaagatcacactatgctgctgttcgtagtactcaatatggtgcacctttccgctcaatcacagtgagagacaccattaacgatcttccacctataaaaaatggtgaatcagagaccaacagagagtatggagctgatccagtctcttggttccaaaagaagataagaggagacatgttagttctcactgatcatatatgcaaagagatggatgaaacaaacctcatccggtgtgaaaatataccaaagactccaggtgctgattggcgtgacctcaaaaacctcaaaaaaaaaaagattaagttatcaagtgggaagatggtagatatgattccagcctggctgagaaacaaagctaagactcacaacgggtggaaaggactctttgggagattagacatggaaggaagctttgcaacttccatcaccgatcctcggccaatgggtatggttggaatgtgcttccatcctgaacaagacaggattatttctgtccgtgaatgcgcccgatctcaggggtttccggatagctataagttcgtagggggaatactagacaagcataggcagattggaaatgcagtgcctccaccattggcttttgctctaggtcgtaagctcaaagaagccgtacttctcaagaaacctcctcttcaacagaaaccctaa

SEQ ID NO: 312 - DNA, 4587 bp, Brassica rapa
atggtgagaaacggaaccaaggctggggagcaaaagaagagacctctcccagagatcaaatcagactctgacggcgaagacctctccacgaggcacactaggccgaagcgcgccgcagcatgcaccaacttcaaggagaagtccgtccgcatctccgagaaatccacaaccgtcgaaaccaagcagcaccagactgtggaggacgaagttgtagctctacacttcacagcatctcctcagggcggcggcgacgagcctcgtcagaccaggaggctgactgatttcatcttgcacgacgagtacggagtcccgcagcctgtggcgatggttgagatcggtgacattttcgtcacgggcgttatcttgccttctggtgaatgcgatgataaggagaaagggaaaggcgtgaagtgtgatggctttggacgcgtggagaattggagtatctcggggtatgatgatggctacccggtggtttggttctcgacggagctggcggattatgactgtggtaagcctgctactagttacaagaagatgtatgactatttctatcagaaggcgtttgcttctgtggaggtttataagagagtggctaagtctgcgggtggggactctggtgttagtcttgatgagttgcttgtggcggtttcgaggtctatgagccttgaaagtaaatgcttttctactgatttcttggttattagaaatttccttatacggcaaggagagtttatatataaccagcttgctggtttggatgagacggcaaagaaagatgaagctagctttgcggagattcctgtgctcgttgctcttagagatgagaatagtagacttgacaatggtgctgttattcagatggaaggaagaccttctaacggggttttgaggattgatggagtttctgaagctgcgaagtgcgaggccttgacatctgatcaagaaatggttgacgaggatcaaagatatgctagaattatgcaagacgaagaggataggaaaactatgcagcggcctaaaagaaaaaacggcgcagctttggcttctaataaaggatatgtaaaaaccactgaggatgagattgctggtgattatcctctcccggcttattacaagaatttcaaagatgaagcagatgagcttatagttgctgatgactatgaggttaactacgaggacctgcctcgcaggatgctgcacaactgggcactgtacaactcggattcaaggttcatatccctggagcttctcccgatgaagccctgtgcggatattgatgtgacgatatttgggtctggtttgatggcagaggacggtgggttctggtttggtctagatgatcctgatacttctacctctggacagccaaagaaggatcttgaggggatgcccgtattcctcagtcaaataaaggaatggatgattgagtgggggtgttcaacaatctctatttcaatacgaacagatgtggcatggtatcgacttgggaagccgtcaaagcaatacgccccttggtttgaacctgttttgaaaacagctagggttacgataggcatttttggtctgctagaggagcaaactagaatgtctaagctctcatttgaagatgtcacgaaaagagtgtctgagttccagaagaacgataaagctttcatttcttctgatcgcttggctgttaacagatttctagtcggccatgggcaaattattttgcagatgttctcagaatttcctaaaaaggatatccagaggtgttcatttgttagtgatcttgcaaggaaaagggctgaaaggcacaacacaagatggaccatcaagaagaagaagattttgtttaaagtaaattgtaatccaagggcaggcatggcacctgtggtatccaagaggaaagctatgcaagcaacaacaactcgtctgatcaacagaatttggggagagttttactccaattactctccagaggaacccgtgcaggcagttggtgcagaaaacgaggaggaagaggttgaagaggagggtgaaattgaagaagatgacgcagaggaaactgttccagaacctgttgaggaggttgaaaagtctcatacccctttgaagaaaattcgaggcgtttctggtaaaacggaatcaagttggagtggcgagagtctaggaaaaacttctgctggtgagcctctctatcgacaagccctcgttggagaagaaattgtggctgtaggtggtgctgtcgtgttggaagatgatggaaacgaggtcatctattttgtggagtacatgtttgaaaaatcaaacaactgcaaaatgcttcatggaagactcttacagagaggatgtgacactgttctgggtaatgctgctaacgagagggaactattcctgaccaatgaatgcaagactgtatcgcttaaggagataaaaggaacggtcagttttgagattcgttcaaggccatgggggcatcagtttagaaaagagaacaccaccgcggacaagcttgaccgggcgagagcagaggaacgaaaaacgaaagacttgcctacggaatacttctgcaagagtttatattcgcctgagagagggggtttctttagccttccattaaatgatatgggctgtgcatctggaacctgcagttcatgtaggataagagaagatgaagagaagaagacagagatcaaactcaactcttcaaagacggggttttcgtgtaatggggttgactattccgttgatgattatgtctacgtaaagccagaagatatagatggatcgaaggaggctaatgggagatttaagtctggtcgtaacattggcttacgaccattcgttgtttgtcaaatactggagatcatcgtcctaaaagaatctagaaaggcttcctttgaggttaaagtgagaaggctttataggcctgaggatgtttctgacgaaaaggcctatgcgtcagatatccaagagttgtattacagcgaggacacagatgttctccaaccagaagctctagagggaagatgtgaagtaaggaagaaaattgatatgccctcacgccgtgagtatccaatatcagataatatcttcttctgtgaacagatctatgacccgtccaaaggttctctcaagcagttgcccgtcaatatcaagccgaagtacactactgttaaggacgaggcacttttaagaaagagaaaggggaaggggttagtgactgaaactgattctgtgactgacaagcctgaagaggtatctaaagagacgcgtcttgctacactagatattttcgctggttgtggtggactgtctcagggacttgaacaggcaggtgtctcggcaacaaagtgggcgatagagtatgaagagccagctgggaaggcttttagaaaaaaccatcccgaaacaacagtttttgttgacaactgcaatgtaattcttagggctataatggagaaatgtggagatcaggatgaatgtatctctactaaagaagctaatgaactcgctgagaaacttgatgaagaccagaaacgtacgctgccactgcccggccaagtggatttcatcaatggaggccctccatgccagggattctccggtatgaatcggttcaaccaaagctcttggagcaaagttcagtgtgaaatgatattggcattcttgtcatttgctgattatttccggccaagatactttctcctggagaacgtgaggacctttgtgtcattcaataaagggcagacgttccaacttactctggcttctcttctcgaaatgggttaccaggtgagatttgggatcttggaggcaggtgcatatggggtttcccaatctcgcaaaagagctttcatctgggcagctgcaccagatgaggttctccccgaatggcctgagccgatgcatgtctttggtgttcctgagttgaaaatctcgctgtctaaaggtgtacattacgctgctgttcgcagtactcaatacggtgcacctttccgcccaatcacagtgagagacacaattggcgatcttccatcagtagttaacggagaatccaacacgaagagagagtataaagctcaaccaatctcgtggtttcaaaaggagataagaggagacaatattgctctcactgatcacatctgcaaagagatgaacgaactaaacctcattagatgtaagaaaatcccaaagaggccaggggctgattggcgtgacctcccagaagaaaaggtgacgttatcaaaagggcaagtggtagatttgataccatggtgtctgccaaacactgcgaagcgacacaaccagtggaaaggactgtttgggagattagattgggaaggcaactttccaacatcaatcactgatcctcagccgatgggtaaggttgggatgtgcttccatcctgaccaagacaggattatcactgtccgtgaatgcgcccggtcacaggggtttccggacagctatgtgtttcaagggaacataatacacaagcataggcagattgggaatgcagtgcctccacctttggcctttgctcttggtcggaagctcaaagaagcggttcaactcaagaaggtcaccaaaacaaactag

SEQ ID NO: 313 - DNA, 4563 bp, Brassica rapa
atggtgagaaacggaagcaaggctgcgaagcagaagaagagatctcttccagagagcaaagagaccgaccacgacgatgatctctccacgaggaagacgaggccaaagcgagccgcagcatgcacaaacttcaaggagaaatccatccgtatctccgagaaatccgccaccgttgcagcaaagcaccatcagactgtggatgacgagattgtagctctacacttgacagcttcttctccccagagcggcggcggccacgagcctcaccaaaccaggagactgaccgatttcgttttacatgataccgacggagtttcgcaggctgtggagatggtggaacatgtcgacatgttcatcacaggtgtgatcttgcctactggtgaatgctctgacaaggagagagcaaaaggtgtgaggtgcgaagggttcggacgcgttgataactggagtatctccgggtatgaagatggctccccggtggtatgggtgacgacctctctggcagattacgaatgcgttaagcctgctaccacctacaagaaggtgtatgattatttcttccagaaggcgtatgcctcggtagaggtttacaagaaagtggccaactctgacttgatgagtcttgatgagttgcttgtggcggttgcgagggctatgagcctcgagactaagtgcttctctagcgattacttggccatcaaaaatttcgttatatcccaaggagagttcatatataaccagctcgccggtttagatgatacggccaagaaagatgatgcaagattcgttgagattcctgtactcgttgctctcagggatgctagtagtagtagcatacttgaatatgatgctggtcaaccttctaatggggttctgaggattgatggagctgcggagaggaaggccatgtcatctgatcaacacatggttgacgaggatgaaaaatttgctcgacttgtacaagacgaagagtatatgaaatccatgcaaaggccgaggaaaagcagcagctcagcttctgtttcaaagaacggatacataatgaccactgaagatgagatcgccaatgattatcctctcccagctcattacaagaactcccaagtagaaacagacgagcttttgttataccatgacgacgactacgaggttgacatcgatgacctgcctcgtaagatgcttcagaactgggcgctttacgacatcgattcacggttgatatccctggagcttctcccgatgaagacttgtgctgatatcgatgtgaccatctttggatccggtgtgatggcagatgatcaagggatctggattgatctagatgatcctgctacctctatgccgtcagaggaacatggtgggatacctatattcctcagtcaaataaaggaatggatgattgagtatggggtgtcaacggtctcggtttcgatacgaacagatgcggcctggtatcgacttgggaaaccgtcaaagcagtacgccccttggttcgaacctattctgaaaacagcgagggttgcggtcggcgtttttgctctgctggaggagcaaactagaatggctaagctttcgtttgaagatgtcgtaagaagagtgtgtgagttcgagagtaaccataaggcttacatttcgtctgaccgcgcggctgttgacagatacgtggttggccacgggcagataatcttgcagatgttttcggagtttcctaacaaggagatcagaaggtgtgcgtttattactgggctcgcgaataaaagggcggagaagcacaacacaagatggaccatcaagaagaagaagattttgctgaaagtgaatttgaaccgaagggcgggtgtggcacctgtctccaagaggaaggctatgcaagcgacaacaacgcgtctgatcaacagaatctggggggagttttactccatttactctccagaggagccgttgcaggcagttggtgcggaggaagaggctgaagaggatgaggaggaggacgaggaggaaaatgaagatgacgacgcagaggaaactgaacctgaagctgctgaggtcgaagaggctcatacgcttccaaagaaaattgtaggcaaatgtggaaaaatggaaacaagatgggatggtgagagtgtaggaagaacttctgctggtgagcctctctatcgacaagccctcctcgaaggggaaagagtggctgtaggtggtgctgtcatcgcggaagtcagcggaagtcaggccatctactttgtggagtacatgtttgaaagttcggatcactgcaaaatgctacatggaagacttttacaaagagggtccgagactgttctggagaatgctgctaacgagagggaactctttttgacgaacaaatgcatgactgtacagttcaaggacgtaaaaggaacagtctgtttcgagattcgaacgaggccatggggacatcagtttagaaaagaggacgccgttgcggataagcttgaccgggcaagagctgaagaacgaaaggcgaaagacttgcctacggagtacttctgcaagagtttgtattcgcctgagagaggaggcttctttagtcttccgctcagtgatatgggctgtgcttctggatcatgcacttcatgcagattaagagaggatgaagtgcagaggaaaaagatcaaactaaacgcttcaaagactggtttttcctcctatgggattgactactgcgctgatgattttgtctacgtatacccagactgtatcgatggatcgaagaaggctaatgggaagtttaagccagggcggaacatcggtttaagagcctttgttgtgtgccaacttgttgagatcattgtcccaaagaaatctagaaagggttcctttgaggttaatgtccgaaggttttataggcctgaagatgtatctgaacgaaaggcctatgcttcagatatccgagaggtgtattacagcgaggacacctttgttgtccaaccagaggctctaaagggaaaatgtgaagtaaggaagaagaaagatatgccctcttgtagtgagtttccaatatcggagaacattttcttttgtgaacaaatatacgacccatctaaaggttccgtcaagcagttgcccctcaatatcaaaccgaagtactctacagttaaggacgacgcacttttaagaaagaaaaaggggaagggagtagagagtgaaactgattctggtattgttgtcaagcctaatgagttacctaaagagatgcgtctggcgaccttggatatttttgctggttgtggtggcctgtctcaaggactggaacaagcaggtgtatctgcaacgaagtgggcgatcgagtatgaagggccagctggggaggcttttagaaaaaaccatcccgaaacaacagttattgttgataactgcaatgtgactcttagggctataatggagaaatgtggagatcaagatgagtgtatctctactacagaagctaatgaactcgctgctaaacttgatgagaaccagaagcgtactctgccactgcctggtcaagtggatttcatcaacggaggccctccatgtcagggattctctggtatgaaccggttcagccaaagcccatggagtaaaattcagtgtcaaatggtattagcattcttgtcttttgttgattatttccggccaagatactttctcctggagaacgtgaggaactttgtctcatatagtaaagggcagatgtttaaactcactctggcttctcttctcgaaatgggttaccaggtgagatttggggtgttggaggcaggtgcatatggggtttctcaatctcgcaaaagagcttttatatgggcagctgcaccggaagacgttcttcccgaatggcctgagccgatgcatgtctttaatgtttcacagctgaatatctcactatccaaaggtttacgctatgctgctgttcgtagtactcaacatggagcacctttccgtccaatcaccgtgagagacacaatcggcgatcttccacctgtagagaatggagaatccaatatagacaaagagtatgaaactgatccagtctcgtggttccaaaaggagataagaggaaacaagaatgttcccactgatcaccttagccaaacgatgaacgaacacaacctcatccgatgtaaaagaatcccgaagaggtcaggtgctgattggcgtgacctcccagatgaaaaggtgacgttatctactggactggtggtggatttgattccagggtgtctagcagcgaaacctggtaaaaaaaagcagtggaaaggactgtttgggaggttagattgggaaggcaactttccaacttgcgtcactaaacctggtcccatgggtatggttggtaagtgcttccatcctgaccaagacaggatcgtcactgtccgtgaatgcgcccgatctcaggggtttccggatagctatgagttcgaaggggacatagcacacaagcataggcagattgggaacgcagtgcctccccctttggcctttgctcttggtcgcaagctcaaagaagcagtacagctcaacaacttcgccaaaagtaattag

SEQ ID NO: 314 - DNA, 1920 bp, Brassica rapa
atggtgatgaagagcaacaatatgacagattatgaaaacaatctgtacaaaaagctcaagagcggaaagctcgaggtcagagtctcctaccgcactttcctctgtccttactgccccaagcagaaggttggtctctacatcgacatccttcagcacgcctctggagtcggtaacagcagctccaagaaacgaagtctcacggagaaggcttgccaccgtgctctcgccaagtaccttcgtaaagatctcgcggattacgctacggctacagtctctaggcgctcaaaggccttggcatcgttaactggcgatattcctctagcttatgatgatcagttcgagaaacttgtgtggccttggaaaggtattttggttaatataccaacaaagatgggacatgatggtctgtgttgtactggggagagtggaccacagcttaaggatgaactgatcagaagaggattcaaccctattagagtacgtaccgtgtccgtgtgggactgtttcggtcattcaggaaccaggatagttgagtttaacagacactggaatggacttaacgatgctttgctgttcaagaaggcttatcaagaagatggtcatggtaaaaaagattggctgagtagtggtggtggtgctgctgactcgagtctttacgcatggcttgccaatgctgatgattattatagggctaactatgtaggagagtacttgcggaagatgggtgacctcaaaagtgtttctaggtttgcagaagaagaggctaggaaagaccataagcttgtgcagcgtctgaacttaatctctgagaacatacagagtcagttgaggatgctagaggaaaaattctcaaagacttctattgcacttaagtgtgagactgaagaaaaagataagattctccatggttacaatcaagatctcacgggaagacaacaaagatcgactgatcatttcaacagaatctttgctgatcatgaaaagcaaaaggcgcagctggaatctcagatgaaggaacttcaaattagagaatctgttttggcgaaacgtgacgcagagaatgaaacacagaggaaaaacgtggcaaaagagcttgaacagagcgcagctaagtatagttacgttcaactagtagccgtggaacaacaaaaaaccagagagaaagttaagaaaatggctgttgatcacaagatgcaaaaggaaaagcttcgtgagagaatcactgcactggaaagagagcttggtcagaaacaagatcttgaacttgtggttgaacatctgaaacgacagttgagcgtgatgaggcacatggagttggacggtggtactgaaattgtgaacaaggtggagacctacctcagagaccttagtgagaaggaaggagagcttgcgcatgtaaacaaatttaatcaagatcttgtcgtacgggagcggaagaccaatgatgagcttcaagaagctcgaagagcactgatcagcaatttgagagacatgagatcgcatattggtgtaaggagaatgggggagcttgacaccaagcctttcatggaagcaatgagaagaaagtactgtcaagaagatctagaggattgggcagttgaaattatccagctctgggaagaatatctgaaggatccagattggcatcctttcaaacggataaagcttgatgctgcagaaactatagtggaagtgatagatgaggaggacgagaagttgagaacactgaagattgaactgggggatgatgcgtaccaagcagtggcaaatgcattgcaggagataaacgagtataacccgagtggaaggtatgtttcctcagagctgtggaactttagagaagagaggaaggctacgctggaggagggtgttacttgtttgctggagcaatggaatcaggcaaagcgtcataagccttaa

SEQ ID NO: 315 - DNA, 1626 bp, Brassica rapa
atggagaagcaggagttttcagttggagattcgtccggagagacaaagaaaagtgagtgtactgaagagaagtttgtgtggccatgggttggtcttgtagctaacatacaaacggaggttgataaaacaggtcggagagttggcagaagcggttcaacgttccgtgatgagctcatcgagaaggggtttgatccaacaagagtccaacccatctggaacttcaagggacactctggtttcgccttggtggagttcaccagagacattaaagggttcgagaacgccatgaacttcgagaggagttacaaatcagacggccatggcaagaaagattgggagaaaggtgttcacttgagagatgataagccctacggatgggtcgctagagaggaagactacaaccgaggtgggattgttggcaagaatgttaagaagaagagagacttgaaaactttatcacagcttcaagaagaggaggaaaggaaaatggttcagcttgttgaaagcatgtctcagtccattgagatgaagataataagcaagcaagagctcgaacacaaagtggatgagacttctcgtgttctggagagtgtggagttgcataactatcagctaaacgaaacgtacaaacaagaggttgagaagatgcacacgaacttgcaagggctgtatcagcagattctggcaggacatgacaagtctatgtctgacctggagacagagagagagaagctggagaatcgtgcgaggcagatctacattaacgaagctgagatggaaaaatccagactcgaaatagaaatgaatcaaaaggcgatgatggagcagaatgaagcgaacatggaagccatgaagcttgcagagaagcaccaggcaaagaaggagaagcttcacgagaagataatggaaatggaagcgaaactaaacgaaacacaagagctggagctggagatagagaagctgaaaggcagcaccaatgtgatgaagcatatggctgggagtgatggagatggggagttgatggagaagatggtcaagactcagatggagctagaggctagagaaacagctctacatgataagataatggctgtgacacaaaaagaacgtatggccaacgacgagtaccaggaggctaggaaagagatgattcagttctggaaggagaatgaggatttggtgagtggggaggagataagagtgaagacgatggggcacttagacacgaagccgtttgtggtagcagtgaagaagaaacttagatgttcagaagcaagggcagggctaaaagctatggagttgtgttcattttgggaaggacaaattggaaatgtgcattggcatccatttaaagtggatgaatctgatggaatcgcaaagctagtggttgataaaaacgatttgaagctggttaggctgaagagtgactacggtgaggagctttacaatgaggtggtgagagcgaaagtggagatagtggaatacaacccgagtggtggctatgtggtttcggagatgtggaaccttgagaagaaccgaaaggccacgatggaggaaggaacggatgtgatgttgaagatgaggaagaagctcgtggctatgaagaacaagcgaaagaggcgttga

SEQ ID NO: 316 - DNA, 1932 bp, Brassica rapa
atgggtagcacggtggttttaagctcagacgaagaagattcagacatgagcgaatctgaaatggaagcgcatgcagacaaaatctacccaactcttaaaagcggaaagctgaaagtgaaactctctccacaagctttcaagtgtccttactgtccaaacaagaagaaaccaagtttccagtacaaagatctcctccaacatgcttccggagttggtaacagcaactcagagaaaagaacctcaaaggacaaagctagccaccttgctcttgtcaagtacctccaacaagatctttctgactcagcagctgcagagccttcatctaagcgccaaaagaccggagaccctattcaagactgtgaccaggacgagaagcttgtgtgtccttggaaaggtgttgtggttaacattccaacaagaaagacacaagacggtcgatcggcgggtgagagcgggtccaagcttagagatgagtatattcaaagagggtttaaccctactagggttcgtcctttatggaatcactgggggttttcaggaacagctattgtggatttcaacagagactggaacggactccacaacgctcttctgtttgacaaggcttatcaagtagatggtcatgggaagaaagactggctgaagaaacatgggcctcctaagacagggctttacgcgtggatagctcgtgctgatgattacaacggaagtactctcataggagaagacttgaggaagaagggtgatctcaagactatagctgaggttacggaagaggaggcgaggaaacagcagaagctcgtgcagaatctgacgcagcttgtggaggagaagaagaaaggggtgaaggagtttgaggagctgtgttcagtgaagtccaaggaacttaaagagaggttggaagagaaggagaagagtttgcaaaagcataacagagagctgaatgctatacaggagagaacaatgggtcatgttaacaagatctttgctgatcatgagaggttgaagatgaagctggagttggagaagaagaaacttgaactcaagggtattgagttggctaagcgggaagcacacaatgaaaccgagagaaagaatctctctgaagatctacaacagaatgcctccaagaatagctctcttgaactagcttccatggaacaacaaaaggcggatgaagaagttaaaaagctggctgaatatcaaaggaggcaaaaggaggagctccatgagaaaatcataagactagaaagacagagagatcagaaacaagccatcgagctagagatcgagcagttgaaaggagagctaaacgtgaagaagcacatgggatcagacggcgacgctgagattgtgaaagaagtggaagaaatctataaaggtttaacggagaaagaagaagaactagcagacctggacaagtttaaccaaacgcttatactcagagagcgcagaaccaacgacgagcttcaagaagctcgtaaagagttggttaacattatgaaagagtggaagttaagtatcggtgtaaagagaatgggagagctggtgacgaaaccgttcatggatgcactgcagcagaagtattgtcagcaagacgtggaggacagagctattgacgttctccagctctgggaagactatctcaaagaccctgattggcatccattcaagcggatcaagctcgaaaatcaagaaagagaagtggaagtgattgatgagagggacgagaagctgaaggagctaaaggacgatttaggagatggtccttataatgcggtaacgagagcattgttggagataaacgagtataacccaagtggaaggtacattacaacagagctgtggaacttaaaagaagacaggaaggctacacttgaagaaggtgtcacttgtttgcttgatcaatgggacaagtcgaaacgccgctga

SEQ ID NO: 317 - DNA, 1938 bp, Brassica rapa
atggggagcacggtgatcttgagctcagacgaagaagattcagacattagtgattccgaaatggaagagtatggagacaagatctacctatctctcaaaagcggaaagctcaaggtcaaactgtctcctcattctttcacgtgtccttactgtccgaacaagaagaaaccgagtttccagtacaaagatctgctccaacatgcttctggagttggtaatagcaattccgacaaaagaaccgcaaaggagaaagcaagccaccttgctcttgccaaatacctccaacaagatcttgctgatgattcacaagctgagccttcttccaagcgaagaaaaactggtgatcctattcaagattgtgaccaggatgagaagctcgtatgcccttggaaaggtgttgtggttaacattccaactacaaagacagaaaatggtcgaaccgcgggtgagagcgggtctaagctaagagatgagtacattcaaagagggtttaatcccaccagggttcgtactttatggaaccactgggggttttctggaacagcgattgtggagttcaacaaagactggaatggacttcacaatgctcttctcttcgacaaggcttatcttgtagatggtcatggtaagaaagactggttgagaaaagatggtcctcccaagtcaggtctttacgcgtggatcgcacgtgctgatgattacaacgggaataacatcattggagaagacttgaggaagaaaggtgatctcaaaactatagctgaggttacggaagaagaggcgaggaagcagcagaagcttgtgcagaatctgacgcagcttgtggaggagaagaagaaaggagtcaaggaaattgaggagcttcattcagcgaagtcaaaggagcttaaggagaagttggaagagaaggagaagagtctgcagaagcacaacagcgagctgaatgctatacaggagaggacaatgggtcatgttaacaagatctttgctgatcacgagaggttaaagatgcagttggagttggagaagaagaaactggagatcaaaggtgttgagctggcgaagagggaagctcacaatgaaaccgagaggaagaacttggctgaagatctgcaagagaatgcttccaagaatagttctcttgagctagcctccatggaacaacaaaaggcggacgaagaagttaaaaaactggctgagaatcagaggaggcaaaaggaggagcttcatgagaagatcataagactggaaagacaaagagatcagaaacaaatgatagagctagagattgagcggttgaaaggagagttgaacgtgaagaagcacatgggatcagacggagacgctgagattgtgaaagaagtggagaatatctataaaggtttaactgagaaggaagaagaactcgctgacctcgacaagtttaaccaaactcttatactcagagagcgcagaaccaacgatgagcttcaagaagcacgtaaagaattgattatgaaagagtggaaacaaaatatcggtgtaaagagaatgggagagctggtgacgaaaccattcatggatgcactgcagcagaagtattgtcagcaagatgtggaggacagagcaatagacgttctccagctctgggaagactatctcaaagatccagattggcatccattcaagcggatcaagcttgaaaatcaagaaagagaagtggaagtgatagatgatagagacgagaagctgagggagcttaaggaagatctaggagatggtccttataatgcggtaacgagagctttgttggagataaatgagtataacccaagtggaaggtacattacaacagagctatggaacttaaaagaagacaggaaggctacacttgaagaaggtgtcacttgtttacttgatgaatgggaaaaggctaaacgcaagcgtggaatggcttaa

SEQ ID NO: 318 - DNA, 2184 bp, Brassica rapa
atgtattcaagaagagagctggatgatttggagtacagatactactctgaaatgaaagatggaactcgcaaggtcaagatctctgactctctcttcaggtgtcccttctgctacttagaccgcaagcgtgattacaactttgacgacttgcttcgtcatgcttacaacatcagcggtagttcccgcactaaggatgggcgagagatagctagacatctcgcacttgagagatacatgaagaagtatctccgccctctggaaagaccatcatcagatgtctcttctcttcatacagaggtgttaaccggaagctggataacagcaggctcatcaagctctgctgcaggggaagtgaatagcagcgttgtcaaatccagttcaccatgtatcgctgaagctgaacctatgtctgtctcaggaggagatgatcctgtaccaagcggtgaagaaagacagatgttttctcctaaacacaactcctctttgagcaaccaagacaatacacacccttccaaaagagcttgcctcactgctggtggtaaagagggagaagaacctgtccaacagagtggtctcagccatggtgctccaagatatcctcagaggcgtgatcctttggctgctcgtaatgatggtctgatgtttgtgcatccatggaaagggatcttggccaacatcagtagaacttttagtgagaagacaaggaagttcactggcgagagtggaagcaaaattagggaagagtttgttagcaaagggttcaatccccacaaagtggagccactgtggaacggcagagttggtttcacaggttttgcgattgtttactttggcaaagactgggaagcttacaggaacgccaccatgtttgagaagcactttgaagtcaatcagtgtgggaagagagactatgattctgcacgtgatcgtggcgaagagctttacggttggatagcaaaaagggaggactactactcgagaactgtagttggagaccacctcaggaagcaaggggacttggtgactgtttctggaaaagaggcagagcaacaaagaagggcattcacgcttgtctccaacttggaaaacacactcgagaccaaaagcactaaccttgaagaaatagagagcaagtacaaagaaaccagtacagagcttcagaggagtatgaaagagaaggatgaaatgatcaacgctcataatgaaaagatgagtagcatgcagcaaaaggcgcgtgattatttggcgagtgtgaaaaatgaacatgaaaaggcagctcagcatctggaagctcaaaggaaagagtttgaagagagggagagatatcttgataaatgtcaaacgctgaacaaaactgagcgacgaaagcttcaatggcaaaaacagaagaacttaatggctactgaagagcaaaacaaaactgatgaagaaatgacgagagtggctaaacagcaacagagggagaaagatgagttacgtgagagagtcaaaaagctggagaaaaaactagatgatgagctggcattggagctggagatagagagaatgaggggtgggctgcaggtgatgggacacatggaagatcctgatatgaaggaagagatagaaaagacaaaggaaaaactaaaggagaaagaagaggagtcagagttccaagagtcactctatcaagctcttgttgttaaacatggctacactaacgacgagcttcaggatgctcgcaaggcgtttatcagatcaatgcaagagttgaccttacgtggtcagatctctgtgaagagaatgggagctttggatgagaaacctttccaaaaactaactaaagagagatatccagcagaagaggctgatgtagaagcagcaaagctttgttccttatgggacaaccacttgagagactcggcttggcatccgattaaggtcgtcctaatagacggaaaccacaaggaggtgctgaatgaagaggatgagaagctgcaggaactgaagaaagagctgggggatgaagtgtttgaagctgtgacacaagcgctgatggagaggaacgagtacaatggaagtggaaggtacatagtgcctgggctttggaacttcaaagaaggaagaaaagcgactctcaaagaaggtgtggtttatctgatgaagttgtggacgcacctcaagccaaagcccaagcgtaagtaa

SEQ ID NO: 319 - DNA, 1338 bp, Brassica rapa
atggaggaaaacctgcatcgagtttcacgtagtcccgatgtcgggacccacaatcaaaacgactccgtcgccgaagacaaccgtcgacgacggcattacaaccaccatactcacggcgtccaagcaaaagattctgctgattggaacgctgtcgatgatttggattttgagatccttaactttcactcatctccatctaatgccgatgatgatatggattttgagatcgttaactttcactcatcaccgtcgtccccatctccggtagtcaccaatgatgagccgcttcgcctaccaataccaatgcttggattaggggttccaaatgagcagctgttcgtcacacaaagatcactaccagaactagcaagaggcccaccatatttctactatgagaatgttgttcttgcaccttgggagacaatctcaaggcatttgtatgacgttgcaccagaatttgtggactcaagtttcatatgtgctgcagcaagggagagaggttatgtacacaatctccccatcagcaacagatatctgattcaacctcctccgaaacacacaattcaagaggtgttgccgctgaccaagaattggtggccaacatgggatacaagaaccaaactgaactgcatatttactgttaatgctagttctcagttaacaaacaggatccgctctgcccttgaggcttctaggggagaaccgcctgaggagataaaaaggtatgtcattgagcagtgcaaaaaatggaatcttatatgggtgggacaaaacaaagctgtgccattggaagtaaatgaaattgagactcttatggggtttccaatataccatacacgaggtggtggtggcattagtagggccgagcgtttaaagtcactcagtaattcttttcaggtggacacattggcatatcatttgtctgtccttaaacccttgtttcctgatggtattaatgtcctctccctgttcactggtattggtggtggagaaatggcgcttcatcgtctccaaattccgatgaaaacagttgtttctgtggagttctcacaagcaaacaaatacatcttaagagacttttgggagcgaactaaccagaaaggagtgttgatagagtttgaagatgtgcaagacctaactaaagatataatcgtagagttgatgaagcagtttggtgggtttgatatcgtgattggaggtagcccttgcaacaacctcgctggtggtaacagagtaaccccgaatggtcttgaaggtgaacagtctttgatgttctatgagtattgcagggttctgaacgtggttcgccagacagcaaaggagatgagaagatcttga

SEQ ID NO: 320 - DNA, 1002 bp, Brassica rapa
atgtttgctacgcttgttgacatgggattttcagatgacgtgatcgatagagcaattcaggaaaatgtttgtccatgtcttagtgtattctctcatttactctatgattatgttgtgaagatgaactgtgaacctagctcttctaagtctaagactatcgatcacttccttgccatgggatttgatgaggaaaaaattatcaaagccatacataaacatggagaagaaaacatggaagagatagcaaatgcactcctctcttctgaagcagatacattgcctataatgaaagaagaagataacatggactggtcagatagtgatgatgagatgaaatacgctgatttgttgagctcagacaacgagaaagatcaagactcctttgatagctgcaatccattgagttctttggtgaaaatgggtttctccgagctagaagcttctctagctatagagagatgtggagacagtgtgagcattgcagacctcgcggacttcatttgtgccgctcatatagctagagaatttgatgagttttacattgaccctgaagaacaaaaggtggacacagtggcatatcatttgtctgtcctaacacccttgtttcctgatggtattaatgttctctcactgttcactggtattggtggtggagaagtggcacttcaccgtctcaaaatcccgatgaaaacagtcatctctctggagatttcagaagtaaacagaaacatcttgagggacttttgggagcaaactaaccaaagaggagtgttgatagagtttgaagacgtgcaagacctagctagagacaaaatcattgagttgatgaagcggtttggtgggtttgatcttgtgattggaggtagtccgtgcaacaacctcgccggtggtaacagagtaagcaggagtggtcttgaaggtgaacagtcttcgttgttctttgagttttgtcggattctggaggttgttcgtgagacgacaatggagatgagaagatcttga

SEQ ID NO: 321 - DNA, 1806 bp, Brassica rapa
atggcgcaagattctgctgactggaacagcgatgatgatttggatttgcagattgataactaccagtcatctccaccgtcatccccaccggcggcagtcccttcttccgatgagctgtttgctacgctggttgacatggggttctctcctgagaatattgctagagctatcgatgaatatggaccaaatgcagatactgtggtgattattgatgctatctccaaatacactgttacctgtgaagctagttcttccaagtccaagactattgatcatttccttgctatgggatttgaggaggagaaagttatcaaggctattcatgagcatggagaagacaacattgaagagatagcaaatgcactcatctcctcggcagcagaggtatcgcccaaaatcaaagaagaagaggacattgagtggtctgagagtgatgatgagaagtatgccaatttcctcagctcagatgatgagaaagtttcagactcctcctctgaaaacggcaatcaattgcggtctttaatgaacatgggattctcggagttggaagcttctcttgctatagagagatgtggtactggagaggatgtgagcattgcagatctcgcagacttcatttgtgccgctcagattgctcgagagttcgatgagttccatgctgaccctgaagaacaaaagcctaatgtcaaaaagagacggatagagccaagaagagagccgaggtcatctgctgctgatgatgagccccttcgtctgccaaatccgatgattggatttggcgttccaaacgagccaggactcatcacgcagagatctcttccagccatggctcgaatgcctccatttttctactacgagaacgtcgcccttgctcccaaaggcgtgtgggacaccatttctagtcacttgtacgacgttccaccggagtttgtggattcgaaatatatttgtgcagcagcgaggaaacgaggatacgtgcacaacctccccatcagtggaaggtatcaggtccagcctcctccgaagtacacgatcagcgaggcgtttccgctgaccaagaagtggtggccagagtgggacaagagaacaaagctcaactgcatcctgacagtgaacgctagtgctcagctgacgaacaggatccggttagcacttgagccttatggtggagaaccgcctgagagtaagaagaagtatgtcattgagcagtgcaagaagtggaatctggtgtgggtgggaaagaacaaagctgcgccgcttgaaccagatgaaatggagactcttcttggatttccaaaaaaccatacacgaggcggtggcatgagtaggaccgagcgtctgaagtcactcggcaactcttttcaggtggataccgttgcgtatcacctctctgtcttgaaaccattgtttccatatggtatcaacgttctgtctctgttcactggaattggcggtggagaagtggcgctccaccgtctccagattccaatgaagacggtcgtctcagtggagatctcggcagtgaacagaaacattctcaaggacttctgggagcaaaccaaccagaaaggaaccctgatagagtttgcagacgtgcaagacctgagtaacgagaagatcgtggagttgatgaagcagtttggtgggtttgatctagtgatcggaggtagcccctgcaacaacctcgctggtggtaacagagtgagcaggagtggtcttgaaggtgatcagtcctgtttgttctatgaatattgtcggattctcgatgtggtgcgagaaacaacaaagacgatgagaagatcttag

SEQ ID NO: 322 - DNA, 4344 bp, Brassica rapa
atggaaggagacgaacctcgtggaggaggaagcgattctctttctgtcaagaggaaattctatgaaatcgatgaagattcttctcctatgaacggcagttccgagttgtacgaggttgcacagaccaggaacactattgctcttctggaaacaggagttgataagtttgggcattgctgtgagattagagcacatttaaatctgaaggttgaagactactatggagctaaaggagttgataagtggacatcacaccgctgggaagaggaactttttaagaacgaggcaaatgcccttagaggtggattcctgaaagtagagatggtacgccttcttgtaatagatgaatgccaccgcaccactggcaatcatccttatgcaatgattatgaagatttttaatcctcaagggcagaaaggggtggacaagtttgttacaaaagtgaaagaaggtccagtattttatgacccagcacctttatgccgtctggaactgaaagataagttgcgaacttcacacctcaagtttgatgcttctctgttaagtcttcttcaagaactggaaaaaggcaattgtcaggacgtggaggagaataagtttaaggcatatcaaaagcgactgtccgctgactaccacgatattttgcattgccttgatagtcttggcctcatttgcgcacatttggcggctgaaatctgcttggagaaaatctcggaaaccgaaacttataacgaatgctcaatggtgtgcaaggagtttcttagtgatgttttatccacacttgggctgtttttgcagaaagaagaaaagaattcggtagatttgccgcaagacaatccgtcagcagtgatttcgggacttgtatctcccaagttacaagaacttttccatctattggattcattgagaggtgaaatgcaaaagccatgccttattatagttgagagaatcataactgcagaagtgatcgaaagatacgtgaagaaacaagcctctttaggttacctttacgtcttatctttaatcggaaacaacgcctctacccaagcattggcacagaaaatgcaagattcatttcatgttggcaaggtaaatcttgtatttatcactgacgtggtcgaagaagggtttcacatgccagattgctcatgcatggtatgttttgacctgcccaaaacagtgtgtagttactcgcagtctcaagaactggccaaacagagtaactctaagtctatcatgtttcttgaaagggggaaccccagccaaagagatcatctgtatgaccttatgcgaagacaagtaccaaaagaaactccaaaccaagcgaattgtcaggacttgaaagagaacggagccacggttcatgatgaaccagcgccaaaagagcagtcggctaataaaaggttacgtcaactgcaagtgttggataagaatctgctacaatgcagcgccaaagagaaggccccctcttctaaaagtaaatcatctgcgtcggctgcaggttccaaaaagcggaaggagttgcacgggacaacccgtgcaaacgcattgtcaggaatctggggagaaaatcttgatggtgccatctttcaggcttataagttggacttctggagtaatatctctggggacgcgtactctagtttctctcttctgattgagtcaacccttgccgatgatgttggaaatgtcgagatgagcctttacttggtcaggaagtatataaaggcttctgtttcacattgtggccagatacgtttgagtcacgaagagatagtcaaagcaaagtgttttcagcaatttttcttcaatggcatgtttggaaagttgtttgttggatccaagtcactgggaacaaagagagaatttttgcttcaaactgacacaagttctctttggcatccttccttcatgtttttaatgctaccggttgagaccggtgatctagtttcgagtgcgacggttgattggtcagcgatcaactcctgtgcctgtgtagttgatttcttgaagaaaaatccccttctagaacttcaggttggtgaagaaaatcattgcaacacctcatccggtcaggaagggacacaaaagaaagaaacggaaacgaatctgattcattttgccaacgctttgtctgataaaaatagcatcgaagaaattgtggtcattgcgattcacaccggaaggatatactctatagttgaagccgtcaaagattcttctgctatgagcccgtttgaggacgaggcctcattagaatatgctacttatgcagaatattttaataaaaagtatgggattgtattggcgcacccgaaccagccattgttgaagttgaagcagagtcaccatgcgcacaacctcttagtcaacttcagtgacgaagtgattgagaagaaagaaccaaacgttagtaatgttagaaaaacaaaacccaacatccacgctcatttgcctccggagcttttggttagaattgacgtgccacgttctgtgacaaaatcaatctacttactaccatcagtgatgcaccgcctagagtctctaatgttggccagccaacttagagaagagattgattgtagcatcgataacttcagtatatctagtacatcggttcttgaagcacttacaacacttacatccgctgaagcgttttccatggaacgtttggaactgcttggggattcagtcttgaagtatgttgtgagttgttctctataccttaagtatcctaacaaagacgagggacaactttcgcgtgagaggcaatcgattatatctaactcgaatcttcaccgcttggctacagatcgcaaactgcagggatacataagaaacggcgcctttgaaccgcgtcggtggaccgcacctggtcaatgttctctctttcccgttccttgcaagtgtgggattgatagtagagaagtaccgttggagccaagattctttacagagaacatgactataaaaattggcaagtcctgtgacatgggtcatagatggacggtttcaaaatctgtatcagattgcgctgaggccctgattggtgcctattacgtcagcggtggattgactgcggctcttcacatgatgaaatggcttggctttgacgttgaatttgacagagaactagtgaatgaagccatcaatagagtttctctacggtgttacatccctaaagacgatgagcttacggagttggagacaaagatccgacgtgaattctcttcaaagtttcttttgaaagaggctatcacacactcatctgttcatgaatcctactcctacgagagattggagtttcttggcgattccgtgcttgattttctaatcacccgacatctctttaacacctacgaaaagacagggcctggagagatgactgatcttcgatctgcgtgtgtaaacaacgaaaatttcgcgcaagttgcagtgaaaaataatctgcatacccaccttcagcgctgtgcaacggttcttgagactcagataaaagagtatctgatgtccttttcagagccagatgagactggtagaacaatcccttcaatgcaaggccctaaggctcttggggacgtggtggagagtatcgctggagcattgctgatcgatacaaggttagatcttgaagaagtgtggagagtctttgagccgttgctttctccacttgtgacacctgataaacttcagcttcctccataccgagagctcaatgagctgtgcgactctctcgggtatttcttccgtgtgaaatgcgcaaatgatggtgtgaaggcacaagccacgatccagttacagctggacgatgttcttttgactggagatggatctgaacagacaaataaactggcactgggaaaagcagcttcccatctgcttaagcaacttgagatgagaaacatttcacgtaaaactgggaacggggatgatcaaagctccatggatattaaacttgcttgcaatcttagcgacagagaaactccgtcttcagattctgtcgaaatgcagggcacagtggttccagttattgggcctataaacatgaagaaaggagggccccgtggaacactacatgagttctgcaagaagcatctctggccaatgcctactttcgacactttggaagacaagtctcgaactccctttgaattcacagatggcaatgagaagcggactagcttcagcagtttcatatcgaccataaccctgaggatacctaatcgtgaggctgtgatgtattctggagaagccaggcctgacaagaagagttccttcgactctgcagttgtggaactgctctatgagctcgagcgccgcatgatcctgactataaaaaagtaa

SEQ ID NO: 323 - DNA, 2418 bp, Brassica rapa
atggctccaaagcgtaaggttccttcaactgaggttgagatctccggtcccacctcaactaggccgaagataagtcccaaagcgccggtagaagttgctgctgagccaatacgttcccgacctaagttcaaggtagagttggtggtggactccaagaaggatccgtcctgggttctagatgagccgattgctgattcggaggctaggactacgtggcccgagaggtatcaagtcatccagaagaaggaagtcgtacctttaccgaagaagaaaaagaaaaagtatgttgaggaagaggagattttccttgcgcgacgccattttcgacgagccatccttgatgattccatcacatacaacctctacgatgatgctcatgtgcagtctgaagaggacgaaaagcctttcatttgcaagatcgccgaaatctttgaaggatgtgatggcaaaatgtactttactgctcaatggttttaccgtgcgtgtgataccgtgatccaaaaacacgaagaaatgatcgatgacaaacgtgtttttatctcggacataaaagatgtaaactcaatgggggttcttctcaacaaattgaagattctgatgatcccgttaacggaaaatactgaagtgactgaaagctgtgattactactgcaacatgaaatatcacctgcctttttcaacacttgaagctttgcaatcaagtcagtgtattacgcctaatcaacgaacggatgctacaatgttagacttgtattgtgggtgtggagccatgtcaactggcctatgcatgggagctcagctgtcagggctgaatcttgtcacgaaatgggctgttgacacatgcgagtatgctgttcaaagcataaagtataaccacccggaaacagaagtgagaaacgagtccgcagaagattttctgtatctgctcaaggagtgggagaaattatgcattcatttctctttgatcgaatctgcggattcagaaaaatacgaaaacctttatgggatgtccgctgtggaagaggttaaagatggcagcgatgagagtgacgtcaaagatggtggagaggtttttgaagttgaaaagattgttggtattaagaaagaggaaggaggtagactccatctaaaggtccggtgggagaactatgggccttcccatgacacatgggaacctattgaaaatcttagcaattgccgtaagaaaattaaagagttcgttgtgcatggatttaaaacaagcatccttccattaccaggaggagtcgatgttgtttgtggaggtcctccatgccaagggattagcggttacaacagattcaggaacgaaaaagagccgctaaaagacaaaaagaacgagcagcttcttgaatacatgaaaattgtggagtttctgaagcccaagtatgttctgatggagaatgtggtagatatgcttaggtttgttgatggctttcttgcgcgctatgctgtgggacgtcttgtccaaatgaattatcagacaagaatgggaatgatggcggcagggtcgtatggccttgctcagttccggaggcggttcttcttgtggggtgcaatgtctagcgagacgcttcctcagttcccacttccgactcatgatgctgtcaatagaggacatgttcctgtgaactttcatagtaacgtagtggcctatgaagaaacagacaatgtgaagttggcggataagatcctactctcagatgtccttaccgaccttccagttgttgcaaacaatgagaggagggcggagatgccatatgacaaagatcctaagacgccatttcaaaaatttatcagattgacgcaagaaggaatgttagcttcacctaaagatcccaagtcaaactccaaaaatgaggtgttgtacgatcaccatcctttgaatcttaacaaagatgattatcaacgtgtctgtaggatccccaagaaaaagcaagcgaatttcagggacttacctggtgtaactgttaatgctaataacaaagttgaatgggatcctaaaatccccaggatctatcttgaatccaatcaccccttgattccagagtatgccatgaaatttgtcgagggaaaatcaaagaaaccctttggacggctttggtgggatgaaactgtcccaactgttatcggaagagccgagccacacaatcatgtgatcatccacccaaaccaagaccgtgtcttgactgtgcgagagaacgcaaggctccagggcttccctgattactatagactatttggccctaccaagaaaaagtacactcaagttgggaatgctgttgcagtaccagtggctagggcacttggatacgcattaggacaagctttccaaggcctcactaatggtagtgatccactcttcactctgcccgaaggttttccaaaaccaaccttctga

SEQ ID NO: 324 - DNA, 2721 bp, Brassica rapa
atgggttctgatgaagataaagcgctaccgcttcctccacctgtccttcctccaaaccttcttcccgaggtggagtccatcaagaagaacactctccttccgatggcccggcgtggcactgggtccaaaggacagaggattcctcttctcaccaatcacttcaaagtgaacttcaacaacgccaacggccagttcttccattacagtgttgctataacgtatgaagatggccgtccggtggaagctaaaggtatcggtaggaagatccttgacaaggttcagcagacctataaaactgacttgggatccaagtactttgcatatgatggcgagaagactctcttcaccgttggtcctcttcccagcaacaaacttgacttctctgtcgttcttgaagacgctccttctagcaggaacaacactggaaacggtagcccgaatgagtctaatgacgctgacaggaaacgatcaaagaggcccaatcagtccaagaagttcatggtggagataagctatgcggctaagatacccatgcacgctattgcagccgctctccaagggaaggaaacggacagccttcaagatgcgatcagagtgcttgacgtcattctcagacagagtgcagctagacaaggttgtctcctagttcggcagtcgttcttccataatgacgcccagaactttgtaccaatcggtgcaggtgttgttggtgtcagagggttccattcaagcttccgaacaactcagggaggcttgtccttgaacatagacacttcaactaccatggttgtacaacctggccctgtggttgattttctcctggcgaatcagaatgtgaaagacccctactctgttgactggaacaaggctagacgtgttctcaagaatctcagagtcaaggttgctccctcaaaccgagagtacaagattagtggacttagtgaaaatcgctgcaaagagcaaatgttctctcggaattccaagaacgatatgggcgaagttgtggagcatcagacgactgtgtttgagtatttcaccgagttccgtaacatccaactgcagtactctggtgacttcccttgcatcaacgttggcaagccaaagcgccctacttacatccccattgagcactgtgagcttgtgagtctccagcgctacacaaagtcacttaccaatcttcagagggcttccctggttgaaaagtctaggcagaagccactggaaaggatgacatctctaaccactggtctgaagaacagcaactataatgctgacttggtgttgcaagagagtggtgtcagcatcggctctagcttcacccacgtggagggccgcatcttacaagcaccaaagctgagagtgggcaatggagaggactttcaacctcgcaatgggcgttggaacttcaacaataagaaactggttgagccaaccactgtcactaggtgggctgtggtgaacttctccgctcgctgtgacacaaaccggctcattccggacttgattcgctgcggcaacatgaaaggcattaacgtggagcctccttacgaagtggtctttcaagaaaatgctcagttcaggagtgcaccacctcacatcagagttgaaaagatgttcgagcagatacagtctaagctcccggggaagcctaagttccttctttgcatcctcgcagaaaggaagaactctaacgtttatggtccttggaagaagaagaaccttgctgagcttggaatcgtgactcagtgcattgcgcccaccgccagaatcaatgatcagtacctcaccaacgttctcctgaagatcaacgccaagctcggtggtctaaactcactgctaactatggagcgctcacaggcaatgccgtcagttacgcaagttcctacaatcattgtcggcatggatgtttcccatggttcccctggccagtctgatgtgccatctgttgctgcggtggtgagctccaggcaatggccactcatctcaaagtacagggcatgtgtgcgcacacagtctcgtaaagtggaaatgatcgacaaccttttcaagcttgtccctggcaaagaagagaagatggttgacgagggaattttcagggagctcttggtcgacttttactccagctcccagaagaggaaaccagaccacatcatcattttcagggatggtgtgagtgagtcccagttcaaccaggttctgaacatcgagttggatcagatgatgcaggcatgcaagtttctcgatgaaaaattgaaccccaagtttacagtgatcattgctcagaagaaccaccacaccaagttcttccaggataaaggaccagacaatgttcctccagggactatcattgacagcaagatctgtcaccctcggaacaacgacttctacctctgcgctcatgcggggatgattggaactacaaggccaacacactaccatgtgctgtacgatgagatcaactttaccacagatgacctccaggaacttgtgcattcgctgtcatatgtctaccagaggagcaccactgccatctcagtcgttgcaccgatttgttatgctcacttggcggctgcacagatgggaactgtgatgaagtttgaggacttgtctttgtctgagacatcatcgagccatggcgggatcacgactcctggggcagtgcctgtgccacccatgccaaagttgaacccggaggttgcaagttccatgttcttctgctga

SEQ ID NO: 325 - DNA, 2793 bp, Brassica rapa
atggattctcatgaagcaaaacggctaccacctcccccaccggtagttccaccaaaccttgtgcctgaacgagagcctatcaaaaagaccacccttcttccaatggctcggcgtggcatcgggtccgaaggagtgaggacacctcttcttaccaatcacttcagagtcaacttcaacaacgcaaatggccacttctatcattacagtgttactattacatatgaagatgggagtccaatggaggctataggtgtttttaggaagattcttgaaaaggtccaggaaacgtatcgaacagatttaggatctaaatactttgcttatgatggccataagaatctgttcaccattggtgctcttcctagcaacaaaatggatttcttagtcgttctagaaaacacaccttctagcagaaacaacactggaaatgctagcccaaatgacgcggacaggaaaagatcaaggctgccacaccgatccaagaagttcatggttgagataagctatgctgcaaggatccccatgcaagctattgcaagcgctattcgaggaaaggaaacagataatattcaagatgctacaagagtgttggatgtcattttgcatcagaatgcagctaggcaaggttgcctacttgttcgccaatcattttttcataacgatgctcggaactatataaacattggtggaggtgtatttggtgctagagggttccacacaagcttcagaactactcaaagaggcttatccttgaacatcgacacttcaactacaatggtagtacaaccaggccctgttattgattttcttcttgcaaatcagaatgtgaatgacccaaagtatctcgactggaataatgctaggcgtgctcttaagaatctgagagttaaggttgtcccctcaaatagagagtgcaagataactggactaagtgaagagcgctgcaaatatcaaatgtttactatgaattctaaaaacgagaagggggatgttcagattacggtgtacaattacttcaccgagattcgcggtctcaaactgcgatattcaggtgactttccttgcatcaatgttggtaaggcaaatcgcccaaattacatccccattgagcactgtgaacttgtgagtctacagcgttacacaaaatcgcttagtagttttcagaaggcttctctggtagaaaattctaggcagagtccacctgaaagaatggcttcactaaccaatagtatgaagaagagcaactataacgctgaccttgtgttgcaagaaagtggtgtcagcattggctctagcttcatccaagtggagggtcgcgttttaccagcgccaaggctgagaataggcaatggagaggagtttcaacctcgcaatgggcgttggaacttcaataaaaagaaacttgttgagccagtcacggttactagatgggttgttgtgaacttctctgctgaatgtgatacagataggataatttctgacttgattagatgtggacagatgaaaggaatgaacgtagaacctccatacaaagtcgtatttcaagaagatcctaattataggggtgcaccagccaatatcagagtagaaaagatgtttgagcagatccaatctgaactcagaaaagaaggaaagccaaaattcattctttgcattcttgccgaaaagaaaaactctcttgtttatgggccttggaagaagaagaatcttattgaacatggaattgttactcagtgtattgctcctccaaaaaacgtaaaagatcaatatatcaccaatgttcttctcaagataaatgccaagcttggtggactgaactccctgttagctatggaacgctcacgagcaatgatgcatttagtaacgcaagttcctaccttcattgttgggatggatgtatcccatggttcccctaaccaggccgacataccatcaattgctgcggttgtgggctccagagaatggcctctcatctcaaaatatagggcttgtgtgcgcacacagtctcggaaaatggaaatgattgataatctcttcaaacttgtccccaacgaaaagggaaaactagtagatgaaggaattttctggtttgactactctcgtgttgtgttcatagcttgtggcagtggcttttgtcatattaatgagaaactttatgcgcttttcagggagctcttgttcgacttttacacaagctcggggaagaggagacctgaacacattatcattttcagggatggtgtgagtgattcacagttcaatcaagttctcaacattgaattggatcagattatgcaggcatgcaagtttgttgaagaaaattgggaacccaagttcacagtgatcattgcccagaagaaccatcacaccaagttcttccaggatagaggcactgaaaatgttcttccaggaacaatagttgacagcaggatctgtcacccacacaacaatgacttctatctctgtgcccatgctggattgattggaactacaaggccaacgcattaccatgtgctttatgatgagattagattttcgacagatgacctgcaagaacttgtgcattctctatcatatgtctaccagaggagcaccactgccatctctgtcgttgcacctatttgttatgctcatttggcggctgcacagatgggaactgtgatgaaatttgaggatatgtctctgtctgagagatcatcaatccatgatgggatcacgagatctggagaaccacctgtgccacccatgccaatgttgaactcggatgttgcaagctccatgttcttctgctaa

SEQ ID NO: 326 - DNA, 5106 bp, Brassica rapa
atggatccgaacaagagtactcatcttcaaatggctcggagtggtaacggttctagaggacagaagatcgatctgcttactaaccactttggagtcaacttcaccacatcaaaaagtcaacatttcttccaatacagtgtcgctatcacatatgaagatgggaatccagttgaagccaagggtattggcagaaagattcttgcaaaagttcaagaaacttatcaaactgatttgggttccaaacactttgcttatgatggcgacaagattcttttcactgttggtcctcttcccaacaacaaactagacttctctgtcgttcttgaagacatgtcttgtaccagaagcaacaccagtaccagtgacgccaacacgaaaagattaaggcctcataatcaatccaaaagattcaatgttgcaatcagctttgctgcaaaaatctcaatgcaagctattcaaggtgctcttcaaggaaaggaaacaaatgatcttcaagatgctgtaagagtgttggatgttatcctgcgccagaatgcagctaccaaaggttgtcttcttgtccgtcaatctttcttccacaatgacgcaaaatacttttcaaacaaccatggaggttttcatctatgcagaggattccattcaagcttcagagctactcagggaggcttatccctcaacattgatgtttcttctacattgatagtatcacctggtcctgttattgatttccttgttttaaatcaagaagtgagagatccatcctctatcgactggaaaaaggctgaacgtactctcaagaatcttagagttaaagtcgacccctcgaatcgagaatacaagataaccggactaactagacttccttgcagagaccaaacgtttctttggaagaaaaagcaaggaaacggggaaactaaggaggttgaggttacagtgtatgattacttcactaaacatcttgaaattgaactgcgtcattcaggtggcttaccttgcatcagtgttggtaagccaaaacgtcctacttactttcccattgagcaatgtcatcttgtttctcttcaacgctatacgaaagctcctacaatttttcagaggagtaaacttgtcaaagaatcagtacagaaaccacaagaaaagatgaatgtgttaaacaacgctattaaggacagtggttataataatgaccctatgttacaagactgtggtgtcagaattgactctgacttcactcaagtggaaggccgcgtcttaccaacaccaaggctgaaagtaggcaatggagaggagtttcaacctcgcgatgggcgttggaacttcaataataagaaacttgttgagccagctactgttactagatgggctgttgtgaacttctctgcacggtgtgatacaaaaaggcttatttctgacttgattagatgtggaaggatgaaaggaatcaacgtagatcctccatacaaagtcgtatttcaagaagatcctaattataggggtgcaccagccaacatcagagtagaaaagatgttcgagcagatgcaatctgaactcagaaaagaaggaatagaaggaaagccaaaattcattctttgcattcttgccgaaaagaaaaactctcttgtttatgggccttggaagaggagaaatcttgttgaagaaggaattgtgacgcagtgtattgctcctacccccaaaataaatgatcagtatctcacaaatgttctcctcaagataaatgccaagatgatgcctttagtaacgcaagttcctaccttcattgttggcatggatgtatctcatggttcccctggccagtctgacataccatcaattgctgcggttgtgggatccagagaatggccactcatctcaaaatatagggcatgtgtgcgcacacaatctcggaaagtggaaatgattgataatctcttcaaacctgtcaccaacgaaaagggaaaacaagtagatgaaggaattttctgggagctcttgttcgacttctacataagctcggggaagaagagacctgaacacattatcattttcagggatggtgtgagtgagtctcagttcaatcaagttctcagcattgaattggatcagatgatgcaggcatgcaagtttgttgaagaaaattgggaacccaagttcacagtgatcattgcccagaagaaccatcacaccaagttcttccgggctgaaggccctggcaatgttcctccaggaacaataattgacagcaggatctgtcacccacgcaacaatgacttctatctttgtgctcatgctggattgattggaactacaaggccaacacattaccatgtgctctatgatgagattggattttcgacagatgacctccaagaacttgttcattctctatcctatgtctaccagcggagcacaaccgccatctctgtaggtgcgcctgtaatgtatgctcatttggcagatgcacagatgtcaactgcggtgaagtttgaggacagctccgagacttcatcgagacatggtgggatcacaacatctgaagcagaacttgtccctcccatgccaaagctgaacgcgaatgttgcaagctctatcgaaggttgttgtggcggcggcgacggaaagacagagatgatacttacggaggaagctctgagaaaagtactcggcatctccaaagcggcttcctccggtactcgtatcgctgcaggaagcgcttgggaggatattcgtggtcctgatcctctaccactattctttcgtgacgtcattgaaagctggcgactttggctgggggctggacctgatcgaagaccaatgtcgtcccacattgtcggttatccccgcatcggtcccaagagagagcttaagtttgcattggagtccttctgggatgggaaaaccggcgctgaggatctgcaaaacgttgctgctgacttgagacgctccatatggaaacatatggctggtgtagggaacaagtacattcccagcaacactttttcttactatgatcagatgttggataccacagcgatgcttggagctgttccctctaggtacggttgggaaagtggtgaggtcgggttcgatgtttacttctccatggctaggggtaatgattctgttcctgctatggaaatgaccaagtggtttgatacaaactaccattacattgttcctgagttgggtcctcatgttaaattctcatatgcatctcacaaggctgtggaggagtttaaggaagccaaagcgcttggcatagacacagttcctgtgctcattggtcccatgacctacttgctcctctcaaaaccagcaaaggatgtcgataaatctttctgccttctctctctgattgacaagattcttcccgtctacaaagaagttttgactgatctaaagtctgctggtgcacgttggattcagttcgacgagcctatacttgtgatggatcttgataccaaccaattgcaggcgttttcggatgcctactctcacatggagtcatctttggcggggttgaatgttcttatagccacatacttcgcagatgttcctgctgaagcgtacaaggcattaacgtccttaaagtgtgtaactgggtttggatttgacctcgttcgtggattagagactcttgatttgatcaaagtggattttcctcgtgggaagctgctattcgctggagttgttgatggaaggaacatttgggccaatgatctttctgcttcactcaagacactacagactcttgaagacattgttggaaaagaaaaagtcgttgtctctacttcttgttctctactccatacggctgtagacttggtgaatgaaattaaacttgataaagaactaaaatcatggcttgcatttgctgcacaaaaggttgttgaagttaatgcacttgccagatcattctctggtgttaaggatgaggcactgtttgcttctaattccatgagacaagcttctagaagatcatctccaagggtgacaaatgccactatacaacataatgttgctgcagtaattaaatctgatcaccggcgttctacaaaagtaagtgctaggctacaagcccagcagaagaagctaaaccttcctcctcttccaacaactacaattggatcttttcctcaaaccccagatctcagacggatacgcaaggaattcaaggccagaaagatatcagaaattgactatgtccaagctatcaaagtcgaatttgaaaaggttgttaagcttcaggaagagcttggcattgatgtattggtgcatggggaggcagagagaaacgatatggtggagttttttggcgagcagctgtctggctttgcattcacatcgaatgggtgggtccagtcatatggatcacgttgtgtcaagccacctatcatctacggtgatgtcagccgaccaaaggcaatgactgtcttctggtcttctatggcacagaagatgaccaaacgtcctatgaaagggatgctcactggtcctgttacaattctcaattggtcctttgttagaaatgaccagcccaggtatgagacgtgtttccaaattgcacttgccattaaagatgaggttaaggaccttgagaaggctggtatcactgttatccagattgatgaagctgcattaagagagggactgcctctcaggagatccgagcaagaactttaccttgactgggccgtccacgcattcagaatcacaaactgtgatgtgcgagacactactcagattcacacccacatgtgctactcaaatttcaacgacattataaactcaattataaacatggatgctgatgtgatcactattgaaaactcacggtcagatgagaagctcttatcagtgttccatgaaggagtgaaatacggtgctggaatcggtccgggggtttatgacattcactctcctcgtatcccatccgctgaagaaatagctgagcgtatcaacaagatgcttgcagttctggatagtaaagtcctttgggtgaaccctgactgtggcctaaagacgcggaagtactctgaagttaagtctgcacttagcaacatggttgctgctgccaagctaatccgctctcagctaaataagtcataa

SEQ ID NO: 327 - DNA, 2736 bp, Brassica rapa
atgggttgtgataaaggaaaaggactaccacctcccccacctgtcgttccatccaaccttgtacctgaactggagcctataaaaaagaacactcttcttccaatggcccggagaggcagcgggaccaaaggagtgaagacacatcttcttaccaatcacttcagagtcaatttcaacaactcaaacggccatttttttcattacagtgttgcgattacatatgaagatggtcgtccagtggaggccaaaggaattggcaggaagattcttgaaaaggttcaggagacgtatcgaactgatctaggatccaaatactttgcctatgatggcgagaagactttgttcaccgttggtgctcttcccagcaacaaactggatttctctgtcgttcttgaagacacatcttctagtaggaataacactggaaatgctagcccgaatgaatcaaatgacgcagacaggaaaagatcgaggcgaccaaatcgatccaagaagttcatggttgagataagctatgctgcaaggatccccatgcaagctattgcaagcgctcttcaaggaaaggaaacagattatcttcaagatgctataagagtgctcgatgttattctgcgccagagtgcagctaggcagggatgcctacttgttcgccagtcattttttcacaatgacgtccagaactttgtacacatcggtggaggtgtcactggtgtcagaggcttccactcaagtttcagaactactcagggaggcttgtccttgaatatcgacacttcaactacgatggtagtacaaccaggccatgtcgttgatttccttcttgtaaatcagaatgtgaaagacccaaagtatcttgactggaataaggctagacgtgctctcaagaatcttagagtacaggttgccccctcaaatagagaatacaagataactggactaagtgaagagcgctgccaagatcaaatgtttactcggaattctaaaaacgagaagggggaagttgaggaagttcagactacagtatacaagtacttcaccgagtttcgcggtattccactgcgatattcaggtgactttccttgcatcaatgttggtaagccaaaacgcccaacattcattcctattgagcactgtgaacttgtgagtctacagcgttacacaaaatcgcttaatagtcttcagagggcttcactggtagaaaagtctaggcagaggccacctgaaaggatggcttcactaaccaatggtctgaagaagagcaactataatgctgacctggtgttgcaagaaagtggtgtcagcattggctctagcttcactcaagtggagggacgtgttttaccagcaccaaggctgaaagtaggcaatggagaggagtttcaacctcgcgatgggcgttggaacttcaattataagaaacttgttgagccagtcaccgttactaaatgggctgttgtgaacttctctgctcggtgtgatacaaataggcttatttctgacttgattagatgtggaaggatgaaaggaatcaacgtagaagctccatacaaagtcgtatttcaagaagatcctaattataggggtgcaccagccaacatcagagtagaaaagatgttcgagcagatgcaatctgaactcagaaaaggaaaagaaggaaggccaaaattcattctttgcattcttgccgaaaagaaaaactctcttgtttatgggccttggaagaggagaaatcttgttgaagaaggaattgtgactcagtgtattgctcctacccccaaaataaatgatcagtatctcaccaatgttctcctcaagataaatgccaagcttggtggactgaactccctgttagctatggagcgctcacgagcaatgatgcctttagtaacgcaagttcctaccttcattgttggcatggatgtatcccatggttcccctggacagtctgacataccatcatttgctgctgttgtgggatccatagaatggccacttatctcaaaatatagggcgtgtgtgcgcacacaatctcggaaagtggaaatgattgataatctcttcaaacccgccactaacgaaaagggagaacccgttgatgatggaattttcagtgagctcttgtgggacttttacttaagctcgaagaagagaaaacctgagcacattatcattttcagggatggtgtgagtgagtctcagttcaatcaagttcttaacattgaattggatcagatgatgcaggcatgcaagtttgttgaagaaaattgggaacccaagttcacagtgatcattgcccaaaagaaccaccacaccaagttcttccaggctgaaggccctggcaatgttcctccaggaacgataattgatagcaagatttgtcacccacgcaacaatgacttctatctctgtgcccataatggaatgattggaactacaaggccaacacattaccatgtgctctatgatgagattggattttcgacagatgacctccaagaacttgttcattctctatcctatgtctaccagaggagcaccactgccatctcagtcgttgcacctgtttgttatgctcatttggcggctgcacagatgggaaccgtgatgaagtttgaggacatgtctttgtctgagacatcattgacccatggcgggatcacaatacctggagcagtccctgtgccaccaatgccaaagttgaacgtgaatgttgcaagctccatgttcttctgctaa

SEQ ID NO: 328 - DNA, 2604 bp, Brassica rapa
atgcctgtaacgccagaagaaccgagccgtcgagattatgcggtcacagctaggcttggggttggaagcacaggcaggagaatacagttgtgcaccaatcacttcaatgtctctgttggacagccggatgttgttttctaccagtacactgttagtatcaccacagaagacggtgagaatgtccaagggaaaggaattggcaggaaacttattgaccaactttacaagacttactcttctgatcttgatggtaaaaggttggccttcgatggagagaagactttgtataccgttggtcctctcccacagaacgactttgactttcaagtcatcttggaagcttctttttccaaacgtgactgtggcgtctctgatggtggtagtccttctggttcttccaagagatcaaagcgctctttcctgccaagaagttacagggtccaaatccacttttcagcaaaaatacccttaaggagtgttcttgccactcagagaggagttgacacatcagataacagcactcaggatgcagttagagtgcttgacattgtactgagacagcaagcagctgaaagggggtgcctgttagtcagacaggcatttttccttaacgatgtgaactctgttgatgttgggggaggcgtaatagggattcgaggtttccattccagctttcgtccaaccgatggaggactctcgcttaacattgacgtgtcaacgactatgatcttaaaaccaggtccagttatcgaatttctgaaagccaatcagaatgttgagttgcctagacagatcgactggattaaggccagcaaagtgcttaaaaatctgagggtaaaggcatcacaccgtaacatggaattcaaaattataggtctaagtgcgaaaccgtgcaatcagcagctatttacaatgaaaattaaagatggcgagtgtgaaggacagactaaagagattactgtgtatgagtattttaagcaaacttacacagagcctacttattctgcgtacttgccatgccttgatgtcggcaagccagatcgccccaactatcttccactggagttctgtaatcttgtatctctgcaacgttacacaaaagcattgtcagtgaggcaaagagctttacttgttgaaaagtcaagacaaaaacccctagagagaattaaagcactcaatgatgcaatgcacacctactgctatgataaagatccgtttttagccggaagcggcatatctattgaaaaacaaatgactctagctgaaggccgggttctaaatcccccaacgctgaagtttggaaagaatgaggattttttacctagcaacggacgctggaactttaacaagaagatgcttatagaaccaagggctattaagaactgggctgtagtcaacttttcttttccatgcgacagtagtcacatttcccgtgagctcataagctgtggcatgaggaaaggcattgaaattgatcgaccttttgcactagttgaagaggaaccccagtctaaaaacttgagtgctgttaaaagggtagagaaaatgattgcaaagatgaagtcgaaatttccaatcgatcctcctcatttcattctctgtgtcttgccagaacggaagaactcagatatctatggtccctggaagaaggtttgtctcactgaagcagggatcaacacgcaatgcatctgccctacgaagatcaatgaccaatatctcaccaatgtacttctgaagataaattctaagcttggcggcataaattctctgttgggaatggagtgctcttccaacattccattgattaacaaaattcccaccttaatcttgggtatggatgtatctcatgggtctccaggtcgtgcagatgttccttcgatagcagcggttgttggttcaaaaaactggcccttgatctcaaggtacagggcagctgtgagaactcagtcaccaaaaatggagatgattgattcgctcttccaaccagtcgaggaccctgtgaacggagacaacggtatcatgaacgaattgtttgtggaatttttcaagacaagcaacgcacgaaagcctaagcagattatcatattcagggatggagtaagtgaatcacagttcaaccaagtcttgaacattgaggtggatcagattataaaggcgtatcaacgtcttggtgaaaccgatgtgccgaaattcactgtcatcgtggctcagaaaagacaccacacgaagttgtttcaagccaagggtcatgaaaatgttcctgcaggaaccgttgtggacaccaagattgtacatccgaccaactacgatttttacatgtgtgctcatgcagggataataggaacttcaagaccagctcactatcatgttttgctggatgagattggtttctctccggatgagttgcagaatctcatccattctctctcctatgtcaaccagcggagcacaactgcaacctcaattgtggctccagttagatacgctcatctcgcagcagctcaatttgcgcagttcacaaagtttgaagatatatcggaagagaaagtcccggagcttccacgtttgcacgagagagtcgaaagcaacatgttcttctgctga

SEQ ID NO: 329 - DNA, 2226 bp, Brassica rapa
atgtcgtaccttctgcctcacttgcattccgggtggtctattgatcaggcgattctagccgaggaagagcgtctcgtggtcattcgtttcggccatgattgggatgaaacctgtatacagatagatgaagtcttttgctctcttccttgtacgaatattaactctttattaactcttcctcatcttcctcttcctattcttcttcctaatcttcctcttcctcacatcgacatggatagggattatagctataatgaatctagcgataatgagtctagcacatgtgaatcagcaaaggggaatcgccttttgtactcactgcctcctcgtccggggtttggaacaaacgttcgcataataccgcttgtgtctaaccatttccaagtcactcttgccaatcttccggaatatttctaccgatacagggtagtaaatttcgtccataatggtgggcgcagccctattgatcagaaagggattggaatagaactcattgacctggttcacagggtttatgactccgattttgttggcatagagtttatctatgatggagaccacatggtgttcacattgggttctttgcccgataggcataatgattttcctgcggttcttgggatgaattcttcaaccatgactaaccctctcaagtcagttgaagtctcgttcaacgctgctcgcaatctcgaaatccctcttcagtctcttgttaacgctatgcatggacaagaatccccgaattcactggaggcaataagggttttcgacatcatcttacatcagcatgctgctagacagggttccctacgtgtgagacggtcttttttccacaatgaaagccgcgaaccaattggtcctaacatcttgggatatagaggattccattcaagttttcggacaacgcagggtggaatgtcacttaacatggacgttaaaaccacaacggtcatcaagcctggtccgcttattgattttctgattgctgaccaaggtgcacgcgatgtgttcgatgtcgactggaatatcaactatttattaactcttcctcatcttcctcttcctattcttcttcctcatcttcctcttcctcacatcgacatggatatggattatagctataatgaagctagcgataatgagtctagcacatgtgaatcagcaaaggggaatcgccttttgtactcactgcctcctcatccggggtttggaacaaacggtcgcataataccgcttgtgtctatccattttcaagtcactcttgccaatcttccggaatatttctaccgatacagggtaaatttcgtccataatgttgggtgcagccctattgatcagaaagggcttggaggagaactcattgacctggttcacagggtttatgactccgattttgttggcatagagtttatctatgatggagaccacatggtgtttacgttgggttctttgcccgataggcataatgattttcctgcggttcttgggatgaatttttcaaccatgactaaccctctcaagtcagttgaagtctcgttcaacgctgctcgcaatctcgaaatccctcttcagtctcttgttaacgctatgcgtgggcaggaatccccgaattcactggaggcaataagggttttggacatcatcttacatcagcatgctgctagacagggttccctacgtgtgagacggtcttttttccacaatgaaagccgcgaaccaattgatcctaacatcttgggatgtagaggattccattcaagttttcggacaacgcagggtggaatgtcacttaacatggacgctaaaaccacaacggtcatcaagcctggtccgcttagtgattttctgattgctgaccaaggtgcacgtgatgtgttcgatgtcgactggtctaagattagggcacgaaacggattgaaatggttgctacgagacgatgtcgtaccttctactcacttgcattccgggtgggctgttgatcaggcgattctaaccgaggaagagcgtctcgtggtcatacgtttcggccctgattgggatgaaacctgtatgcaggaacaaagacattatgatcgatctcgggacgggtacaacaacaagattaattgggctatgaaggacaaacatgagtttattgatatcattgagaccgtcttccgtggtgcaaggaagggtcgtaggctcgtgattgctcctaaagattactccaccaaataccgctactaa

SEQ ID NO: 330 - DNA, 2901 bp, Brassica rapa
atgtcgtctcgtggtggtcgcggcggcggtggaggacgtcgatctgaccagtcccccggtcccgttgcgtggcctgcactgcaaagctccggcgctcgcggcgggagaggtcgcggtaacgccgctcccgtcgcttcgagctcttcgtctcctccgtcggatgctgtttccggcgccatcggagcggttgacgtcgcttcgtcgtcgtccgtacgtgagaaacccaaggcctcggcgtcttcggattccgattcgtctctcggtcaggagttagcggagaaagtccagatcacgacggctcctccgtcgtcgtcgaaggcggtgacgtttccggtcaggccagggtttggtcaggcggggaagaaagtgacgattcgcgcgaatcacttcctcgttcaagttgcggatagagatctctatcactacgatgtgtcaatcagtcccgaggttatttcgaagaaggtgaacagggacgtgatgacaacgttggtgaagacgtacggagaatcacacatggcgaagaagattcctgcgtatgacggcaggaagagtctctacactgctgggcctctcccttttgagtctaaagagtttgttgtggatctgaacgacaaaaaacctgctgcgtcatctaagagggacaggaagttcagagttgctataaagctggcgtcaaggcctgatcttcatcagttgcaggagtttctccgtcggaaacagagagatgctccatacgagaccatccaagttttggatgttgtactcagggatctgccatcccaaaagtttgtttccgttgggaggtctttcttcgaccccagtttgggaaggaggggtgagcttggtgatggtgttgagtactggagcgggtatttccaaagtctaagactcactcagatgggactgtctctcaacattgatgtgtctgctagatctttctatgaacctatccttgtcactgaattcatcggcaagtacctgaatctgagggattttagcaggccactgagggactcggatcgtgtcaaggcatcttatctgatgtttattcaaccagtgaagaaagcattgaagagcttaaaagttgaattggcacagtttgacttcgcaagaagtgtcaaggtcagtgggatttccagctgtcccatcagcgagctaaggttcacgttagaggacaacacccaaaaaactgttgtgcagtactttgctgagaagtataattacagagtgaaatacccggctctacctgctatccaatcagggagtgactcaaggcctgcttacttcccaatggaattatgccggatagctgaaggccagagatacaccaaaaagctgaatgagaggcaggtgactgcgttgctaagagctacctgccaaaggcctgacattagagagaattcgatcaaagggatggtcaagaataataagtataacgagattgatcttgtgaggaaggagtttggaatgtcagttactgatcagctagccacagttgaggctcgggtcctacctccacccctgttgaaataccatgaaagtggcagagaaaaaatggtgaatccaaggctaggacagtggaacatgattgacaagaaaatgattaatggagcaagagttgcatcttggactagcgtgtgcttctctactaggattgaccggaatttaccacaagagttttgcaagcaattgattgacatgtgcgtcagcaaaggaatgcaattcaatccacagcctgctattccgttcatctcttgccagcctcaaagaattgaggaagcactttgtgatatccacaaaagggcacctggtcttcaaatgttgattgtaatattaccggatgtcactgggtcatacgggaagatcaaaaggatatgtgaaacagagctagggatagtatcccagtgttgtcaaccaaatcaagttcgtaaactcaacaagcagtacatggaaaatgtcgcattgaagattaatgtcaagactgggggacggaacacagtccttgatgatgccattagaagaaggattcctctgattagtgatcgcccaaccataatctttggtgctgacgtgactcaccctcaacctggagaggactcgagtccttctattgctgcggttgtggcctcgatggattggcctgagataaccaagtatcgtgggctggtgtctgctcaaactcatagggaagaaatcatcgaggacctgtataagctggtacaggatcctcagcgagggccagtccacactggtatgataagggaacatctgatcgcattcaggagggctacaggtcaaaaacctctgaggatcatattctatcgcgatggtgtgagtgaaggacagtttagccaagtgctgttgcatgagatgactgctatacgcaaggcgtgtgcctctctcgaagagcgttatcttccgcctgtaacgtttgtggtcgtccagaaaagacaccacacacgtttgtttcctgctcaacacgggaaccgtgagacaactgataagagtgggaacattcagccaggtaccgtcgtcgataccaaaatctgtcatcccacggagttcgacttctatttgaacagtcacgctggcattcagggaacaagcaggcctgcacattaccatgtgcttgtggacgagaacgggttcacagctgatgccttacaaatgctcaccaacaacctttgttacacgtttgcgaggtgtacgagatctgtttcaattgtgccaccggcttactatgcacacttggctgcattcagggctcgttactacatggaaagtgagaactctgatggaggttcaagcaggagcaggaacacaaccgcaagcacgagtgctgttgtctcgcttcttccagcaaccaaggataacgtcaaggacgttatgttctactgctga

SEQ ID NO: 331 - DNA, 4926 bp, Brassica rapa
atgccggaccgcgaaatcggcgacgatgcttctgacactaacctctcctcttccttctcttccttcgcgtcttcctcctcctccttctcttcctcctactccgctgctggcgcttggacggatgatcactccgccaaaatggagaaagatcctagaaaaatcgccaggaggtatcagctggagctgtgcgagaaagcagtggaggagaacgttatcgtgtatttaggaactggttgtgggaagactcacattgctgtgatggttatatatgagcttggacctttgattctcagccctaggaagagtgtttgtatctttcttgctcccactgtggctttggttgaacagcaagcgttagtcatagcaaagtctatcaacttcaaagttgcaacacattgtggtggcaatcggactgtgactacccattctgactgggagagagaggtttcagagaatgaggttctcgttatgaccccacaaatacttctgcataacttacagcactgtttcatcaggatggagtggatttcccttctaatattggatgagtgtcaccatgctcaagaacaaagcaaccatccttatgcacaaatcttgaaggttttctataaaacagaaggtgtaaaaggacctcgtatatttggaatgactgcatctccagtggttggcaaagggtcttttcaatcagagaatttatcgaaaagcataaatagccttgaaaatttgctcaatgccaaggtttactcagtggaaagcaatgtccagctggatggttttgtttcatctcctatagtcaaagtatattattatcagacagctgggactgaagcatctcaatcgaccaacatatatgaaaacatgctggaggacatcaaacagcggtgtttgacatcacttaagcagcagattgataaccatcaaacacaggtcctcttaaatatgaaaaagcttctgaaaagaactcatgataatctcatatatagtctggtgaatcttggcctttggggagcaatacaggctgctagaatccaactgaacactgaccgcaatgtacatcaagagcctttggaagagaataataagtcaaagatatgtattacatatctctctctggctgccgaagtcctttcttctaaagttgctaaagatgagaatgcatctgaacttatcagcttaccagcgttgaaggaaccatttttctcaagaaagctattacaactgattaaaatcctttcggcattcaggatagagccacacatgaagtgtataatatttgtcaatcggattgtgactgcgaggacgctgtcatgcatactaaatagtttgaaacttctagagtcttggaagtctgatttccttgttggacttagttctggagtgaagagcatgtcaagaaagagtatgaagacaattcttgaacggttccaatccaaagagctcaatctactggttgccactaaagttggcgaagaaggtcttgatattcagacatgctgtcttgtgatccgttttgatttgccggagactgttaccagcttcatacagtccagaggccgtgctcgaatgcccaagtctgaatacgcgtttctagtggacaggggaagcgagaaagagatggatctgattgaaaattttaaagtaaatgaagatcgaatgaacctggaaattacttccagaacgtcagaggaaacttgtcctagacttgatgatgaggtatacagagttcatgagacaggagcttgtatcagtggtggaagtagcatctcccttctctataagtattgttctaggcttccacatgatgaattttttcagcccaagccggagtttcaattcaaacctgttgacgagtttggtggaacgatctgtcgcataactttacctgctaatgctcctataagtgagatcgtcagttcactactaccttcgattgaagctgctaaaaagaatgcttgtctaaaggctgtctataagttgcacagcttaggtgtacttaacaattttctgttgccggattcaaatgaagaaactgaggacgagttgtcagatgaagaatttgactttgataaagttgaaggtgaagcctgttcacgaggtgaactgtatgagatgattgttcctgacttgtttaaacaaaagtgggatccatcaaagagttgtgtcaatcttcaatcttactacataaggtttgtgcctcatcccgccgataggatctacaagaagtttggtctcttcatgaagtcacctcttcccattgaggctgagactatggattttgatcttcaccttgctcatcaaagatctgtaagtgtgaagatttttccaaaaggagacgccaatttcgacaatgatgagataaggctagcggagcgtttccaggaggttgccctgaaaattatttttgaacggcgggagctaattacggaatttgttcccttggggctgcaagactcttttagaactagcaaatctaccttctaccttcttcttccaattaatctggatgcttcagaaagtgttttatttgttgattgggcgactattagaagctgcttgtcgtccccaatcttcaaggctccgtctggcttagtagaagatatggatcctcctgtgggatctcatttaaagcttgcaaatggctgctggagtattgatgatgtgaagaacagtgtggttttcgcaacccacaaaaagcaattttattttgtctcggatatctgccatggaagaaatggattcagtgctattagaaaatcaatcaccgaaacccatctggaaagcatatataattcgtatggcgtgaaactcaagcatcctttacagccactcttgcgtttgaaaccgctttgttatgttcggaacttgcttcacaaccgaaagcgggagaatttggaaccaaatgaacttgaggaatatttcatagaaattcctccagagctttctcagttaaagataaaaggattatctaaagacattggaagttcgttatccttgctaccatcagtcatgcaccgtatggagaatttactcgtggctatcgaactgaaacacatgctgtctgcctctatccctgagatagctgaagtttctggtcacagagtactcgaggcgctcacaacagagaaatgtcaggagcgcttttctcttgaaaggcatgcggtgcttggggatgcattcctcaagtttgctgttagccgacacctgtttctacaccatgataggcttgatgaaggagagttgactcggagacgctcaaatgctgtgaacaattccaacctgtttaggcttgcaaccaggagaaatttgcaggtttacatccgtgatcaagcattcgatcctacacagttctttgcattgggccatccatgcagagtaacgtgtgacgaggtagcaatgaaagaggttcattccttggataaggttcctgggcttttggaatcaagtactggtgaaatcagatgtagcaaaggccatcactggttgcacaagaaaacaattgctgatgtggttgaggctcttgtcggagcattcttagttgacagtggcttcaagggggccattgaatttcttaaatggattggcataaatgttgattttgagtcattgcaagtaagagatgcttgtgttgcaagcaagcggtacatgccactgactacttgctttgatttggcggcccttgaaagcctgcttggatataagtttctccacaaaggtctacttttacaagccttcatccatccatcttacaacaggcatggaggaggctgctaccagagattggagtttcttggggatgctgttctggactacttgatgacatcctattttttctcagtctttccgaaactgaaacctggtcaactgaccgatctaagatcgctctcagtaaataataaggcgcttgcaaatgttgctgtcagtttttcactacagaggtttctattttgcgattctacatatctccatgatgctataaaggattataccaacttcgtgacagcatcaccattggccagcggaccatctgaaggtccaaaatgcccaaaggttcttggtgacttgatagaatcctttttgggggctcttttcctcgactgtgggttcgacttgaatcatgtctggagaataatgctatcttttttagatccagtgaaaaacttgtctaacctgcagcttagtcctgtgaaagaactgcttgaatattgccagtcttacaagtgggatcaggagatatcagcgacaaagaaggatggtgctttctctgttgaattaaaagtgaccaagaaaagttcttgccttacagcttctgcaactggtcggaacaaaaaagagagtaccaaaaaggctgctcagctgatgcttacgaacctgaaggctcatgggcatataaaaacctccaatccgttggaggatgttctgaagaatagcatccgaaatgaagctaaattgattggctacgatgaagagcctatagatgttgtggatcgtgatgggctggacgttgaaaacctaaatatccaagattcttttgaggaggatcctgtcactgaaagcaagactagtgaaacaagcagctcatacatcatcagacgagttctcaccaatgcaccaccatctgaaaaagaagaaagccttcctcaaaagaccatcaaagacgcaggtgggtcgatcatcaaaactgcaaaatctctcttgcgcgaaacatgtgttgccaactgttggaagacaccagagttcgtatgttgtgaggaagggccagcccacctgaaaacgttcagctataaggtaatcctggaggttgtagatgcccccaatatgacactggagtgttatggtgaagctaaaccaactaagaaaagtgcatcagaacaggctgctcaagctgctttatggtgtctcgagcatactggattccttcgccgatga

SEQ ID NO: 332 - DNA, 3333 bp, Brassica rapa
atggggaaaacgattcaagtgtttggtttccctaacggcgtgagcgcagaggaagtcaaaaacttcctcgaaagactcactggcccaggcacggtctacgcaatcaaagtcagacaaccgaaaaaaggcggtcctagagtctacgccatcgttcagttcacatccgagagactcgctaggcatatcgtcactctagccagccagcgtctcgactacggaagatcttacctcaaggccttcgaagtcgaacaagacatcgtccccaaacctagagcttcgttgcacaacatgccgaatttaaaaatgtacttcggatgccaagtctctcccatgaagctttccgttttctggagtgctcaaaacgtcgccgtatcgtacggaacggggatgcggaaattccacttctcattgtcttggtgcgagaaagagtatcgcctcgagcttccttacgaaaacatatggcatatcgatttgcatttccctcaaggacgtagagactccaagtttcttgtgattcaggtcattggtgctccgaagatcttcgagaaagaagatcaacctgttaacctcttgttcgggttgctagacttctaccgcgacgggtccgacgagcagtggataagaactacagacttcacttcctcttcatgtataagccaatcatcagccttctgtttagagcttcccgttcatctcaacgtctctgacttcagagagaacttcgccaactacgcggaacacgaagacagcactttcgccctcgaatccgggcgtagcttctcatcaaacgcgaacaaactcgtccctgttgttgaccctcctccagggtgttacctccctttcgagatcttgttcaaagtcaacacactggtccaaaacgcgtgcatcccagggccagctctcgatcccgccttctatcagctccttaacccgcagagattcgatagagctctcatagaccactgcctcgagaagctttttcaccttcccgaatgttgctacgctcctgctcgttggctacgcgaagagtactcaacatgggtaacgaaagggaagcttccacagtctcctatgatatctctagacgatggactcgtgtatatgtatcgggttcaagtcacgcctacaagagtctatttctctggccccgaggtgaacgtttcgaaccgcgtgctacgtcactactcagactacatcaacaacttcctcaggatctcgtttgttgacgaagatcttgagaaagttcgctccatggatctctctccacgctcctctaccgtgaaaagaacaaagttatacgagaggattaactctgttcttagggacgggatcgtcatcggtgataagaggttcgagtttctcgcattctcttcctcccagctgagggagaactccgcgtggatgttcgcgccggtcaacgggatcacagcagctaacatcagagcttggatgggggatttcgacaatatacgaaacgtggctaaatacgctgcgaggctaggccagtcgtttagctcgtcgagggagacgcttactgttaggagagatgagattgaagtgattcccgatgtcgagatcagatattctgacgttcactatgtgttttccgacggaatagggaagatctcagctgagttcgctagacgcgtagctaagaaatgcggcttgacggagtttttcccgtctgcttatcaaatccgttacggcgggtataaaggagtggtggctgttgatccgaactcctcgaagaaactgtctttgaggaagagtatgagcaagttcgagtcggagaacacaaagctggatgtgttggcgtggagtaagtaccaaccttgttatatgaacagacagctgatcacgctgttgtctactctcggagtcgaagacaatgtcttcgagaagaaacaaagagaagttgtgaaccagctcgacgcgatcttaaccgatcctcttgaggcttttgaggctctcggtatgatggctccaggggagaacacgaagattctcaaggagctgatcttgtgtggttacaaacccgacgccgagcctttcctctcgatgatgcttcagaatttcagagcgtcgaaactgttggaactgcggaccaaaactcgggttttcattcctcgcggaagatcgatgatgggatgccttgatgagaccagaacgcttgaatacggtcaagtggtggtgcagtatacggatcccactaggccgggaagtaaatacatcgtcacgggacttgttgtggttgcgaaaaacccgtgtctgcatcccggtgacgtgcgtgttcttcaagctgtcaacgtcccagctttgagtcacatggtggattgtgttgttttcccgcagaagggcccgcggccacatccgaatgagtgttccgggagtgatttagatggagatatatactttgtatgttgggatcctgaactcattccacaaggaacgtctaacccaatggactacactcctgaaccagctcaaatcttggatcatgatgtcactattgaggaaattgaagagtatttcacgaactacattgtgaatgatagtcttggaatcatcgcaaatgctcataccgctttcgccgataaggaacctctcaaagcattcagtgacccgtgcattgagcttgcacgaaagttctctatcgctgttgatttcccaaaaacaggtgttgcagctgagatacctcagcatctttacgtgaaagagtatccagattttatggagaagccagataaaccaacgtacgagtcgaaaaacgtgattggtaagcttttcagagaggtgaaagagcgagctcctccgttgatctcgatcaaatcgtttactcttgatgtggcctccaagtcttatgacaaagacatggaagtcaacggattcgaggagtatgttgaccaagctttcttccacaagggaaattatgattacaaattaggtaatttgatggattactatgggattaagacagaggctgagatacttagtggcggtatcatgaggatgtcgaagtcattcaccaagagacgggacgcggaatctattggaagggcggttcggtcgcttaggaaagaagctttgtcgtggttcaatgcttctgaagatgaagaagaggtggttaatgaatctgcaaaggcctcggcttggtatcatgtgacgtaccaccgaagttactggggagtttataatgagggtttgaaccgtgaccatttcttgagctttgcgtggtgcgtttatgataagcttgtgaggattaagaaggctaatgttgggaggcgtcagcggcaggagactcttgagcggttaggcctcatgcgtttgagttga

SEQ ID NO: 333 - DNA, 6124 bp, Brassica rapa
ttatatgcttagacatatatccataacttgtgtaaatgtacgtgtcgattaatgcgcgcatttaattttattacggacacgtcggacagtttgtctaccactactaccaataagaaaaaaaacatcgaatttaaaaattcaaaataatcgtagcgggatataaaaactctttccaagaaaaagtctacggaataaagacactcttaacgaacgatcaggatcgtatatcctggaacgtctttaaacaaaatcccttaaacgaacggttatgattgtaagagcagattcacttaaaaataaatctatatagactaacgagcggtcaagatcatagctcaagaaaagtcaataagtaaagtaaacgaatcgaacggttaacattataagagcaggttactgttatatgcaccgcatagtagaggaatataaccgtagggcgaaggatccatcctggatatattccactgtttactgatcaatttaacccattttagctcagagcagaaagggaaaaagaaagagaatctcagaaactaatctctcgtctcgtcttagggtttcgcgttcgtttcatcgatacactcagaggtatgatgattttagggtttcgcaaatgtttcttctgtttaagacttgtgtggattttttttaaatccgtagggtttatgctttctagctttctagcttcgtaatgtggcttctgtgtttgtgcttttttagaagtaaagtgtttttttttccgataaagcttgagactttgtctatcgtcgcatgcattgttcttatgggttattttgttccctgaaatcttaaaaaggttgttgctttactgtgatctctgattttgtgaaaattttactgaggtttccgtttaaaaaattaacctttctgggtttttacatgttgaacaaagccgtaaatgttcttagaaagtgattgtattttgctagtatgtgatgaaagcttgcatctttttgtttttttgttgcgtcatcctttataaagttcaccactctgtttgtgtgtttatttactaaagtgagttttttttgctgatgtttgcttgaaatatgtcatctttttgggttctttattaaaataaacatgtgaatgttctcagcgtgactgtgtttagctaatatgtgatgaaagctgacttctttgggggttcttacatgtttatttacacctgcatgcttttttcaaaatttttgttgggtggtttttagttttagtcaaagattttacttctctgtgggttcttgtgaatgaaagttggaaactttgttagaactagaagctaaaatcttaaaaaggttgttactttactctgtgatctctgtttttgtgggtttcctttgcaaatgtgaaaactttactgaggtttccgtaaaaaaaattcacctttcttggttttctatgttgaactaatctgtaaatgttctcaacgatgaaaactgagtttttttttgttgttgttgttgtttgtgtgtgtagaacatggatgctactaccggtaatggagctgagctcgagtcagcaaatgggagtggggtttccgacgcgctgcctcctcctccaccggtcataccgcccaacgtggagcctgtgagggttcaaaccgaagttgctgtgaagaagaacctaagagtacctatggctcgtccaggctttggatcaaagggtcaaaagattcagcttttgactaatcacttcggagtcaaagttgcaaatcttcagggattcttctaccactacagtgtatgtcttcttgctactgtcatgtttattcaatctgttttgttttcagtgatgttaaccaatagaattatttgttgtcttgaacaggtggcgctcttctatgatgatgggcgtcctgttgagcagaaaggggttggaaggaaagttcttgacaaggttcatgagacgtaccactcggatcttgatggcaagcagttcgcctacgatggagagaagacgctgttcacttttggagctttgcccagcaacaaaatggatttctccgtggtccttgaggaagtttcttccgccaggtaaaaaagatatcatcacattgttccttcacttgagtgcttgagttatgattcttactgacaatgttttatgagcaggactaatggaaacgcaagccccaatgggaatgaagagccaagtgacggtgatagaaaaagacttcgtcagcctaaccgttccaagagcttcagagtcgagatcagttacgcagcaaaaattcctctccaagctcttgctaacgctatgcgtgggcaagaatccgagaattcacaggaggcaataagggtgttggacatcatccttcgacagcatgctgctagacagtaagtgtatatgtttcattttcatgatcctaatatcttttgtgttgtctctctaattaatttctgggaaaactgcagaggttgcctgcttgtgagacagtccttcttccacaatgacccgagcaactgtgaacctgttggtggtaacatcttgggatgtagagggttccattcgagtttccggacaacacaaggtggaatgtcactcaacatgggtaagtagtttcacctgttcgtcgtgtttcctttctgttgcagcaacagtatagtgtctgatgtcttttgtttgttcttatgccagatgttacaaccactatgataatcaagcctggtccgcttgttgactttgtcattgctaaccaaggtgcaaaggatccctttacggttgactggtctaaggtaatctactaaacgtggctatgtcattttcttagcaggttccttgctttttttttttttttagctcaacacgttttgacttgatgttttaaataggctaaaagaacacttaagaatctgaggattaaagtcagcccctcaaaccaggagtacaggatcactggcatgagtgacaagccttgcagggaacaaacgtaagatgccattctctcaaaatcactttgtatttgcttatgtcttactttgctgacattgtgtgatccctttcaaagttagaaaggtctctctgatgtttgcttgttaccgttgtgtaggtttgagtatagaccaaggaacgcacccaagaatgagaatggagagtctgaaaccgttgaaataacggtgtatgactacttcctcagagaacggaacctagagttgcagtactctgcggatttgccttgcgtcaatgttgggaggccaaagcgacccacctatatcccccttgaggtttccctcttttttttttctcatagtattcacttgttttatgttctcgaagtccatcctaaaatgtttgttattttgtggaactttttgcagcactgcacattgattccccttcagaggtacacaaaggctctgaacactttccaaagatctgccctggttgagaaatctagacagaagccgcaagagaggatgaatgttctgtcaaaggtacagtgtctttactctctcatagttgttatgttttatcagtcaagaggattggaatttttatatttatatttggtttaatgttttcaggcgctgaaagtgagcaactatgacgctgaacctctcctgcgttcatgtgggatttctatcagctccaactttactcaggtggagggtcgtgttctgccagctcccaaggtatggtacagttacttagttttgacttgaataattgtctttaatgtcctctttgttttcttttcagctgaaaatgggacgtggagatgaactgtttccgagaaatggtcgctggaatttcaacaacaaggtgctgtgtcttgtctgtctctctttgtatttactttttcatgtaagaaagatgttctgattccctcttttttgttgttgcagcaatttgtggagccaaccaagattgataaatgggctgtagcaaatttctctgctcgctgtaacgtgcgtcaactggttgatgatctaatccgaattggtggaatgaaaggaattgtaagcatgattcttttttcttcatgtttcttggaaacttgttttgtaatcatcatcatcaccatttgtattaaactgctttctgtcacaggaaattgctgccccatttgatgtgtttgaggagggtcatcagtttcgccgtgctcctcctatgattcgtgtagagaagatgtttgaagagatccagtctaagctccctggtgctcctcagttccttctgtgtctcctccccgaaaggaagaactgcgacatctacggttagatattatctctcaactcaagttctttaggttgttaaatgttccttttgattaaaatttgaatttgctactcctcagggccatggaagaagaaaaacttaactgaatacggcatcgttacacaatgcatggctccggtgaggcagcctaatgatcagtatcttaccaactgtcttctgaagatcaatgcaaaggtgatctctgtctttctttttttcctttgtaccaatcgttcattttgcttcttgtatacaatctctgatgcatatactctacagcttggtggcctcaactccatgttgagtgtggagcgtactccagcctttaccgtcatttccaaggttccaaccatcatccttgggatggatgtttcacatggatctcctggacagtctgatgttccctccattgctgcggtaatacattttactctttactatatatattgtttgcttttgcataaaccttttgatttgtgctctttctttgatgctgatgtcttgtgtatggtttttacataggtggtgagttcaaggcagtggcctctagtctcgaaatacagagcatctgtacgcacacagccttcaaaggctgagatgattgagtcactcgtcaagaaaaatggaactgaagatgatggcataatcaagtacttatacaccaactctctctgtgccttgttcttgctcttccttttgtttaagtacttaatgtaatttcattttgttgatttgcagggagttgctggtagatttctacaccagctcgggtaagagaaagccagagcatatcataatcttcaggtaatttactttgttacatcagaacttgtatctttatattcttccgttccgtatgtttctcatatgtgattgtttaaatgtctcaatacttctagggatggtgttagtgaatctcagttcaaccaggttctgaacattgagctcgatcagatcattgaggtaactgaatcatacagaaacagtttcgtattgtttttcaactgttaggaatttgattgcttctgtctttttcccaggcctgcaagcttctagatgagaactggaacccaaagttcctcttgttggtggctcagaagaatcaccacaccaagtttttccagccaaactctcctgacaacgttcccccaggtgattttgattataacctttttttttaaaacacgtacataacatgcatgatctcatgttgtgtttgtttctgtagggactatcatcgacaacaaaatctgccacccaaagaacaacgacttctatctctgtgcccacgctgggatgattgtaagtattatctcaactcttagaaagctacgtttgttgttgattgccactattgttttgtttcttacgacacttgtgtgtatttgaattagggaacaacacgtcctacgcattaccacgtcctgtatgatgagattcatttctcacctgatgagcttcaagagctcgtccactcgctctcttacgtgtatgtagtagtttcaacctttttctaactcttatggcttctattgtgttttgattacattttgaacagatttgtttcgttgttcgatattttgcaggtaccaaagaagcacaaccgccatctctgttggtaatttaaacccatattattttctgtgtttgacatttgaaagtctctggttgtctgtttaataaccgagacatttgtggttcttatgcagttgcaccgatctgctatgcgcacttggcagctgctcagctaggaacgttcatgaagtttgaagatcagtctgagacgtcctcgagccatggtggcgtgacagctccaggaccagtctctgttgcgcagctccctaaactcaaagacaacgtcgccaactccatgttcttctgttag

SEQ ID NO: 334 - DNA, 6126 bp, Brassica rapa
gacatttttttgcttttctaaataaaaccataaacttttcagatcgatgtgttgtaaatatagctttgaggcaaaggagaccatcaacaaaacattaataaagggacaacatgatctctacctatttctcaaattcaaaattttatagattctttataataaatttatcaaatgatatcatatattatataaacttaaaaggaaaattatagaaccacactatccgcgcgtagcgcggacacggacctagtaaccataaaagaagagtccaaaggtatatgaaacgagttggagaaaaaaaaagtggagaaaatatatactaatatgtgttatttgatgatgttatatgcatggggtacctaccgttatatccagtaacggaagctaaaccaaacactacactcgtatcacacgttcatccagttaacgaggataatatagttcttttaatttgacctggaaaaatctgatttgttattatatacatagaatagtttctctatggtatgtgtaacgaacgtgcatatatttgattccttaattaagctaagcgctagtaagctcagcaaattatttataacaataaatgcaaaagtaattaacttttttccttccttaacaatagaaaaagtaaacacgtgaggggaggagaaacggatatcaaacaataggacaaaggaaacgaaaagaataaaaatataataatccaggaatataggggccaaattaataataacgataagtgggacccacattattacttgttttgagtctgcttctttaaaacaaagcgtaggagagaagaagctgcaggctctcgcaaaccacccccaaatcaaaccgcagaaacctctctttctctctcgccgtagctctagcgtctagggtttattctccgtctcgtcttcgccgtttcttattagctaaaggtacagactttcttagtcaaaatcttttctaatgtctttctcccatgcatacccactgtttagcccttcgggttttgctcttaacgatttcgtgtgtacggcttcttagtcttcgtgtttcttctgctgctgatgttgtgaatcgctctaaagttgtgatttttcttagtgggtttttcatggggttttagggtttttgtcacagttatcttccatctgcacgtagatctatccctcggttcatggtttctatgttgtttctgctcttaataatctgttcttatatcttacctgctgtaagttgaactttgggttttttttgtgggtttctatttttgtcacgtagatctcttctttgatgtgttctggttatcacaatctgttgaaaagtttaaaacttttttcatatcttgagatgggtttcttttgttttcacttgtcatctagccgcttgatgtgtatatgacgctaaaagtgttcgttttatttttcttggaaaaaaagtttgtaatgttgctttttccatttatcttatatgttttgggtcttgtcttgtttgtgccttgcagatatgggttctgatgaagataaagcgctaccgcttcctccacctgtccttcctccaaaccttcttcccgaggtggagtccatcaagaagaacactctccttccgatggcccggcgtggcactgggtccaaaggacagaggattcctcttctcaccaatcacttcaaagtgaacttcaacaacgccaacggccagttcttccattacagtgtaatgcttcctgtctcctcctctaatgtattatttgtctcgctctaatggttcaatgcttttaacatacttgttttgtctcctctgtgattgttggatgcaggttgctataacgtatgaagatggccgtccggtggaagctaaaggtatcggtaggaagatccttgacaaggttcagcagacctataaaactgacttgggatccaagtactttgcatatgatggcgagaagactctcttcaccgttggtcctcttcccagcaacaaacttgacttctctgtcgttcttgaagacgctccttctagcaggttcgagacttcaaactccttttaacatatattcactgctttataaagatgtgatgataatatactttttatctggcaggaacaacactggaaacggtagcccgaatgagtctaatgacgctgacaggaaacgatcaaagaggcccaatcagtccaagaagttcatggtggagataagctatgcggctaagatacccatgcacgctattgcagccgctctccaagggaaggaaacggacagccttcaagatgcgatcagagtgcttgacgtcattctcagacagagtgcagctagacagtaagcttatttctcaacttctttctttattacaaccttcgttttcctgattggtgtaattcacatcttctgacttttgttttttgcagaggttgtctcctagttcggcagtcgttcttccataatgacgcccagaactttgtaccaatcggtgcaggtgttgttggtgtcagagggttccattcaagcttccgaacaactcagggaggcttgtccttgaacataggtaatcttatcttgaatttaatgtttgttaaagtcttttgggttgtaacactttggtttcttgattgtgtagacacttcaactaccatggttgtacaacctggccctgtggttgattttctcctggcgaatcagaatgtgaaagacccctactctgttgactggaacaaggtacatcgtccgcttcatttgtgctattgaatttctacagatgagaagtacttatctggttttctctcttatcaggctagacgtgttctcaagaatctcagagtcaaggttgctccctcaaaccgagagtacaagattagtggacttagtgaaaatcgctgcaaagagcaaatgtatgtcaagtgtatatcttttttatcacatgttgaagtcgctttgagaagtttctaacaggtctgtctttggttgatacaggttctctcggaattccaagaacgatatgggcgaagttgtggagcatcagacgactgtgtttgagtatttcaccgagttccgtaacatccaactgcagtactctggtgacttcccttgcatcaacgttggcaagccaaagcgccctacttacatccccattgaggtaactctagttcattgttgttccttcttttaccggattatgcttgtacggttcatgacagttcttgttgggttttttttttcagcactgtgagcttgtgagtctccagcgctacacaaagtcacttaccaatcttcagagggcttccctggttgaaaagtctaggcagaagccactggaaaggatgacatctctaaccactgtaggtcttctgtccattatcctttgagagtttttgaagttttttttctgtcaaattttgatttgtgatctgattcatcttgcagggtctgaagaacagcaactataatgctgacttggtgttgcaagagagtggtgtcagcatcggctctagcttcacccacgtggagggccgcatcttacaagcaccaaaggtgacttaccctttttctatacttgttgtgtatcttttcatgtcttaatctggaagtttaatgtaaatatctttccttgtttccaaacagctgagagtgggcaatggagaggactttcaacctcgcaatgggcgttggaacttcaacaataaggtggatggactttattaaattttcagttagataaatgtttcaacctctaatactaacattgaatctctttgcagaaactggttgagccaaccactgtcactaggtgggctgtggtgaacttctccgctcgctgtgacacaaaccggctcattccggacttgattcgctgcggcaacatgaaaggcattgtaagggatcattgattactatatttaactcagtcatatgcaccagttactaattcctcccttgtttttgttcttccttcagaacgtggagcctccttacgaagtggtctttcaagaaaatgctcagttcaggagtgcaccacctcacatcagagttgaaaagatgttcgagcagatacagtctaagctcccggggaagcctaagttccttctttgcatcctcgcagaaaggaagaactctaacgtttatggtaaaagcattctaccattaaataagagagactagtggcatcgtatcttgattctcacataatcgtctgtgtttttttcaggtccttggaagaagaagaaccttgctgagcttggaatcgtgactcagtgcattgcgcccaccgccagaatcaatgatcagtacctcaccaacgttctcctgaagatcaacgccaaggtgatctcctaaagcttgaaatttcaatcagttataatttaagataaagattataaagaccttaaagcttgaactgacttcactgtttcctatatgtagctcggtggtctaaactcactgctaactatggagcgctcacaggcaatgccgtcagttacgcaagttcctacaatcattgtcggcatggatgtttcccatggttcccctggccagtctgatgtgccatctgttgctgcggtaagattacattttgttttctgttgattgtgagttcactcttctatctctctagtaacttgatgtttgtttgtttggaaacaataggtggtgagctccaggcaatggccactcatctcaaagtacagggcatgtgtgcgcacacagtctcgtaaagtggaaatgatcgacaaccttttcaagcttgtccctggcaaagaagagaagatggttgacgagggaattttcaggtcagtttcttggattgttgtgctgtcttagtagtagctcgtgacatggcatcaatgtaactacggattttgtgctcttttcagggagctcttggtcgacttttactccagctcccagaagaggaaaccagaccacatcatcattttcagggatggtgtgagtgagtcccagttcaaccaggttctgaacatcgagttggatcagatgatgcaggtatggatgatgattcttgagcctcattgaccttagtatacagttgaatatttatggacctgtttttcttgtgggttatgctaataggcatgcaagtttctcgatgaaaaattgaaccccaagtttacagtgatcattgctcagaagaaccaccacaccaagttcttccaggataaaggaccagacaatgttcctccaggtataatccatttgacctgagcatgattgatcttatgcatgattgatcttatcttgtaaatgagttctgaaacctgtttctaactgacctgcagggactatcattgacagcaagatctgtcaccctcggaacaacgacttctacctctgcgctcatgcggggatgattgtaagtaacatgcctcatcggttggtttttcctttgtattgatgaattgaacgaaagcttgatactggtctgttgatttcgaatgtattagggaactacaaggccaacacactaccatgtgctgtacgatgagatcaactttaccacagatgacctccaggaacttgtgcattcgctgtcatatgtgtaagcattatatcacttttctagctctctatctgaaacatttgtttgtggtgtgttgccgatgtatactaaacttgtgtggtttgatacttgtagctaccagaggagcaccactgccatctcagtcggtaagctctcatatctttttctcgattgctgctgatagtttagatctctggcatgtaatgtctttggcctccattgattgctgctgatagttaagatctttggcatgtaattgctgtgtctctgctcatctatagttgttttttgaactttatgatgtctagtattagtgagaatgaaccacaactaattttactgcgttcttacctgcaataatctgaatgcatgatggttgcgcaagtatctcaagtttccttgtgtcttttctgcagttgcaccgatttgttatgctcacttggcggctgcacagatgggaactgtgatgaagtttgaggacttgtctttgtctgagacatcatcgagccatggcgggatcacgactcctggggcagtgcctgtgccacccatgccaaagttgaacccggaggttgcaagttccatgttcttctgctga

SEQ ID NO: 335 - DNA, 6130 bp, Brassica rapa
ccattttcaaagtaaagtaatagtaatatatgtggcaaagataaaaaaggaaatccaaaggaggaaacacctaatttttattttttcttttattttttgattaagaacacatgattttcttctatttgagtctgcgtatatatagggtaggaccgtaggaagcgtgagactgcaccgcccataaacctttcgtttccaaacacccttctctttatccgttgctctaggggcttcttcgtcgtcatttcctctcttaatctcagtgaagcaggtatacttttctccctttaaatcgttcaatgcatgctaactatttagtatgattccatgcataaataaattaatgttggcgtatttttttttcagttataaaaaaaaaatttaaatgatgacaaaaggtatttaaattttccaagaaaaaagggtttagttctaggaaagtaaaatttgtctgaacaaattgtctggcttctgggaatgatatactccctctgttttattaagttagaggtttttaaaaaaaaaaattgtttcacaaggataatttttttgtattttctatgaaaaaaattgtgatcttcaaaaaaataattgtattaattaaattattattagttaaaaattattaaaaattaaaaataacagaaaacaatatatttattatagtgatttaatgtattttttaataggtgtgaaatcactaaaacatttgtctttgtgaaacggaaagagtatgttattagagtggtaaaatatctatatccgaagaatttaacggaattcaatctaaaaaagttataccaaaccaaaatggtataatgttcagaatgaattcaaaattttaatatctaaagaaacataataaaatccgatccgaaccaaaatatttgacatccaaaaatatacatgcttaaatatattaattatttaaatctaatatgcataaatattcaaaatatctaaaataattggagttatccaaaaaatctgaaaaatatccaaaattattcaaaatagccaaaaataaatattcgaaaataatcaaaaaatacttaaaacactcgaaatacataccggagagctctccggtaaaatatccaaatcaaaccaattttcatgtcaattgaggtatttagtaatacatattcaaacttacttgttgcatattactttaattttggattttaaagattcgaagtacatttgatttgttttttgttacataattttaatggataccttaacctgaacaaaacacgcaaaagttagaacgaatacaaaccgaacccgaatcaacgtatgtagatacccaaaaaggcttaaatttataatcattgaaaatctaaaacatgaatataaatctgaaccgaacctgaacagctgaactgataccgaactcctaaaagtacatgttgtgttcatgcttttaccattaccataaaaaatgtacgttgattctgtcgtcatttcttctgaccttctgattattttcatgcagatatggattctcatgaagcaaaacggctaccacctcccccaccggtagttccaccaaaccttgtgcctgaacgagagcctatcaaaaagaccacccttcttccaatggctcggcgtggcatcgggtccgaaggagtgaggacacctcttcttaccaatcacttcagagtcaacttcaacaacgcaaatggccacttctatcattacagtgtatgtgcacgttttcctctagtattctatttgtatcactgttttctttctgcttataaatgttcattgctttaaagtacttgcttggtatgatccttggatacaggttactattacatatgaagatgggagtccaatggaggctataggtgtttttaggaagattcttgaaaaggtccaggaaacgtatcgaacagatttaggatctaaatactttgcttatgatggccataagaatctgttcaccattggtgctcttcctagcaacaaaatggatttcttagtcgttctagaaaacacaccttctagcaggtccagtttggttttaaaacatatttaccatgttgttatcaagtttaagatgagttgataatattctctttatctacagaaacaacactggaaatgctagcccaaatgacgcggacaggaaaagatcaaggctgccacaccgatccaagaagttcatggttgagataagctatgctgcaaggatccccatgcaagctattgcaagcgctattcgaggaaaggaaacagataatattcaagatgctacaagagtgttggatgtcattttgcatcagaatgcagctaggcagtaagttgatttgtggaatgtctttcagaaacattcattctctgcctggtcttttatacatgttctaacttctctctgcagaggttgcctacttgttcgccaatcattttttcataacgatgctcggaactatataaacattggtggaggtgtatttggtgctagagggttccacacaagcttcagaactactcaaagaggcttatccttgaacatcggtaattcgtttttaaacttaatgtgtaattagactcttctttgtaacatttttggctattaacacttgtttttttagatttttcttttctttagacacttcaactacaatggtagtacaaccaggccctgttattgattttcttcttgcaaatcagaatgtgaatgacccaaagtatctcgactggaataatgtacaccatcttattgctgtaacatttaaccgatgttttactatctttgggaagtggaattatctgatttttccctcatcaggctaggcgtgctcttaagaatctgagagttaaggttgtcccctcaaatagagagtgcaagataactggactaagtgaagagcgctgcaaatatcaaatgtatgtagtgatttgatgtttttttttattacatgtttacatctctttgagttctttccaacatatctttctttaattgatataggtttactatgaattctaaaaacgagaagggggatgttcagattacggtgtacaattacttcaccgagattcgcggtctcaaactgcgatattcaggtgactttccttgcatcaatgttggtaaggcaaatcgcccaaattacatccccattgaggtaactttactacattgttgttttcttctttttgtactcatgaaattttcatgcacactcttatgctttttgtttaaaaaatatatatttttagcactgtgaacttgtgagtctacagcgttacacaaaatcgcttagtagttttcagaaggcttctctggtagaaaattctaggcagagtccacctgaaagaatggcttcactaaccaatgtaggtcttctttttttccattatccatgagacttcgaatttttctgtctagtttaatttggtttatgttattcatcttgaagagtatgaagaagagcaactataacgctgaccttgtgttgcaagaaagtggtgtcagcattggctctagcttcatccaagtggagggtcgcgttttaccagcgccaagggtatggcttaccttgcttctcttgcaagtatcatttcctttttgagtcttgaaggttaaatgttaattattagttcttgttttcaaacagctgagaataggcaatggagaggagtttcaacctcgcaatgggcgttggaacttcaataaaaaggtgcatagataattcatcttttctgattactatttcaagctatgatactaattgtatttctttttttcagaaacttgttgagccagtcacggttactagatgggttgttgtgaacttctctgctgaatgtgatacagataggataatttctgacttgattagatgtggacagatgaaaggaatggtaggctttcttttgaatcattacttgactattcagaaactcaatcatatgcactactactctttatcatccttcccttattatttgttttttttctttcagaacgtagaacctccatacaaagtcgtatttcaagaagatcctaattataggggtgcaccagccaatatcagagtagaaaagatgtttgagcagatccaatctgaactcagaaaagaaggaaagccaaaattcattctttgcattcttgccgaaaagaaaaactctcttgtttatggtataactgtattctactattcttgaatatggtctctcttttttttcttttgatgaactaatgaatgtaaatgtgaaacttgtctctcaatgttccagggccttggaagaagaagaatcttattgaacatggaattgttactcagtgtattgctcctccaaaaaacgtaaaagatcaatatatcaccaatgttcttctcaagataaatgccaaggtggttactgaacattgaactttcagtcatttaaaatttcaagattgattataaagactttacaaactctatttcgtatatgcgcagcttggtggactgaactccctgttagctatggaacgctcacgagcaatgatgcatttagtaacgcaagttcctaccttcattgttgggatggatgtatcccatggttcccctaaccaggccgacataccatcaattgctgcggtaacattgtttctcgtttcttgtgatgtcatccatatatggagagtttaagtctaaagtcttgtatatgtttgtgtgttttgaaaccataggttgtgggctccagagaatggcctctcatctcaaaatatagggcttgtgtgcgcacacagtctcggaaaatggaaatgattgataatctcttcaaacttgtccccaacgaaaagggaaaactagtagatgaaggaattttctggtttgactactctcgtgttgtgttcatagcttgtggcagtggcttttgtcatattaatgagaaactttatgcgcttttcagggagctcttgttcgacttttacacaagctcggggaagaggagacctgaacacattatcattttcaggtatagtgacatttattaaggtatcatgtgaaagtagtataatacatttttgttaacttttggttattaatgttatatgtagggatggtgtgagtgattcacagttcaatcaagttctcaacattgaattggatcagattatgcaggtatggattatggtttgtttatttagtgtatggtcgacattttatggacttgatttattttcttggggttacattattaggcatgcaagtttgttgaagaaaattgggaacccaagttcacagtgatcattgcccagaagaaccatcacaccaagttcttccaggatagaggcactgaaaatgttcttccaggtaagaatacatttgacctgagcatgattttcttttggccattgtggtttaaaatgagttgaaacatgttgcaggaacaatagttgacagcaggatctgtcacccacacaacaatgacttctatctctgtgcccatgctggattgattgtaagtaaatagttccttgtagtggaagtcttctgctcaaatccattatgaatggaatggaaaaaattctattgattttgatgttttagggaactacaaggccaacgcattaccatgtgctttatgatgagattagattttcgacagatgacctgcaagaacttgtgcattctctatcatatgtgtaagaattacatcactttttgtgttctttatgtgaaacatttgtttatgtaatgtctactaaacttgtctgctttggtaattgtagctaccagaggagcaccactgccatctctgtcggtaaattctcatatctttttaacgttacttgttgttttgactaatatcgttttcttcttaacatatggtggattactagtgacttcgctgctttcactatgtgcaataatcttaatgcatgatagttgcaatatgtgcaaatatctcaagtttcgttattgttttttttattgttgttgcagttgcacctatttgttatgctcatttggcggctgcacagatgggaactgtgatgaaatttgaggatatgtctctgtctgagagatcatcaatccatgatgggatcacgagatctggagaaccacctgtgccacccatgccaatgttgaactcggatgttgcaagctccatgttcttctgctaa

SEQ ID NO: 336 - DNA, 12604 bp, Brassica rapa
cacgtcaatgttcttctgttgaagcatataactattgactctagatcctaagcaacagaataaaaatcggtgttatgattttcgttttattaacatatttagcatcttgactctgcctttgctagcgctggttaatctatgtttcaataagtttgatttttaaaacttgagtttgcattttatcctaggaaaataattattctactgtcctttcttgaacgactttacaaaaatgacataagaactgattaatgaaacctaaaaaagttgtttatgaaaggtcatttcatagtaaaacaacgaaatactttgatataattttccaaaatttaagtattttgaaaacaaatcttacttttaagagtttgtaaactaactttttatgatccaaaatcatcaaaataccttgaataaatcaaacaaaataagctgcgccgatatactacaatctttggcatgatgagaactgcaatgaagtttcaggacatgtccgagacttcaacgagccatggctagaggtagcataacatctggagcagttcacatgcctcccatgctgaagctgtacaagaaagttactatttccatgtttttatgctgtacgaacgaaatttgacactaatttgactctgataaacattgttctccctgttttaataagataaatgttttagaattctcacagatgttaagaaaatatttgaaatttaaattataaatgctttactttatgtttaactatttcctataatgtagtcaatcaaaatacagtttaaaaaaaattactatgtatacagcattggaaatataaaaatattgatttttaacaaatttttttgaatatagatcattttgaaatgttgacaaaaaagatcattttgaaataaagggagaattatttatccaaatattaattttggttaattcaaaagtaatatcgagtagtaacacgtttcctcaggcagagtctataaaaagaggaaaatgaagaggtttgtccaacacgtttcctccagaaaaaaaaaaagaagaagttacaaatctctgtcttgttcactaaaaataagcataggtagcgcaacgactagtttggcttcgtcatcgcactcttcgtctcctcttacatactccgtatctttttttcctcaggcaagattttctcttcatctttgactattgttttattatgtaataaatcttcatgtttaactccacttcttgcttgttctatttcattttttcatgtttagattatatcagaatacgtttgatttattaaaatactattaaaaaagtttgcatccacttacataactcttttctttttctctggcaagttttttctcttcatcttgacaattctttttctgtcatatatcttcaagtttatctccattttcttgctttattcttgattaggtttcataaaaatgtgttttaaacttttaagttaatgaaatatgattaaaatgtgaccatgtgggtttaacgactccagaaatggatccgaacaagagtactcatcttcaaatggctcggagtggtaacggttctagaggacagaagatcgatctgcttactaaccactttggagtcaacttcaccacatcaaaaagtcaacatttcttccaatacagtgtaagcttattaatgtctttactttcatctctctctttttttgaaagtacttattacagtgggatgtgttggatacaggtcgctatcacatatgaagatgggaatccagttgaagccaagggtattggcagaaagattcttgcaaaagttcaagaaacttatcaaactgatttgggttccaaacactttgcttatgatggcgacaagattcttttcactgttggtcctcttcccaacaacaaactagacttctctgtcgttcttgaagacatgtcttgtaccagaagcaacaccagtaccagtgacgccaacacgaaaagattaaggcctcataatcaatccaaaagattcaatgttgcaatcagctttgctgcaaaaatctcaatgcaagctattcaaggtgctcttcaaggaaaggaaacaaatgatcttcaagatgctgtaagagtgttggatgttatcctgcgccagaatgcagctaccaagttagtatacattttcttgatttttttctttctttacatcttaatgtttttttatggtaaaatttatattttcatgttgttacttacataacttttttttttttttttttgcagaggttgtcttcttgtccgtcaatctttcttccacaatgacgcaaaatacttttcaaacaaccatggaggttttcatctatgcagaggattccattcaagcttcagagctactcagggaggcttatccctcaacattggtaactctttttttcattgtacagtttctaacgtcgaatccaaactcatctttctaacattttgttatttttcatcagatgtttcttctacattgatagtatcacctggtcctgttattgatttccttgttttaaatcaagaagtgagagatccatcctctatcgactggaaaaaggtacttacaagaacttcagtggtatgtttaaggttaagtacttatttgattatgttctcttgttaaggctgaacgtactctcaagaatcttagagttaaagtcgacccctcgaatcgagaatacaagataaccggactaactagacttccttgcagagaccaaacgtatgttctgaactaatatctttggatcatatgctttaaactgctttgatttggttataagttaccttttttttattttgcttaaggtttctttggaagaaaaagcaaggaaacggggaaactaaggaggttgaggttacagtgtatgattacttcactaaacatcttgaaattgaactgcgtcattcaggtggcttaccttgcatcagtgttggtaagccaaaacgtcctacttactttcccattgaggtaatattctgctttctttctttttttttgttctcatcacattttcattctttggtgataaaacttgtgtgttgtttttaaaacattttcagcaatgtcatcttgtttctcttcaacgctatacgaaagctcctacaatttttcagaggagtaaacttgtcaaagaatcagtacagaaaccacaagaaaagatgaatgtgttaaacaacgtaagggtctttaaaaatttcattcttcctcttttttttttccgttcttattctaatattcaagtttcattggcaggctattaaggacagtggttataataatgaccctatgttacaagactgtggtgtcagaattgactctgacttcactcaagtggaaggccgcgtcttaccaacaccaagggtatggcttaccttgcttctcttgcaagtaaacattgatcaagtaactccttttaaatcctgatgaataacgttaattatctgtccttgtttccaaacagctgaaagtaggcaatggagaggagtttcaacctcgcgatgggcgttggaacttcaataataaggtacataggttgattatcttttcctcagttgatgaatatggtaacctttgatactagttgaatctttctttttgcagaaacttgttgagccagctactgttactagatgggctgttgtgaacttctctgcacggtgtgatacaaaaaggcttatttctgacttgattagatgtggaaggatgaaaggaatcgtaagctctcttatatgtggatcattgcttgcctatataaacttaaatcatatatgcaatgcagcattctttttaattaattcttcccttattatttgttttttttttctttcagaacgtagatcctccatacaaagtcgtatttcaagaagatcctaattataggggtgcaccagccaacatcagagtagaaaagatgttcgagcagatgcaatctgaactcagaaaagaaggaatagaaggaaagccaaaattcattctttgcattcttgccgaaaagaaaaactctcttgtttatggtataactgtattctactattcttgaatatggtctctctttttttttttataaactaatgaatgtaaatgtaaaaaaaaattcttggaattttccagggccttggaagaggagaaatcttgttgaagaaggaattgtgacgcagtgtattgctcctacccccaaaataaatgatcagtatctcacaaatgttctcctcaagataaatgccaaggtgatcactgaaatttcaatcacttagaatttcaagattgattataaagacattacaagaactgatttctttatgtttgtatgcgcagcttggtggactgaactccctgttagctatggagcgctcaccacgagcatgatgcctttagtaacgcaagttcctaccttcattgttggcatggatgtatctcatggttcccctggccagtctgacataccatcaattgctgcggtaacattgttcctcgtttcgtatgatgtcatccatatatatagagagtttaagtctaaagtcttgtctatgcttgtgtgttttgaaaccataggttgtgggatccagagaatggccactcatctcaaaatatagggcatgtgtgcgcacacaatctcggaaagtggaaatgattgataatctcttcaaacctgtcaccaacgaaaagggaaaacaagtagatgaaggaattttctggtttgacttcttggactactcttgtgttgtgttcataacttgtggcagaagctttgtcatattaatgagagactttatgcgcttttcagggagctcttgttcgacttctacataagctcggggaagaagagacctgaacacattatcattttcaggtatagtgacatttattaaggtatcatgtgaaagtattatgatacattttggttaactcttgattattaatgtttacatgtagggatggtgtgagtgagtctcagttcaatcaagttctcagcattgaattggatcagatgatgcaggtatggattatggtttgtttatttatttagtgtatgttgttggacatttatggacttggtttattttcttgggttaggcatgcaagtttgttgaagaaaattgggaacccaagttcacagtgatcattgcccagaagaaccatcacaccaagttcttccgggctgaaggccctggcaatgttcctccaggaacaataattgacagcaggatctgtcacccacgcaacaatgacttctatctttgtgctcatgctggattgattgtaagtaaatagcctccttgtgttaaaaatcttctgctggaatccattatgaatcttgtttattgatgttgatgttgtagggaactacaaggccaacacattaccatgtgctctatgatgagattggattttcgacagatgacctccaagaacttgttcattctctatcctatgtgtaagcatcacaatctttgtctatttacatttctatgtactgaattagtcaaactaattctataaaatgtttggttgtgtagctaccagcggagcacaaccgccatctctgtaggtaaattttctggtcaatatcagtagactttagatgatatggacaataaacttgtttgatgtgagattagagtttgctttttagtattgagtgttatgagtaatataacacatctcaaattcctttctttttttgcaggtgcgcctgtaatgtatgctcatttggcagatgcacagatgtcaactgcggtgaagtttgaggacagctccgagacttcatcgagacatggtgggatcacaacatctgaagcagaacttgtccctcccatgccaaagctgaacgcgaatgttgcaagctctatgttcttctgttgaagcatatgactatttgactctagatccctttctgcctaagcaacagaataataatcggtgttgtgattttcgttttaaaaaatatttagcatcttcactctgcctttgttggcgttggttatcatattattctaccaaaatttaaagtatgtcctttcttaatgaaacctacaaaagttgtttatgaaaatttatagtaaaataacgaaatattttgatattttgatttaatattccaaaattctaagtattctgaatacaaattttacttttaagaatttgtaatatttcatttcactgtagaataagattgtatgagttgctacatgaacctgagagatgttataactcacgtcccacgacacaaaataactctgataaacattactttctaatttctagtaacaaatttataaaaagagatctcttataaaaattactgtaaactcaaagcttagtggttaaatacttatcttttacataaaaaacgctctggaatttatggatttgaaacaattatagcatgttacactctgagataaagcaatacaaggacacatatgaaactattactgaagtgaaatgttacaaagattttttcctacatactatattaaagagttaggattcatattcaacgtagcctttacttgtccgcagctgctaaaagctttacaatcaacgtctcgtatatatcaggaagctttaagaggtcaaatgtatgagatgtaacaggctctacttcttccggaagagaatctttgtacatgaatggtagaaaagcctgaaaggaagagagcataaatacagacatgatctgaacaaacaaacaaaaacaagtaaatcatgtaccttataaaaccttaggttccagatcgttgatcgtgacctctgtgctgtttgcttcaagctcattgaaaaatttagacttgaaaaatggaggcagaactaatttatgagtcttgaaacttgtcgccagcaatgttaaaagtgacatctttcttttcttcgttattcaatctcacaaacagtcaataataagctaaactctagattcaatcacaagggtgcagcagctagatgagctaatcaagctaaagtagaaaacttaaaccaatcccatcgactgtaatcaaagaactgcgagcagtgagtgataatcattactagctatgtgcttccccaacgtctcctttccttactaattttaccagcaagaactaactatccggtttatcttattttttcccggtttatcttatttgctttggtttatagctattttgaggtacggttcaaattgatttacataaagaaaggtttcacaaatgagaaatcaagtgaaccgtacctcaaaaatagctaaaccaaagcaaataagataaaccggattgtattttctgttacaagcgtttggttgttggtttaaatctaatctgtcattggtttaatatcttaatgaaatgacctgtcgtctctctctttcaaacagcgaaggttgttgtggcggcggcgacggaaagacagagatgatacttacggaggaagctctgagaaaagtactcggcatctccaaagcggcttcctccggtactcgtatcgctgcaggaagcgcttgggaggatattcgtggtcctgatcctctaccactattctttcgtgacgtcattgaaagctggcgactttgggtattaattgtttggttgtctctatgatctaaaatattctcttagtacctggggcctgagtataaagtggctattcttactgtcagtgatactgtctcagctgggggctggacctgatcgaaggtatgcttaatgttttatactttcttgattgttctgtttacatgttggaagatatagtttttttttattatatatatgcgcctctaaataaaagaaagtgcatctagatacatctctccagttcgttattctggtgaggtcacttattcgatgccatagtaacaacgcaacgtaaaatattgctccttgtcatagtcagacaaggaagcaccacagttctttgctacatcttatagcttaaatcttatcatgatgctacttctcattaaatactcgaaccctttcctgatagttttttttttttttctctccctggttcctctacttcagaggacagggaagcaatatttatacatttgttgaatgaccctttctgctttttttttctcgtgctagtgcagtgggcccagggctgtatcagtgattgattcctcgtcagaaaaactgggaggagtgaaggtagttacaacagatgtagtcccttgatgaagctgaaagaatcaatgatattcttcagaagtggagcgatattgacgaaatagacctcattcttacacttggtatgttaacaacatctagttacgtatcagatttagtgtagtgtttgggatcatattgtgatacaattacttcttgcaactaggtggtactggcttcactccaagagatgtaacacacacctgaagcaaaaaaaaaagtgattgagagagaaacacccggtcttctctttgttatgatgcaaccgagctttaaggtaaaaggctttttcttgtcatgtattgcaacttggttttggttactatttctttccaaaccgaagcagttgcccttctccactcctggaaaagaatggcggtgggtagttatctgatcccgttttccttttttctctgtgagcagatcacgccatttgcgatgctctcaacctctgcagtaggaattagagaggctcaacattggtacaaatctccaaaattcacactgctcttatcatctctaagtaatcatcatcactcacgtttccaggtcttttttacttttttcagataatcaacatacctgggaacccaaacgtagtagccaaatgtatgaaggcgctgttaccagctttgaagcacgctctgaagcagatcaaaggagacaagagagagagagagagaaacatccaaagcatttggaagaagccattgcaccaccggctgacacatgggagaagacgagacaaaggatagtggctgttcttatacacactgaaacttctcagcttctctggtcaatgaatcagtccccaagtgagtgtaaaaacttttcagaatgttaaagagttacatgagacttaactacatatggtgcaaaaggcattgttataacttttgtattgtaaaaatatttgtcccctaatgagaaaaataaaattatgttggtatttttgttttatgtccagtttaattatcttttggttataacaataaatgaattaaaaataggtaaaacctgggaaaataaattaaattaaattaaatagttgtgtttgtgtatgagtctcctccttccccggcggagactgaacagaaataataggagcagtttgaagaaagggaagactataagaatgggtcagcgcgctcttcagagagtcccgccgtcgcttccaagccgcactccttctcttccaccaccgtcttcctcttccccctccctccgttgcgcaccctcctctcgccgccccctccgtcccaggttttcctctcttgatatctccttgtattatttattacaatcatgaccccctgatcatgttgcttgtgaggaaacagaccaatgtcgtcccacattgtcggttatccccgcatcggtcccaagagagagcttaagtttgcattggagtccttctgggatgggaaaaccggcgctgaggatctgcaaaacgttgctgctgacttgagacgctccatatggaaacatatggctggtgtagggaacaagtacattcccagcaacactttttcttactatgatcagatgttggataccacagcgatgcttggagctgttccctctaggtacggttgggaaagtggtgaggtcgggttcgatgtttacttctccatggctaggggtaatgattctgttcctgctatggaaatgaccaagtggtttgatacaaactagtaagtgatcgaatcctccttttttaatgtttgtaaagaaagattctaatgctaattaaatgccttaacagccattacattgttcctgagttgggtcctcatgttaaattctcatatgcatctcacaaggctgtggaggagtttaaggaagccaaagcggtaagttgactgcaacctttcttagttaaaagcttgtagttgacctgttaaaaggttcttattcaaaattgtgctttttggctgctcatggcacagcttggcatagacacagttcctgtgctcattggtcccatgacctacttgctcctctcaaaaccagcaaaggatgtcgataaatctttctgccttctctctctgattgacaagattcttcccgtctacaagtaagaactgttattaaggttttctagaaattacctagaagaaaacaaatacaaacttacactttcatttggatagtactagagagagaggttaaatggttcctgtggcatttgttttgtcagagaagttttgactgatctaaagtctgctggtgcacgttggattcagttcgacgagcctatacttgtgatggatcttgataccaaccaattgcaggcgttttcggatgcctactctcacatggagtcatctttggcggggttgaatgttcttatagccacatacttcgcagatgttcctgctgaagcgtacaaggcattaacgtccttaaagtgtgtaactgggtttggatttgacctcgttcgtggattagagactcttgatttgatcaaagtggattttcctcgtgggaagctgctattcgctggagttgttgatggaaggaacatttgggccaatgatctttctgcttcactcaagacactacagactcttgaagacattgttggaaaaggtaatcagtaaacaaccttttattcgatcgttagcctcagaatgatgtaaatctttgtcttctcttttgcagaaaaagtcgttgtctctacttcttgttctctactccatacggctgtagacttggtgaatgaaattaaacttgataaagaactaaaatcatggcttgcatttgctgcacaaaaggttgttgaagttaatgcacttgccagatcattctctggtgttaaggatgaggtaaggtacatatttgcttattacattacgcacatcgtttgaggactaggactattatctctttgtaggcactgtttgcttctaattccatgagacaagcttctagaagatcatctccaagggtgacaaatgccactatacaacataatgtaaggggttttcttacaaatacattttgtaccctggacttggatctttaattactttcttactcaggttgctgcagtaattaaatctgatcaccggcgttctacaaaagtaagtgctaggctacaagcccagcagaagaagctaaaccttcctcctcttccaacaactacaattggatcttttcctcaaaccccagatctcagacggatacgcaaggaattcaaggccagaaagtaggcgtatctaatccgatgatgtatctaaaaactgtaacatgacattcttctattactcattcactcactgcattttgtaggatatcagaaattgactatgtccaagctatcaaagtcgaatttgaaaaggttgttaagcttcaggaagagcttggcattgatgtattggtgcatggggaggcagaggtgaaaacatactaaaacactaagcttattattcgaactattgcattgtttattcccctgatatgccgtagtcctgcagagaaacgatatggtggagttttttggcgagcagctgtctggctttgcattcacatcgaatgggtgggtccagtcatatggatcacgttgtgtcaagccacctatcatctacggtgatgtcagccgaccaaaggcaatgactgtcttctggtcttctatggcacagaagatgaccaaacgtcctatgaaagggatgctcactggtcctgttacaattctcaattggtcctttgttagaaatgaccagcccaggtgtgtgacaacccaagcctatcaaattctcttttcactctatatggtggtccatctcacggttgctgttgtttataggtatgagacgtgtttccaaattgcacttgccattaaagatgaggttaaggaccttgagaaggctggtatcactgttatccagattgatgaagctgcattaagagagggactgcctctcaggagatccgagcaagaactttaccttgactgggccgtccacgcattcagaatcacaaactgtgatgtgcgagacactactcaggtcgatcatctttatctcactttattgctccattatgaaacatatgtaatttattcatgctctccttgtactttcatgcagattcacacccacatgtgctactcaaatttcaacgacattataaactcaattataaacatggatgctgatgtgatcactattgaaaactcacggtcagatgagaagctcttatcagtgttccatgaaggagtgaaatacggtgctggaatcggtccgggggtttatgacattcactctcctcgtatcccatccgctgaagaaatagctgagcgtatcaacaagatgcttgcagttctggatagtaaagtcctttgggtgaaccctgactgtggcctaaagacgcggaagtactctgaagttaagtctgcacttagcaacatggttgctgctgccaagctaatccgctctcagctaaataagtcataa

SEQ ID NO: 337 - DNA, 6186 bp, Brassica rapa
tatattttttttaaaaattaaatcaaacatcaaattatttatatatgacaaatatttttatttatacaattttttttattaatatttaattgtaaataatttcatatcttaattttcaatttttatgaaaaatattatttcaagataacaatacaatatataagataacaacacaatataataagaattatcttattataatatatacagaaattatctttttatttttaattatatttttaaattttggataattcttagctttaatcacttatattattaaaaaaattaaattcgtttttattttttattaatttatatatttaatttattaaaggtataattgatattaaacactctaacttttaacgtgagcgctccgttgcaaaaattcactttgaaaataatagtatagatattatatacattaatacatctattacattaatcgagctgtcctttaacaatataattaaatataggcctaaagtatgtaacgaataatgataggacactgaaacgaaaagaacgatcataatatataggagcgataaaaaaagaaaatattaccctttaacaaagaaaaaaaggaaatacaaaaaaagggagggcttactatttagagtaggaagctggaagcgcaaggttttagtgaacaacccttctcctcttccttaaacacctctcctctctagctctctctgcgttgctctacggcttcgtcgtgctctcgatttactctttccatctctgtgaagaagcaggttcttcctcaaaatcgctcaatgtatgatcgtattatctttctgccatgcatattaactgttgaatccttcgatttatttgcttgcaactatattgttttgtctatcgtctttgctctccgtttatcgctgggagctagtgattttctattatatctcaacgtttttagcagattccatcatcgtctttctcggagcagctctggtttgtttctaccactatttgatttatctgttaaattaaaaaaaaaaagtaaacgttgtcgtgtgttcttgttctatgaaaattttgatttgtattttccgagaaagactttctgttttttttttttgttccttggctgctctgtgatttttgtctttttggtttcaagaggtctctctctttcgcttcacgcacactcgctttttactagtggcctttcttatgtcataaatcttcatgtgcacgtagatctcttcattattctccatcttttaatgtttaatgtcttgattctgcctgtatgaggtgttttgatacactctgatggtttatatcattattctccaatcttttaacgctaatgggttttactttctaatgaactaatctgaacaaaatgtttttgcttgagcattcttgcgttcattctaatatcattgccataaacaattgtacattgcgtgctgtttttttctgatcttctgtttccctgcagatatgggttgtgataaaggaaaaggactaccacctcccccacctgtcgttccatccaaccttgtacctgaactggagcctataaaaaagaacactcttcttccaatggcccggagaggcagcgggaccaaaggagtgaagacacatcttcttaccaatcacttcagagtcaatttcaacaactcaaacggccatttttttcattacagtgtatgtacttgcttcctcatcttgtgtcctatttgtatcctgcgtttcctttattatataatttttaaatacttgtttggtgtgaatgttttttttttgtctctctgattattggatgcaggttgcgattacatatgaagatggtcgtccagtggaggccaaaggaattggcaggaagattcttgaaaaggttcaggagacgtatcgaactgatctaggatccaaatactttgcctatgatggcgagaagactttgttcaccgttggtgctcttcccagcaacaaactggatttctctgtcgttcttgaagacacatcttctagtaggtaggtgccacatttttcagtttctttcgacttgttttttaaattatcttttaccctatttgttcaaaaatttatgatgaaattgatactctttatttacaggaataacactggaaatgctagcccgaatgaatcaaatgacgcagacaggaaaagatcgaggcgaccaaatcgatccaagaagttcatggttgagataagctatgctgcaaggatccccatgcaagctattgcaagcgctcttcaaggaaaggaaacagattatcttcaagatgctataagagtgctcgatgttattctgcgccagagtgcagctaggcagggatgcctacttgttcgccagtcattttttcacaatgacgtccagaactttgtacacatcggtggaggtgtcactggtgtcagaggcttccactcaagtttcagaactactcagggaggcttgtccttgaatatcggtaaattctcgttttctgaaaatttaatgtgtattattagactcttctttgtaacattttggctgttaacacttgattttttattcggattcgatttttcttttagacacttcaactacgatggtagtacaaccaggccatgtcgttgatttccttcttgtaaatcagaatgtgaaagacccaaagtatcttgactggaataaggtacatcatgatcttcttattttgtactgatatttgagtagtactaatctgatttttttctcacatcaggctagacgtgctctcaagaatcttagagtacaggttgccccctcaaatagagaatacaagataactggactaagtgaagagcgctgccaagatcaaatgtatgtaatgatttgatgtttattttttaattatatgtttacatctctttgagtttttttttctaacatatatttctttgatgacataggtttactcggaattctaaaaacgagaagggggaagttgaggaagttcagactacagtatacaagtacttcaccgagtttcgcggtattccactgcgatattcaggtgactttccttgcatcaatgttggtaagccaaaacgcccaacattcattcctattgaggtaaattttagtgcattattgttatcttcttttgtattcttgaaatatttatgcacaggttatgctaatactagttgtttttttttttatattttcagcactgtgaacttgtgagtctacagcgttacacaaaatcgcttaatagtcttcagagggcttcactggtagaaaagtctaggcagaggccacctgaaaggatggcttcactaaccaatgtaggtcttctttctattatccttgagactgaatattttctgtttaattttggttttatgttattcatcttgaagggtctgaagaagagcaactataatgctgacctggtgttgcaagaaagtggtgtcagcattggctctagcttcactcaagtggagggacgtgttttaccagcaccaagggtatggcttaccttgcttctcttgcaagtaaacattgatcaagtaactccttttgaatcttgaaggttaaacgttagttatctgtccttgtctctaaacagctgaaagtaggcaatggagaggagtttcaacctcgcgatgggcgttggaacttcaattataaggtacataggttgtttatcttttcctcagttgatgaatatttaaacctttgatactagttgaatctttctttttgcagaaacttgttgagccagtcaccgttactaaatgggctgttgtgaacttctctgctcggtgtgatacaaataggcttatttctgacttgattagatgtggaaggatgaaaggaatcgtaagcgctcttatggatcattacttgcctatgtaaacttaatcatatatgcatcactctttttaattaattatacccttgtttttttgtttttctttcagaacgtagaagctccatacaaagtcgtatttcaagaagatcctaattataggggtgcaccagccaacatcagagtagaaaagatgttcgagcagatgcaatctgaactcagaaaaggaaaagaaggaaggccaaaattcattctttgcattcttgccgaaaagaaaaactctcttgtttatggtataactgtattctactattcttgaatatggtctctctcttcttttttttaataaactaatgaatgtaaatgtgaaatttttttctcggaattttccagggccttggaagaggagaaatcttgttgaagaaggaattgtgactcagtgtattgctcctacccccaaaataaatgatcagtatctcaccaatgttctcctcaagataaatgccaaggtgatcacttaaatttcaatcacttagaatttcaagattgattacaaagacattacaagaactgatttctttatgtcttatacgcagcttggtggactgaactccctgttagctatggagcgctcacgagcaatgatgcctttagtaacgcaagttcctaccttcattgttggcatggatgtatcccatggttcccctggacagtctgacataccatcatttgctgctgtaatattgattatcttttcttatgatgtcatccatatatagagagtttaagtctaactcttatctatttctggtaacttgatgtttttgttttgaaaccataggttgtgggatccatagaatggccacttatctcaaaatatagggcgtgtgtgcgcacacaatctcggaaagtggaaatgattgataatctcttcaaacccgccactaacgaaaagggagaacccgttgatgatggaattttcaggttaacttcctcgactttaaagttgcattcgcagtggcagagctttgtcattttcatgtaactttatgcccttttcagtgagctcttgtgggacttttacttaagctcgaagaagagaaaacctgagcacattatcattttcaggtatatttacatttattaagttatcatgtgaaagtagtataatgaatttttgttaactcttggtttattaatgtttacatgtagggatggtgtgagtgagtctcagttcaatcaagttcttaacattgaattggatcagatgatgcaggtatggattcttaggataaaatttattaagtgtatgttgttggacatttatgaacttggttattttcttgggttaggcatgcaagtttgttgaagaaaattgggaacccaagttcacagtgatcattgcccaaaagaaccaccacaccaagttcttccaggctgaaggccctggcaatgttcctccaggtaaaaatcttatttgacctgagaaatgattttcttttggtcattgtagttataatgacttgaaaaatgtttaccatttgacttgcaggaacgataattgatagcaagatttgtcacccacgcaacaatgacttctatctctgtgcccataatggaatgattgtaagtaaatagcctccttcaaaaccgctgcttatatgagacaaccacatgcctcatttctgttaaaaatcttctgctggaatccattatgaatcttgtttatgtatggaatgaaaattttatttattgatgttgatgttttagggaactacaaggccaacacattaccatgtgctctatgatgagattggattttcgacagatgacctccaagaacttgttcattctctatcctatgtgtaagcattacatcaccttttagctcttcatctgtttatggtgctagtaatgtctactaaacttgtctgatttgataactgtagctaccagaggagcaccactgccatctcagtcggtaaaattctcataacttttcaacatagctactggtgttagttcagatgcatcgctatacttgtttgttgcgactatcattattttttttttttctgaaaatatgtttgactactactgagtttgctgcttttcactatgtgcaataatctcaatgcatggtggttgcattatctcaaataccgttttgtttctcgcagttgcacctgtttgttatgctcatttggcggctgcacagatgggaaccgtgatgaagtttgaggacatgtctttgtctgagacatcattgacccatggcgggatcacaatacctggagcagtccctgtgccaccaatgccaaagttgaacgtgaatgttgcaagctccatgttcttctgctaa

SEQ ID NO: 338 - DNA, 6162 bp, Brassica rapa
ttaaagaccatcataaaaacacttgattcacgctgaaaatcaggacaccggtaccgcggtacgatacacctccaaaaacctataaaagaagaatgataagccaagaaaagtgatccagttctctcgatagcgaaaacgatagtgtttcaatacatatacttaaaaagattttgagttttcattttttaaatagtttcaaacataattttcgattttcaaaaagaaattttgaaaaaaaattcaaacaaaaaaactattataaaaagtttgaatatgaaaaattataattcgaaaacataaaaaatattttttatttatttaaataattatttattatatatatagagaataaatgtacaaaagttttttgtcatttaataaaaatgtccttttaatgatgataaaaatgaacaatgataccatgaaaatagtaaacatgaaattttctcaaatatgaataataaaaaataaggaaattttaactatgtttacatctaacaaatatattaaagtataaataatgatattatatataaaatatttttaattcttcaaaacatctctaactaatcaaagttatatcaaaataattgactactacattattaacacaaatgaaattaattaaataagtatactaaaaaaatgtttaagttagatgacattaaaacttataaattttgacaaacaaaccacctaaaatctctaatattaattaaagatacatatatatacttaaaaatatcgaattcagttttatttacccactcctaaattttaattttaaaatttttgtaaactactttcagttcaaattcaaattagtcaaatacaagtttggttcttttttactgatctcaattctaaattttttatctgggacagattaaattacccaaaaatggtatcattttaatttatttttttccgtcacgcggcgagacagttccctccattgttttgcctttttctggggaaaaaccctgagagagctgacgaagcgcagaagaaatgagctaatagtccccacacacacacagtgctcaaccctagaatccgccttcctgattcttcttccaaggtacacactcgacatttccacttttctctccgaccgattccgttgtcccggagagagatgagatgtttcgtgttcccgctcgtgatttctctcctcaggcaaaatttcgctcgctgttgttgatttagagctagggttttactcttttgtccttgagaaacacacaccttgcatgccgcagcagttgaatcgactgagtgagactatctcttgtgtaaatgtttactcaaataaagtattgaatccgagcttaaaaaggaacaatttttatcatagatctagggaatgcaggtctgttggtttcaatctgtgactgtttctgtttagttatttttagttaatagtatattcattgcttgcttgcttgcagcagcttatctatgatactactaacttgcagattattcttcccaagaaagatgcctgtaacgccagaagaaccgagccgtcgagattatgcggtcacagctaggcttggggttggaagcacaggcaggagaatacagttgtgcaccaatcacttcaatgtctctgttggacagccggatgttgttttctaccagtacactgtgagatttgttctgtcacttttctgttatcagtgaatgtgtgtgtatgagatgtgtgacaagcccatgcctttcttttgcaggttagtatcaccacagaagacggtgagaatgtccaagggaaaggaattggcaggaaacttattgaccaactttacaagacttactcttctgatcttgatggtaaaaggttggccttcgatggagagaagactttgtataccgttggtcctctcccacagaacgactttgactttcaagtcatcttggaagcttctttttccaaacggtatagtcctcacctcttatctcgcgttatttttagtgtacaaggtagatcttatagaccgccagccttgttaatattgtagtgactgtggcgtctctgatggtggtagtccttctggttcttccaagagatcaaagcgctctttcctgccaagaagttacagggtccaaatccacttttcagcaaaaatacccttaaggagtgttcttgccactcagagaggagttgacacatcagataacagcactcaggatgcagttagagtgcttgacattgtactgagacagcaagcagctgaaaggtgcattgtcctatctgtttgcatgtgcattgtatgttttcattgaaaaagatactttctacattctaatggacgaattttacttcattttgttggtatatatgcagttattacatcttgtgaccatgatagattcttactgtagaaccatttactatgcagggggtgcctgttagtcagacaggcatttttccttaacgatgtgaactctgttgatgttgggggaggcgtaatagggattcgaggtttccattccagctttcgtccaaccgatggaggactctcgcttaacattggtatttttctttttaccttccttctcatatcaatgtttcatgaactgttctttatcattgaatagtttcaataattccccaaacttttttcgttttgcaatggtttgcagacgtgtcaacgactatgatcttaaaaccaggtccagttatcgaatttctgaaagccaatcagaatgttgagttgcctagacagatcgactggattaaggtagttttggttttaaaatgcaataactgagaacatgccatgttgcttttagtttgaactcttatttctcattgaaccatggcaggccagcaaagtgcttaaaaatctgagggtaaaggcatcacaccgtaacatggaattcaaaattataggtctaagtgcgaaaccgtgcaatcagcagctgtatgttccccatgacctgtttcgtatataaatgtatcctcttttcagactttgtttgactttcttcatcgttttccagatttacaatgaaaattaaagatggcgagtgtgaaggacagactaaagagattactgtgtatgagtattttaagcaaacttacacagagcctacttattctgcgtacttgccatgccttgatgtcggcaagccagatcgccccaactatcttccactggaggtatgcacctccagcagtttttcctttatttaattttggtcaagtcttatatactacttctgttttgtttttttgtatatttcaatttgacaatttctattcgttttcttgcagttctgtaatcttgtatctctgcaacgttacacaaaagcattgtcagtgaggcaaagagctttacttgttgaaaagtcaagacaaaaacccctagagagaattaaagcactcaatgatgtgagcttagtttttatctttatctattttggatggtaaatcattgctaatggctatgaattgcaggcaatgcacacctactgctatgataaagatccgtttttagccggaagcggcatatctattgaaaaacaaatgactctagctgaaggccgggttctaaatcccccaacggtaaaactatttatgatttttttgtgcatagaaaggttatgcactgccatgcacactctagtgaattgtttaatattcttacacccatgttgttttgtttgtatatatacagctgaagtttggaaagaatgaggattttttacctagcaacggacgctggaactttaacaagaaggtagatgtctgctaagattttcgttcatcatatatacatacttgtggattggcagagcgttcttatctctttatgatttggattgaacttgttattcccgaattagcacgttaaacttttctattttacccccttgtttcttgctttgcagatgcttatagaaccaagggctattaagaactgggctgtagtcaacttttcttttccatgcgacagtagtcacatttcccgtgagctcataagctgtggcatgaggaaaggcattgtaggttccgcagatactgtctccattttcgaatagtgttgaactatatctggtcatttacagagtctgagttttggtttgtttaaccatgtaggaaattgatcgaccttttgcactagttgaagaggaaccccagtctaaaaacttgagtgctgttaaaagggtagagaaaatgattgcaaagatgaagtcgaaatttccaatcgatcctcctcatttcattctctgtgtcttgccagaacggaagaactcagatatctatggtatcatctcgccttttctgtgtgaattttaagtttcagctctctagtttaaacttgtttttgcaaattataaaggtccctggaagaaggtttgtctcactgaagcagggatcaacacgcaatgcatctgccctacgaagatcaatgaccaatatctcaccaatgtacttctgaagataaattctaaggtataccaccacctaagctagaaccctatgctggagtcttctccgtaaatttacttcttttattgtcttaatctagcttggcggcataaattctctgttgggaatggagtgctcttccaacattccattgattaacaaaattcccaccttaatcttgggtatggatgtatctcatgggtctccaggtcgtgcagatgttccttcgatagcagcggtattgctgcattcttacgttccttgtcctttgtttgcccattgtgtctggttctcttaggatcttgattgctcttcttcatgtctcgatctgtgctgcaaggttgttggttcaaaaaactggcccttgatctcaaggtacagggcagctgtgagaactcagtcaccaaaaatggagatgattgattcgctcttccaaccagtcgaggaccctgtgaacggagacaacggtatcatgaagtatgtgaatgctatttagtcagctctattgttttgtttttgttaaatcaagaagcaaccagttatcaaaagatatttaagtgtcttctctttctctatgactatgttgccaacagcgaattgtttgtggaatttttcaagacaagcaacgcacgaaagcctaagcagattatcatattcaggtatactagtttatcttcaacgtttaacttccagtatccaaaagttttgttcttacacaatcatgtgcatgtttgttagggatggagtaagtgaatcacagttcaaccaagtcttgaacattgaggtggatcagattataaaggtcatgtttcaaagctccttgtccggttctggcttctatcaaattatgttttcaaatatgtgtctagtgaaagtattatactgaacagtttgcttattgaacatgatgcaggcgtatcaacgtcttggtgaaaccgatgtgccgaaattcactgtcatcgtggctcagaaaagacaccacacgaagttgtttcaagccaagggtcatgaaaatgttcctgcaggtaaagcggatacttttttttttttatcttctgcatcagtcactacgatttcaaatttggtttcggaactctttcttcatagaaaaagacacctctgtttgtcaggaaccgttgtggacaccaagattgtacatccgaccaactacgatttttacatgtgtgctcatgcagggataatagtaagttttagacttttttaaccttttaaaaggttcactcctcgctgcatatgtttatgtttcaccttggcgatccctcagggaacttcaagaccagctcactatcatgttttgctggatgagattggtttctctccggatgagttgcagaatctcatccattctctctcctatgtgtaagtctctctactccctcatctgcattattgattccattttactattattaagatcttcttttatcattggtccagcaaccagcggagcacaactgcaacctcaattggtaatacactttcctaatcaaactctcttctattttttatcttcgaattgcttctcaatattcgatgtgtcctctctctttgtgtgtttgttttcagtggctccagttagatacgctcatctcgcagcagctcaatttgcgcagttcacaaagtttgaagatatatcggaagagaaagtcccggagcttccacgtttgcacgagagagtcgaaagcaacatgttcttctgctga

SEQ ID NO: 339 - DNA, 6256 bp, Brassica rapa
aatcacatcagagctacactcaatccacaagtgatgcaatccgaatcacaatactgatccaccacatttcatctctagccagaaaaattacactaaatcacccaaccatctacatggtaagaagtgacattgtccacaggacaaaaaaaaaaaaacgaagactcatcagagctaaaatcaattcaccactaatgcaaaactaatcacaagacaagatttggctactagaaacacagaaacgatgcgagattatccaaggagaaccacaagcactacatttcatctctaaaccatctacataaacacgcaaagtgattgacattgtcccatacaactcactcaaaccaaggaagctgatccaaacagagggctgatcaaaatcgagactttgaatcataattaaggaaaccaaggcagacccattagcaatcaagtggtcatagactcggaacagaccagtgaaccacactagaagtataaaggagagaactttgaccttccccttgtgccaattctaatcacaagacaagatttggctactagaaacacaaaaaaaaacaaagcagagactggcataacacgtcaagtgattgacactgtccactttaactcactcaaccccaggaagctgatccaaacagaggactgataaaaatcgagactttgaatcagcatttaggaaaccaaggctaacccattaccattcaagcattcacagattcagtgaacgacacgagaagcaataaagagagaaacttttaccttccccttgtaccaattctgatgatagcagttcgtttcttctcttccatagcaacacaagctcttacaaacccggaagagctccgtttccggcgacatttttccagagaaggagatgtgacctgcggaagcgagaatccgataacggagacagagttgaccgggaaagagggttgacgacgcaagagagagactttgttgtgagcttgatggaaagaggaagaagatatatccatggatcccgcgaagagctcagagaagtaaggtttggaatcgttgagagagattccgagggaaaaaatgaaagtgaccttcgaaattcgaatggagaattgatagctcttcttctgatctctacgaagattttggataggatagtttagattttactgatgtaatctcctacggtaacccataccagagttacgtggtctaatacgtttcccaccgtccatttttcaaatctcgttgactcatacttattgggcacgcgaacgtttaattatttaatgggcctaagcccaatttatggactcttataagtgtataggaacctttttcaccgtctgtttatcaatctcgtggacctattattattgggcctaactaaaacgtaacagctagtccaaatcagactgttctcgggtcgggtcgggtcgggtcgggtcataatagtcggtcatcgttgttaataaaagattaggacacgaaacggattgaaatggttgctacgagacgatgtcgtaccttctgcctcacttgcattccgggtggtctattgatcaggcgattctagccgaggaagagcgtctcgtggtcattcgtttcggccatgattgggatgaaacctgtatacaggtatagtttcttccatcttcaatttgattcgatttgggttccttaatttcgaattagggatctgattttgatttttgattttacttggatgaagtgtgactctcttccttgtacgtgagagcattaatttgcattgcatgggtcgacacaaaaccaagtttacatctgaaaatgatgtaattcaatgtagctcatgtttcaatgtatatctgaaacagactaatttttttttccacagtatgaaatatcaactctcgatgtggatcttgattttttttattttagatagatgaagtcttttgctctcttccttgtacgtaagagcattaagttcatagctgctagttcatcattcaaggtatgaatgaaacatacatttttattttatttttgacataggaatattaactctttattaactcttcctcatcttcctcttcctattcttcttcctaatcttcctcttcctcacatcgacatggatagggattatagctataatgaatctagcgataatgagtctagcacatgtgaatcagcaaaggggaatcgccttttgtactcactgcctcctcgtccggggtttggaacaaacgttcgcataataccgcttgtgtctaaccatttccaagtcactcttgccaatcttccggaatatttctaccgatacagggtaggttttcatttcatctatttttttgttttcagttttcaatgatgtataatcttgctgtcttgaacaagtaaatttcgtccataatggtgggcgcagccctattgatcagaaagggattggaatagaactcattgacctggttcacagggtttatgactccgattttgttggcatagagtttatctatgatggagaccacatggtgttcacattgggttctttgcccgataggcataatgattttcctgcggttcttgggatgaattcttcaaccatgtaaaagttatcaatcactttcgcccttcacttgagtgctttagttttgattctgactgacaaattatatctcatgcaggactaaccctctcaagtcagttgaagtctcgttcaacgctgctcgcaatctcgaaatccctcttcagtctcttgttaacgctatgcatggacaagaatccccgaattcactggaggcaataagggttttcgacatcatcttacatcagcatgctgctagacagtaagtgtgtatatgttttctttcatgatactattatatctttggcattgtctctctaataataacctcggggaaaacactgcaggggttccctacgtgtgagacggtcttttttccacaatgaaagccgcgaaccaattggtcctaacatcttgggatatagaggattccattcaagttttcggacaacgcagggtggaatgtcacttaacatgggtaaatagtttcacctgtttgtatttgttttctctttgtagcagtaatttttagtgtctaatgttttgttttgttctcatgccagacgttaaaaccacaacggtcatcaagcctggtccgcttattgattttctgattgctgaccaaggtgcacgcgatgtgttcgatgtcgactggtctaagatgatcgactaatactaattacatgatatttggtctaaccaggttcttttatcttcgctattagctccaacttttgacaccgtttaattatttaatgggcctaggctcaatttatcgactcttataaatgtatgggaacctttttcaccgtctgtttatcaatctcgtggacccattattattgggcctaactaaaacgtaccagctagtccaaatcagtctgttctcgggtcgggtcgggtcataatagtcagtcatcgtcgttaataaaagattagggcacaaaacggattgaaatggttgctacgagacgatgtcgtaccttctacctcacttgcattccgggcgggctgttgatcaggcgattctagccgcggaagagcgtctcgtggtcatacgtttcggccatgattgggatgaaacctgtatgcaggtatagtttctttcatcttcaatttgattcgatttgggttccttaatttcgaattagggatctgattttgatttttgattttacttggatgaagtgtgactctcttccttgtacgtgagagcattaatttgcattgcatgggtcgacacaaaaccaagtttacatctgataatgatgtaattcaatgtagctcatgtttcaatgtatgtctgaaacagactaatttttttccacagtatgaaatatcaactctcgatgttgatcatgattttttttattttagatggatgaagtgttttgctctcttccttgtacgtgagagcattaagttcatagctgctagctcctcattcaagatatgaatgaaacagacatttttattttatttttgacataggaatatcaactatttattaactcttcctcatcttcctcttcctattcttcttcctcatcttcctcttcctcacatcgacatggatatggattatagctataatgaagctagcgataatgagtctagcacatgtgaatcagcaaaggggaatcgccttttgtactcactgcctcctcatccggggtttggaacaaacggtcgcataataccgcttgtgtctatccattttcaagtcactcttgccaatcttccggaatatttctaccgatacagggtaggttttcattttatctattttttgtttacagttttcaatgatgtataatcttgctgtcttgaacaggtaaatttcgtccataatgttgggtgcagccctattgatcagaaagggcttggaggagaactcattgacctggttcacagggtttatgactccgattttgttggcatagagtttatctatgatggagaccacatggtgtttacgttgggttctttgcccgataggcataatgattttcctgcggttcttgggatgaatttttcaaccatgtaaaagttatcaatcactttcgtccttcacttgagtgctttagttttgattctgactgacaaattatatctcatgcaggactaaccctctcaagtcagttgaagtctcgttcaacgctgctcgcaatctcgaaatccctcttcagtctcttgttaacgctatgcgtgggcaggaatccccgaattcactggaggcaataagggttttggacatcatcttacatcagcatgctgctagacagtaagtgtgtatatgttttctttcatgatactattatatctttggcattgtctctctaataataacctcggggaaaacactgcaggggttccctacgtgtgagacggtcttttttccacaatgaaagccgcgaaccaattgatcctaacatcttgggatgtagaggattccattcaagttttcggacaacgcagggtggaatgtcacttaacatgggtaaatagtttcacctgtttgtatttgttttctctttgtagcagtaatttttagtgtctaatgttttgttttgttctcatgccagacgctaaaaccacaacggtcatcaagcctggtccgcttagtgattttctgattgctgaccaaggtgcacgtgatgtgttcgatgtcgactggtctaaggtgatcgactaatactaattacatgatatttggtctaactaggttcctttatcttcgctattagcttcaacttttgacaccgtttaattatttaatgggcctaggctcaatttatggactcttataagtgtatgggaacctttttcaccgtctgattatcaatctcgtggacccactattattgggcctaactaaaacgtaacagctagtccaaatcagtctgttctcgggtcgggtcgggtcataatagtcggtcatcgtcgtttataaaagattagggcacgaaacggattgaaatggttgctacgagacgatgtcgtaccttctactcacttgcattccgggtgggctgttgatcaggcgattctaaccgaggaagagcgtctcgtggtcatacgtttcggccctgattgggatgaaacctgtatgcaggtatagtttcttccatcttcaatttgattctattttgattccttaatttcgaatatcatatactctcgttctattaagttacgatcttttgtttcgattgcttgaaagttttaagccattagtgttttctttagcttggaaccgatgagaattaggggtttattgtgtgctcgtgttgttgtttgattcattatttgtttacatttagttttaagccattaatgtgttgtttagcttgtgctactgttgtggtctgattaaatgattttgatctgatgttagatggatgaggtgttggcatcagttgctgagacgataaagaactttgcggttatatatctggtggacataagtgaggttccagacttcaacaccatgtacgagctctacgatcctttaaccatcatgttcttcttcaggaacaaagacattatgatcgatctcgggacgggtacaacaacaagattaattgggctatgaaggacaaacatgagtttattgatatcattgagaccgtcttccgtggtgcaaggaagggtcgtaggctcgtgattgctcctaaagattactccaccaaataccgctactaa

SEQ ID NO: 340 - DNA, 5894 bp, Brassica rapa
acttattttttaatcgacatatttatttgtaatgttagacttattttcttacggcaaatttatatgaccgatttaaaattattggcagacttcttatttatgtgatgatagactttttaatttatgttttgacagatttattgacgaaaaacttggtttatacaaaaatataagagttattctagtaattagatatataattagagtcatgttgagtaatttctcattttattatgatttattcttggattcatcttctaggatgaatttctaagttcaccaatataattttattatttcatattcgatatctcttaaaaaaactaaatattgtcaaattatattatatttttaaaaataaaaaggtaagaaaataaaaaaaaatagtagtagttacaaaagaaaaagaatttaaaaaaaatatttttaacgtaatcagcaaaacactaaaccctaaaccgtaaatcctaaacttttaggtaaaccttaagctcctggataaaccctaaacccttggagaaaccttaacccattggataaatcctaaattttaaatttaataaaacagtgtagtgtgttattggtttatatattttgattgatttagaaatctatatagtatttataaatccaagtaaaatatgcaaatctggaggttttccttcggatttgagttaatactaaaacactcaagggtttagggtttaatgttttggtgtttttgatttagagtttatgatttatccaatgatttaggatttatccgaggatttaggatttagattagtgttttgccgacgacgttaaaaatattttaaatattttttttgtaactactattaatttttaattatttttatttattttaaaaacataatataactggataatattttgtttcattttctaaaagatattaaatataacctctgttctctatatagggggggggggggaatccaagattagcacttttattattcattagtctttgtgttgtagtaaatgctttctttgttttaaaaaaatagtttttaaaatattacgattattatttatttgacaagtcgtggagattggtattccttaggtttaggaagcaaagatccactttccccatttaccttctgtttaggactaatttaatcatggtgataattgattctctacgtgtttttgtaaattataatgacgtaaagaaaacaaaagaaggaaagatatatttttggttcaaagggaggaaagatatatttttgggttcaaaaagaggaaataaatatttttaaatacattatgaacaaggaaggtggaaaaggtgggggaatgtggcccaaaattttaaattcatttgaaaaaaaaaataataatcgaagaatttagcgcttctttcatttaaatacttccccacaagtggtttttcatcttttctcatcttccatcacttcttcaggtctcactcgtctcatctcccccttccttcagatttctccggctctaatcatggctccaaagcgtaaggttccttcaactgaggttgagatctccggtcccacctcaactaggccgaagataagtcccaaagcgccggtagaagttgctgctgagccaatacgttcccgacctaagttcaaggtagagttggtggtggactccaagaaggatccgtcctgggttctagatgagccgattgctgattcggaggctaggactacgtggcccgagaggtatcaagtcatccaggtatatgctcagatctatacatttactctttctttaaacttctgaaactgatgaaattttatattttctgtagaagaaggaagtcgtacctttaccgaagaagaaaaagaaaaagtaaattctcgaatccttttgcttctagtggctggttagctttagagatctatgtgtaactaactccattcaattttttcttttaggtatgttgaggaagaggagattttccttgcgcgacgccattttcgacgagccatccttgatgattccatcacatacaacctctacgatgatgctcatgtgcaggttaatctctaaacaacctcaacgatgacgagctgtacatttacatccatcattacattcttcagtctcagaacttgttatcaattaaactgtgccctaactaactaaggatgagatcttatttgaacaatagcttaattaattgattgttatataaactaattatgcattgactgaacctctctttcagtcttctgttataaaggatataacatacgtaacttgtgtttgtatattaaacataattatttttttgttgttcagtctgaagaggacgaaaagcctttcatttgcaagatcgccgaaatctttgaaggatgtgatggcaaaatgtactttactgctcaatggttttaccgtgcgtgtgataccgtaagcatcagaatctattactttcgagcatttaatatatctaaatgctgaatcatctgattttgtcattttcttaacttttaggtgatccaaaaacacgaagaaatgatcgatgacaaacgtgtttttatctcggacataaaagatgtaaactcaatgggggttcttctcaacaaattgaagattctgatgatcccgttaacggtacgttcttatttcatgtatagcctcttgtcatgcaccatgcatttttcttcattgatttcattaatatttgctttcttttctgatgctaggaaaatactgaagtgactgaaagctgtgattactactgcaacatgaaatatcacctgcctttttcaacacttgaagctttgcaatcaagtcagtgtattacgcctaatcaacgaacggatgctacaatgttagacttgtattgtgggtgtggagccatgtcaactggcctatgcatgggagctcagctgtcagggctgaatcttgtcacggtgagcattttttttcttgctattttaatgcgttaataacttttcattgttgtagttagcatctctttgatgtttaacctttgttttgttttgttttgttttatgatttctcaagaaatgggctgttgacacatgcgagtatgctgttcaaagcataaagtataaccacccggaaacagaagtaagttcttcttttttattatatctctgttattgtctttattttagcctttgtcttctgtgtttatgttcagttggtcaattcgctgtttaggtgagaaacgagtccgcagaagattttctgtatctgctcaaggagtgggagaaattatgcattcatttctctttgatcgaatctgcggattcagaaaaatacgaaaacctttatgggatgtccgctgtggaagaggttaaagatggcagcgatgagagtgacgtcaaagatggtggagaggtttttgaagttgaaaagattgttggtattaagaaagaggaaggaggtagactccatctaaaggtatcgtttgttaaatgtttcacatcttaccatctgattaaaacctcacaatcaaaatcatctttggtgtttttggtataacaggtccggtgggagaactatgggccttcccatgacacatgggaacctattgaaaatcttaggtgagtaaaacatagtaaacttgtagcaattgtttgcaatctaatgatattcttcaatgagttgttaacgtgtctgaatttgtttgtgaacagcaattgccgtaagaaaattaaagagttcgttgtgcatggatttaaaacaagcatccttccattaccagtaagtaactagttttaactttatctgaatcttatttgtatttttctgcttaattacttatttgtgtgacacttatgcctaattaatttcagggaggagtcgatgttgtttgtggaggtcctccatgccaagggattagcggttacaacagattcaggaacgaaaaagagccgctaaaagacaaaaagaacgagcagcttcttgaatacatgaaaattgtggagtttctgaagcccaagtatgttctgatggagaatgtggtagatatgcttaggtttgttgatggctttcttgcgcgctatgctgtgggacgtcttgtccaaatgaattatcagacaagaatgggaatgatggcggcagggtcgtatggccttgctcagttccggaggcggttcttcttgtggggtgcaatgtctagcgaggtaatgcttatttatttctactcttctttgtttggtatcaagaaatagacgaagcaattaatttcttgtatctttttgtttgtttgtttcagacgcttcctcagttcccacttccgactcatgatgctgtcaatagaggacatgttcctgtgaactttcatgtaagcggtatatatttagtactgttgaatgtagctagcaaattcttaatagttttattcagtgagctcggcttatgattgatgcagagtaacgtagtggcctatgaagaaacagacaatgtgaagttggcggataagatcctactctcagatgtccttaccgaccttccagttgtaagtctttctttgtgttatatctttaactaaatagtagctaaacattgttggtggtgttcctgatttattaatgttctctatggttttaggttgcaaacaatgagaggagggcggagatgccatatgacaaagatcctaagacgccatttcaaaaatttatcagattgacgcaagaaggtaagattcttatctctcttcaaggtaacgatgtaaaacatagatatgaagagtattattaaaactggaagatgtctccccttttttcaacaggaatgttagcttcacctaaagatcccaagtcaaactccaaaaatgaggtgttgtacgatcaccatcctttgaatcttaacaaagatgattatcaacgtgtctgtaggatccccaagaaaaaggtagagcatcttcacactccttgctcacattttttttcttctatcttttggtctttgttttaatgttgtactgtttctggtattagcaagcgaatttcagggacttacctggtgtaactgttaatgctaataacaaagttgaatgggatcctaaaatccccaggatctatcttgaatccaatcaccccttggtaatacactgatcatctcgtttctttctttctttctttatctatcaatcttgctctctcttcattgccttttaagagacattgtcttgtgctatccaaacagattccagagtatgccatgaaatttgtcgagggaaaatcaaagaagtgagtccttgatttccacagtcattcttctctctccagattctggatttggcatatatgttttcgagttattaaatcacctgaaccattttcctttgcagaccctttggacggctttggtgggatgaaactgtcccaactgttatcggaagagccgagccacacaatcatgtcagtctttctttcggtcttgaaaccctctcgatcaggagaatgaaataactcattaattcatctgaaaatgctgggctgtgcatctaatctatggaaacaattttaaaatagtattcactgttaatgctgcttgatatgattacaggtgatcatccacccaaaccaagaccgtgtcttgactgtgcgagagaacgcaaggctccagggcttccctgattactatagactatttggccctaccaagaaaaagtaagtcactgtcctgattattatagattgttactagaactctcccatatttcttgaaataagtaaaatcttacatacctatctataatgttgtcaaggtacactcaagttgggaatgctgttgcagtaccagtggctagggcacttggatacgcattaggacaagctttccaaggcctcactaatggtagtgatccactcttcactctgcccgaaggttttccaaaaccaaccttctga

SEQ ID NO: 341 - DNA, 7908 bp, Brassica rapa
gtatcttgttcattttgcttggtattgaattttaaactattagttgttatttattttcaatcgtacttttttttatttttacttggtaaattaaacaattaagtgtaaaatattggagtattttgtttagattgggtgtgttttattaaactatactataaaatttgtgtgatctttagagataagcattacttggttggcaagtttttttggaagataattacgtgattgcgttaattctttgatcccttttttaaatgctgactgcgtacaattaggaaacaatattctttgttgatttgttttttaataatcgtaaatttatgagtcgtttttggaatattttctcatatggaaggaaataagtttgagggcaattgtcaataatagcacctttgaagtttatgtctcaaaaatagcagtagaaggagaaagtcacaaaaatgacattcattaaagggtaaaatatccctaatacccttttaaaaataatttttgaaactgttttataaatttttattttttattttagtattttttttttataaaattttaaaccctaataccaaaacccccaccccttaactctaaaccctaaggtttggattaattaacccaaggggtataagtgtatatttacctctttaatgaaacctatttttgtgactttgagccttgagtgctactttgggaacataaacttggtttagtgctattctagtctttttctctaagtttaattaggtacgcttttatatgcaaaatcttaactaatatgatatttaaggagcatattatatgcatatacaaaaaataccaaattgataaacaataaaaaatatttgactttgggaaccaaaatctaaaccataaaacaaccagaccgtacctttattataaaattaatatactaaatgttggtaagcatagtcataaaaaatattattcactgtttatatcatgcatatgtaatagaaaacgtgaatataatggtgtagatacgttttgatatgaaagatattttgtaaatatatgttcaatcgattggtttgcaacgggttaacagattttaaaacatttggttattgattttttgtgttcggctgataaaattctaaatttagcattgatttgggtaattaacaatttgtaagcccaaaacaatattgtgggtgagtaagaaagatgaaaaggcaaaaatgtttcagaaaaaaagaagtaaaatgacagaatttgatggcagtggcataaagatgtaatttttgtgcaactctaaggagtaattactgtttgtacttctgccttaatagtttagataatcaaaaccatcatgtaaaaaggaagaagagagagagagaaataaaaccctcattcacaactctaaccccccttggatcaaacatagtacacttgctagtggcaggacgaaagaaagagaatcgcctttttattggtctcttcgaagaagaatctctctacccttctctttctccgttttccatggaaggagacgaacctcgtggaggaggaagcgattctctttctgtcaagaggaaattctatgaaatcgatgaagattcttctcctatgaacgggtatcttctctcttcctagttgcttttgggtcttgttcactaaagccttttcctttgcagcagttccgagttgtacgaggttgcacagaccaggaacactattgctcttctggaaacaggagttgataagtttggggtaatcaacttgcttataaaacccattccttcttctgattcccccaaaagattcatcatttgcttggcccctactgtcaatctcgtcaaacaggcaactccctttctctactctttatttgattgatttcttctctgtaacaagattgtttgttttcttttttccctatggatttagcattgctgtgagattagagcacatttaaatctgaaggttgaagactactatggagctaaaggagttgataagtggacatcacaccgctgggaagaggaactttttaagaacgaggcaagttatatgctaacaactgatctcactaacagctatcacatacactttgtctgttgcctaacccagttgatctgtctattaccttttttgtctggttcaggttctagttatgactcctcaaatatttctagatgcccttagaggtggattcctgaaagtagagatggtacgccttcttgtaatagatgaatgccaccgcaccactggcaatcatccttatgcaatgattatgaaggtagtgctttctcatttgtattttcggtaaccagagtcagtcaataaactattatcttcctgctttgcgtgaaggagttctatcacaaagctacagacaaaccgaggatgtttggattgactacgacagccgccattagaaaaggcatgctatttcgagtttcctctttacgtaactgttttgttaatgttcctcattgaactgtgcagatcaagtatcagaactggagaacctcatggactcgcaggtactttgtttattgtgtaaaaaaagaaaagaaatgtgtactcgttcacaaaatgcaagatttactttggaaatttcagatttttaatcctcaagggcagaaaggggtggacaagtttgttacaaaagtgaaagaaggtccagtattttatgacccagcacctttatgccgtctggaactgaaagataagttgcgaacttcacacctcaaggtaatattatatgctcactgattatgagccagagctttgctctttcctattatctttcacaaggtttgaaaaggttgtatcttgttccacagtttgatgcttctctgttaagtcttcttcaagaactggaaaaaggcaattgtcaggacgtggaggagaataagtttaaggcatatcaaaagcgactgtccgctgactaccacgatattttgcattgccttgatagtcttggcctcatttgcgcacatttggtattctttctgtcacatacgaccacgccacatataatattctgtgatgaattaacatatatattttaaaaatcttgccttcatttaaaggcggctgaaatctgcttggagaaaatctcggaaaccgaaacttataacgaatgctcaatggtgtgcaaggagtttcttagtgatgttttatccacacttgggctgtttttgcagaaaggtacggtattagaagctctttttgcattgaggcttcgaaatcactaatttaatcttttgtgtgatttaaaagaagaaaagaattcggtagatttgccgcaagacaatccgtcagcagtgatttcgggacttgtatctcccaagttacaagaacttttccatctattggattcattgaggtaacttatatattgtatttttttttcaattcccaaaattgcaacaaaggctcattctgttctgacgattttaattcgcttacagaggtgaaatgcaaaagccatgccttattatagttgagagaatcataactgcagaagtgatcgaaagatacgtgaagaaacaagcctctttaggttacctttacgtcttatctttaatcggaaacaacgcctctacccaagcattggcacagaaaatgcaagattcatttcatgttggcaaggttacatgttctttatcaccgtagacggttaacagattgaagttatattatgttttctctgaaagctttttgttttttttaaatggatgcaggtaaatcttgtatttatcactgacgtggtcgaagaagggtttcacatgccagattgctcatgcatggtatgttttgacctgcccaaaacagtgtgtagttactcgcagtctcaagaactggccaaacagagtaactctaagtctatcatgtttcttgaaaggtaggagagagtcttggttaacagaacgtgtttgctgaaacccaatgccctcttttgcatctcagtttttccatacaaaaattttgtagggggaaccccagccaaagagatcatctgtatgaccttatgcgaagacaagtaccaaaagaaactccaaaccaagcgaattgtcaggacttgaaagagaacggagccacggttcatgatgaaccagcgccaaaagagcagtcggctaataaaaggttacgtcaactgcaagtgttggataagaatctgctacaatgcagcgccaaagagaaggccccctcttctaaaagtaaatcatctgcgtcggctgcaggtatgtgtcacacatcagcagatgcacatcatacgaggtcatggcgtttctcttgatgttcttatataattctattctttggacaggttccaaaaagcggaaggagttgcacgggacaacccgtgcaaacgcattgtcaggaatctggggagaaaatcttgatggtgccatctttcaggcttataagttggacttctggagtaatatctctggggacgcgtactctagtttctctcttctgattgagtcaacccttgccgatgatgttggaaatgtcgagatgagcctttacttggtcaggaagtatataaaggcttctgtttcacattgtggccagatacgtttgagtcacgaagaggtacctcccacactctggtctatgggatatttatacagtttcttgtttatattcttcaaattttatgtcttgcgaaaacatgcagatagtcaaagcaaagtgttttcagcaatttttcttcaatggcatgtttggaaagttgtttgttggatccaagtcactgggaacaaagagagaatttttgcttcaaactgacacaagttctctttggcatccttccttcatgtttttaatgctaccggttgagaccggtgatctagtttcgagtgcgacggttgattggtcagcgatcaactcctgtgcctgtgtagttgatttcttgaagaaaaatccccttctagaacttcaggttggtgaagaaaatcattgcaacacctcatccggtcaggaagggacacaaaagaaagaaacggaaacgaatctgattcattttgccaacgctttgtctgataaaaatagcatcgaagaaattgtggtcattgcgattcacaccggaaggatatactctatagttgaagccgtcaaagattcttctgctatgagcccgtttgaggacgaggcctcattagaatatgctacttatgcagaatattttaataaaaagtaagtcatattcttatctatggatcttctctcagtaaatcttccgtaacttatagcgtcatttctcttcaatcaggtatgggattgtattggcgcacccgaaccagccattgttgaagttgaagcagagtcaccatgcgcacaacctcttagtcaacttcagtgacgaaggtaagttgagtcttcctctagatattgtaatgtacaagctcttaaagatgttgtttcctaaatgtaaatggacagtgattgagaagaaagaaccaaacgttagtaatgttagaaaaacaaaacccaacatccacgctcatttgcctccggagcttttggttagaattgacgtgccacgttctgtgacaaaatcaatctacttactaccatcagtgatgcaccgcctagagtctctaatgttggccagccaacttagagaagagattgattgtagcatcgataacttcagtatatctagtacatcggtatggttttccacactatttataatttagagtggaaactaactgtcaaacgaaatattgtatttgattcaatgaatcaggttcttgaagcacttacaacacttacatccgctgaagcgttttccatggaacgtttggaactgcttggggattcagtcttgaagtatgttgtgagttgttctctataccttaagtatcctaacaaagacgagggacaactttcgcgtgagaggcaatcgattatatctaactcgaatcttcaccgcttggctacagatcgcaaactgcaggtatctctatgtaagtaatgtaatttgaatcattctgaaaactaaagatctattggtttttacagggatacataagaaacggcgcctttgaaccgcgtcggtggaccgcacctggtcaatgttctctctttcccgttccttgcaagtgtgggattgatagtagagaagtaccgttggagccaagattctttacagagaacatgactataaaaattggcaagtcctgtgacatgggtcatagatggacggtttcaaaatctgtatcagattgcgctgaggccctgattggtgcctattacgtcagcggtggattgactgcggctcttcacatgatgaaatggcttggctttgacgttgaatttgacagagaactagtgaatgaagccatcaatagagtttctctacggtgttacatccctaaagacgatgagcttacggagttggagacaaagatccgacgtgaattctcttcaaagtttcttttgaaagaggctatcacacactcatctgttcatgaatcctactcctacgaggtctggcttcattctttcaatcctgcatttttctaatctcatgcttgctatcaacttgttgttcctcaaacagagattggagtttcttggcgattccgtgcttgattttctaatcacccgacatctctttaacacctacgaaaagacagggcctggagagatgactgatcttcgatctgcgtgtgtaaacaacgaaaatttcgcgcaagttgcagtgaaaaataatctgcatacccaccttcagcgctgtgcaacggttcttgagactcagataaaagagtatctgatgtccttttcagagccagatgagactggtagaacaatcccttcaatgcaaggccctaaggtgcatgaccgtttaaatatccatgcttgagtgatttcagatattaaaataaaaagaataaggttgacaaactttgtctgtttcggtttaggctcttggggacgtggtggagagtatcgctggagcattgctgatcgatacaaggttagatcttgaagaagtgtggagagtctttgagccgttgctttctccacttgtgacacctgataaacttcagcttcctccataccgagagctcaatgagctgtgcgactctctcgggtatttcttccgtgtgaaatgcgcaaatgatggtgtgaaggcacaagccacgatccagttacagctggacgatgttcttttgactggagatggatctgaacagacaaataaactggcactgggaaaagcagcttcccatctgcttaagcaacttgaggtatatatgtcctgatgtttccacttgtatgtgtattcattttctatgcttctttcagatgagaaacatttcacgtaaaactgggaacggggatgatcaaagctccatggatattaaacttgcttgcaatcttagcgacagagaaactccgtcttcagattctgtcgaaatgcagggcacagtggttccaggtaagagtacttcaagattcttcttcacttctttatcgtccagagttgtgctaatgatttatttttacagttattgggcctataaacatgaagaaaggagggccccgtggaacactacatgagttctgcaagaagcatctctggccaatgcctactttcgacactttggaagacaagtctcggtgagctcatcactttgatttgtcctagtttttatttggctctcatgggtcctgaccaatgttaaactgataacatatttgtgtgcggacagaactccctttgaattcacagatggcaatgagaagcggactagcttcagcagtttcatatcgaccataaccctgaggatacctaatcgtgaggctgtgatgtattctggagaagccaggcctgacaagaagagttccttcgactctgcagttgtggaactgctctatgagctcgagcgccgcatgatcctgactataaaaaagtaa

SEQ ID NO: 342 - DNA, 5170 bp, Brassica rapa
tgttttcttaagaaagtgttcatatatcgaaatttagctgataaaccattaacgcggagcatatatatggccatgtgtgtgtggacatcagtatagcgtatgaacatgcaaatttcattttctaaaatttacccaccagtttgcactttcaccttatacaagtgaaaaggacaataaaacaaggtcccaccctgataaaaagagagaaaacagattataatctcaaaacacaaaacatctactttattaaaacagaagtacacttatagaataaccctaaaagttacataatatttacagtcaaatgccattgagaattaaattagttttacattaaaaatgattgtcttttccacttattcattgttttcctaaaataactcaaactaaccacaaaaaaaggaaacatattattaataaactcaaacaaactacatatttttaaataaatgaacaaacataaataattcccctgcaatatcgacaccctaacattgcttattatatgaatctcatttttagctcacgtaacctgcacgaacatcaaattatataagtaattaaactaagaaaaattaacaatgattctcacacgagttgaacaatttcagttcacttaatttcacggtggtgtctgtagcatatttgtaaccactttattatattgaaatattccactgacttccatatgtccaaataattaataatcattatctatcttattaaaatctaatatttttgaattgaaaatctttttccctaacaatctttggaaaaaaaaatagaaatatttgcataatttactaatttgtttctaaataagatttccccttcaatttcggaacaaggaatatatatatatataatttgatccataactactaaacaataaacataatattcgaatttcaacaacatattctgcatactaatgcaaacaagagatgccttacgagggtggttaagatatttcctcaactttagcgttttgtattgcgttaaaaaaattgtttgaaagtccatttgagaactcatcatcatctctcctattttttctttatatttatattattaataggtcaaaaaaaaccctttaaaacctagcaatggagatggccttagtccaaagtactcaaaactttttcttttcttatgtaaatgtttgacaaaatttgacaagaggaatcaaattagtactaaagcatctatctccctgccgtggtatacatgcgctataagagagcgtgaggaacttttgaatctaaacttcgaactgtctttatgtgaaagtgcatggaaaatctcaagttgtagtttcctacacctctctgtttccttcatttttcactattaaagcaaaacctttctcaaactttgatctataaatccatacatttatatatattaatatatctagtattgatatatgtaacgtatatatagggtaacaaaagctcatattgtttctctattttttctagcaggcagggtttagttttgatggaggaaaacctgcatcgagtttcacgtagtcccgatgtcgggacccacaatcaaaacgactccgtcgccgaagacaaccgtcgacgacggcattacaaccaccatactcacggcgtccaagttaaatgctcaggcaggtcgtgggcggctgcggctattgctgattgtgtagcgctctgttgctgtccatgtgccatcataaactttcttactctgactttcgtcaaggtcccttggatgataggacggcgatgtctcggaggcagacggaagaaacagaacaaacggaggctgcacaagagacaacgccgcggtaaaatcaacagtgaagacgggtttcatcattacaataaccgtaagtttgagacggccgtggaagatgagaaatgcggtggtggtagcggcggagatgatgatgatgatcaccggtttgtggtggagagagatggaagtttaacgaaggatgaggaggagaaaacggcgtcggttagtgggagtgaagagtcgagaacaagtgcaagagttgaagcagagagagtgtggttagagttgtatcagattggtcatcttggatttggtcgagtctccttcactgggattcaatgatttaatcgatcatttttaggatttaaaaaaaagttaatattctgaaatttcggagaatataaaatgtgaatttatctagcctaaataatgtaaaatttgatagtgtagtgtactagtgtacatttattagtaatagacaattaaaaaatttcacatttgaaactgaaaactacatactacaaaaaatttcacattttggtagagagtgtggtttaagttccttgtgtaatttttcgactcttcaatggttacattctgtgtcgattctcttacataatatccaaattttaaacggtcgaaatgtctttgaccaaaggaaaaaaaaggtcgaaatgtccaagtgatcaatcagtataaaccgaatagataaccggatcaaactaaaccatgtaaaaaccagacgcattctcatttcctttgtgttaagtaccctaaacctaataggcaatagcgttgcagtagtgaaaagggctgcttcaacttcccttctctccaaaggaatggctcagtatgtttgccttcccttcacaccaaatctccactttcccaaaccaaacacgcccttgtgtttcgctgctaaccgaaaatgtttcatggattcttctgatcgagtcatgttggctgtgtcaggcagttgttctgccataaggagttttcaagtgttaaagaaaattcacttccgctacctcggttcgattagcacttaaatatgaaatatataagtgcttattttctaaagtcatagattaaacacatttgtttttgaacctaatcattggcattgttatctccttttttttagttttatgaatgggcctgtttgtgggcatcagtttgtaattatcgtacttgttgagccttctaataagaaatgatatgacagaaaaaaaatctcaggcctattaacttcagatatcattctcagagcacccccattgagagttcatggggggagttcacacaaaaaccaagaaaaaaaaataataaaataattcaatctcatgaaccctctctctcctaaagttctcttggttgaacctctcactcctaaagttcatcactgtagcgcgggctccacgtgtcgtggcggcccgcgattggtctaacttttttttttttttttttttttttttaaaaaaaccaaaaagaaaaaaaaacaaattttaataataaaaaactaaaaagatgagctattaatcagtaaatcaccgatcatttacgacaaagcatcatagtcctaaaatgactttgactttatctgacaataatcacgatcctgcagcagtacgccatcgttgctaatattaaatgtttctctagttcacggcgtaacacagctctctcaccgacgacgacgatcgaacttctacccaccacgggagcgtttcagcttctcagacgatatttctccgggttttaactttattctcttataaaatagaatttggtagaatctgcttgttactttgaggccatgcaacatgcgttattattcactgatctcttcttcttcagaagtttttattcttagtaactcttcttaggcaggtttacacaccagagatccttactagactacaagtccccttgatccagtcaccttactactacaacaatggtacactgtgattattttcatttgtacagttatttgatttgtatatgattattttatttcatcatcacaattttctattttgtacattaattttaggcaaaagattctgctgattggaacgctgtcgatgatttggattttgagatccttaactttcactcatctccatctaatgccgatgatgatatggattttgagatcgttaactttcactcatcaccgtcgtccccatctccggtagtcaccaatgatgagccgcttcgcctaccaataccaatgcttggattaggggttccaaatgagcagctgttcgtcacacaaagatcactaccagaactagcaagaggcccaccatatttctactatgagaatgttgttcttgcaccttgggagacaatctcaaggcatttgtatgacgttgcaccagaatttgtggactcaagtttcatatgtgctgcagcaagggagagaggttatgtacacaatctccccatcagcaacagatatctgattcaacctcctccgaaacacacaattcaagaggtgttgccgctgaccaagaattggtggccaacatgggatacaagaaccaaactgaactgcatatttactgttaatgctagttctcagttaacaaacaggatccgctctgcccttgaggcttctaggggagaaccgcctgaggagataaaaaggtatgtcattgagcagtgcaaaaaatggaatcttatatgggtgggacaaaacaaagctgtgccattggaagtaaatgaaattgagactcttatggggtttccaatataccatacacgaggtggtggtggcattagtagggccgagcgtttaaagtcactcagtaattcttttcaggtaactgccccatgcatttgcataatcatcgttttgtttggttagtatcagtttatactttatagtagtttgaatttatttagttattgatagttgtatttcccatgttttgatgtttgaacttgtttttaggtggacacattggcatatcatttgtctgtccttaaacccttgtttcctgatggtattaatgtcctctccctgttcactggtattggtggtggagaaatggcgcttcatcgtctccaaattccgatgaaaacagttgtttctgtggagttctcacaagcaaacaaatacatcttaagagacttttgggagcgaactaaccagaaaggagtgttgatagagtttgaagatgtgcaagacctaactaaagatataatcgtagagttgatgaagcagtttggtgggtttgatatcgtgattggaggtagcccttgcaacaacctcgctggtggtaacagagtaaccccgaatggtcttgaaggtgaacagtctttgatgttctatgagtattgcagggttctgaacgtggttcgccagacagcaaaggagatgagaagatcttga

SEQ ID NO: 343 - DNA, 4366 bp, Brassica rapa
gtcactctccaaaccatttaccctttatgaatcctgtaatgattgtcactaaaattatgtgtatttactaatctttggccagttagcctctctttccagtggagtcgaagatatttgagcctcaatctctatataaagatgtatgatcacataaatagtctgattgattaagtaatggagttagcattgtcaagattattactaccgattagctttcgtattttaatgaatgtatttctgtcgtttaatgtctcttgccactatccaacgcaatctggatgattgacattttttattaattttaaaaacttactcatatatatatatatagatgattagtgtattcacggtctttgactcgctatagatcgtctcgtgttagaccaccactactactaagtactaagtactaacgaactaatgtacattaggatccacaaatttgaatttctcatatactatacaaattaatttcgggacatggccttttggattatctgtaatactctcttattattattaggtgtttttctatatatttatgaaagatccctgtagaccgagaatatatttatatttagtttactttttaaaacttaattatttatcccaaaatctttttattcatacaaaataaaaagatatagaaattgctgacaaaaaagattttgaaatttttgatacaaataataattatcactgctaaattttctgaccacacaattttttcattttatatttaaatattaatataattgatgagaaatttgtgatcaaaattttaatgcgccaactgtaaagcaataataacaactacactaccataacagctgtattccaatatcttgatgtttaaacaaaaatttctctttcttgaaaaacaaaattgaatgtgccagctgtaatgaaaaagacagctggtcatgcaaaatgacaaatgtatttcaatgtctattgatttttaaacaaaaataataattattaaggatatctttgtaattaaccattttaactttatctcttgaaaaagatatgaagtagtattcagtaagccatagttatatccaaacgttagaacacagacagcgggagcgtttccatttatttgggtattgagtccacgatatttctatgtctgtgtatctttcatgttgcgtcggccactgatgatctgttaatggtaatgattttctttttcttttctaacacacaggagagatccaagtcttaaccccatcatcatcttactaactacaacaacaatggtacactacgattatttccattttgtatgccctattcttttttttttaaacaatataccctattttatttaagaggttaaaactattgctgaagttttggtggattttcatttttgtccaggttcaaaacgacgactctgctgagtggaatacagatgacgatttgtattttgagattgataactttcagtcttctccaaagtcatcatctcctgtagtcacttcttcagaccacatgtttgctacgcttgttgacatgggattttcagatgacgtgatcgatagagcaattcaggaaaatggtgagccatttttgtatgtgaatgaatacatttgtttgtttagttttaatgtcattatcaatgattttgcaggaccaaatgctgaaacttccgccattattgacactatatccaagtactcggttagttttcaatttttgttttgatgggttctttctttgtcatatacagtttgtccatgtcttagtgtattctctcatttactctatgattatgttgtgaagatgaactgtgaacctagctcttctaagtctaagactatcgatcacttccttgccatgggatttgatgaggaaaaaattatcaaagccatacataaacatggtagacatttatctctctctctcttttaaagtatgaagttaaactctatgactttctttacatttgttttgtatcttgcaggagaagaaaacatggaagagatagcaaatgcactcctctcttctgaagtaagtggtgatattatgaagataccatgtcttctgatattaacaaaaatatcttaaattttattggtggtttgtaggcagatacattgcctataatgaaagaagaagataacatggactggtcagatagtgatgatgagatgaaatacgctgatttgttgagctcagacaacgaggtatatttagcagtacacaaaacaagtttataattgtatctcagtgttatttgcatatatgtataggttatatgcactttaataactatttttatttttaaacaattacagaaagatcaagactcctttgatagctgcaatccattgagttctttggtgaaaatgggtttctccgagctagaagcttctctagctatagagagatgtggtaaggttcccttttacttcttttttcttcacgtttcttcccaaggaagtgacataaactgtgattaaatgaaaccatagcctctgcttgtatggtgtaggcgttacatgtttctatttttctcacttatctatcatatggtgttgtgtgccttacacttatgcgttacatggtttaggcttgtctatcatagcctatgcttctatggtctaggtgttacatgtttctatttctctctcacttatctattatttagtgttgcctcaaacttgggcgttacatgtatatcatagactctgcttgtatggtgtaggcgctacatgtttatctctctcacttatctatcatatggtgctgccttaaacttaggcgttacaaatttacatggtttaggcttatctatcgtagcctatgcttgtatggtgtagggttacatgttgctatttgtcactcacttatctttcatatagtgttgcgttaaacgtatctgaaaattttcaggagacagtgtgagcattgcagacctcgcggacttcatttgtgccgctcatatagctagagaatttgatgagttttacattgaccctgaagaacaaaaggtatggttaaaaactcctataaaagtctgtcctgcaagttgattcgtttcataagttgttgtagttatttcatcaagaaaaggttgatgattttgtgggaacttgttgatttgttgttcattatcatcggaaaccagcaatattaaaccttgattttgtgtatgcagcctagacagaacatcaagaaaaggaggaaggagcctaggccatccgctaataaccagccgcttcacctaccaaacccaatgataggatttggtgttccaaatgaggcggtgttcatcacacatagatctctcccagcactagctcgtgccccaccgtatttctactatgaaaacgttgcttgtgcacctacaggcgtttgggagacgatctcaagtcatttgtatgacgttctaccagagtttgtggactccaagttcatatgcgcggcagcgaggaagagaggctatgtgcacaacctccccatcagcaacagataccagattcaacctgctccaaaactaacgattcaagaggcgcttccgcacactaggaaatggtggccagcatgggacacaaggaccaaactgaactgcatacttaccgttcatgctagtgctcagacaacaaagaggatccgcttagaacttgaagctcatactggcgaaccatctgaggcgacaaaaaggtatgtcattgagcagtgtaggaggtggaaccttgtatgggtggggaaaaacaaagtggcgccactcgatgcagatgaaatagagtctcttcttgggtttccaaaatatcatactcgaggtggtggcattagtaataccgatcgtttgaagtcacttggcaattcttttcaggtaacttgaccttgcatttgcatacatgtaatgcgtttgcttatgttttgatgttttgtgtttgaacttgttttttaggtggacacagtggcatatcatttgtctgtcctaacacccttgtttcctgatggtattaatgttctctcactgttcactggtattggtggtggagaagtggcacttcaccgtctcaaaatcccgatgaaaacagtcatctctctggagatttcagaagtaaacagaaacatcttgagggacttttgggagcaaactaaccaaagaggagtgttgatagagtttgaagacgtgcaagacctagctagagacaaaatcattgagttgatgaagcggtttggtgggtttgatcttgtgattggaggtagtccgtgcaacaacctcgccggtggtaacagagtaagcaggagtggtcttgaaggtgaacagtcttcgttgttctttgagttttgtcggattctggaggttgttcgtgagacgacaatggagatgagaagatcttga

SEQ ID NO: 344 - DNA, 4941 bp, Brassica rapa
tgttgaattattctatatctcttgatcttgaagagcctattggtccccaaattcactgaaatgctgttactattttattaattgtaccttgctttggctgttggaagtgtgattatatataagaaattaaatttcaagtgattccatgtcgtgtaactgatttcttgtacacttttttattatcttcgactatattaggtgtgaggtaggtggtgcatgttgcagtttctatacgattagagatgtatttttgttgttggtttagttattttatcattttgatatagattttacgaagaaaaatggttggatagcagcaattcacggaagagatcataactcgtagcttgcaagtcacatgaacaatattttctagcagtctgtagaatttcggtatatgcccaacaactcgtgcaagtcgtaccatttgaaaattgcaccattatgtaatcgtaacccgtgatctgattctgatgtaacgtctattacattttcttatgtataatgaaatctatttgtatgtgcagcaggcgtgtataataaataatatacatcattttttatactaatgtttctcaattgtcaacttaaatatcaacgtttacatgcacggatttgtacgcaattttgtgagtaatgccaatttgtgtagtccagtatcgtgtacgaaattcactcttttttgtcgtaaccatttttgttataaatggtaagtcctaattcgtatccttatgaacttgttgtcacatcaaagtcacatgtcagtattcaaacgatacaacgatagtaacttatacactagaaagcccaattagtattcaatcaaaagtagcccattaaaaagaatggatacccaaaaactaattgtaaagcggatccggatacggatcttcatccaactaaaacggagcgaatcaaaatacagcatatcgtttccatgctcatcccttgtcaatgtcgatgcttcactagtagacaaacggcggagcacgactctctcaccggcgaagaacagacttttaccggcgacgggagcgtttctgcttctctgttcctctcatagacgaaaaattctctgggtaattcctctaactctagtccacgatcttcgtagctttcgtacattcaactccgtttgtctcgccgttaaactcgatctcgccgtctatttttccatctttcttcgaaaacccactaagctctcttaaaagccccccactgaaacagaagagaattttcgttaggatctgccaaattattctcgaaatttgatcctttaaaacacttgtccgtctttcgcaaactttgaggacatgcattagtagtctcactgaaccactcttatcactgattccatttaaaaaactcgatctttctccagtcaaaagtttccaactttagcagttttgcgatgataatttttgtaggtttactctgaggaaggacgaagattcgttactctgactacgagtgtctcttcaccttactgctgctgcaaccatggtacattgctattaacttacattcttattctattgctgctactcttgactctcatcaaggtgctttttgtgaaattgtttatgcaggcgcaagattctgctgactggaacagcgatgatgatttggatttgcagattgataactaccagtcatctccaccgtcatccccaccggcggcagtcccttcttccgatgagctgtttgctacgctggttgacatggggttctctcctgagaatattgctagagctatcgatgaatatggtgagtgttgtttgtgttcgtatgtgttgtttgcttagtgttctttaaataatgtgattgttaaataaacttttgcaggaccaaatgcagatactgtggtgattattgatgctatctccaaatacactgtgagtttctactgtttggattctttctcctgcttactgtcttttttttagattgtgtgttgtttctcattcctcgtattattctttgtgaaggttacctgtgaagctagttcttccaagtccaagactattgatcatttccttgctatgggatttgaggaggagaaagttatcaaggctattcatgagcatggtaattaattctctatctctctctctctctctctttagttaagaagtaaaacgctctataagtctatatgattctttacatctgtcttatatcgcaggagaagacaacattgaagagatagcaaatgcactcatctcctcggcagtaagtgatgcaaagttatcatgtcattaagaatataccttatagatttgtctcatgacattaataacataacttatgttttttttggtggtttgtaggcagaggtatcgcccaaaatcaaagaagaagaggacattgagtggtctgagagtgatgatgagaagtatgccaatttcctcagctcagatgatgaggtatatttatttccttgtggtaataacatcagtacatcacaccagtcactattgtacaattgtctcgctttgttagttgcagacttgtaaattgtatgcattctaaaaaaaattctgttttaaacaatggcagaaagtttcagactcctcctctgaaaacggcaatcaattgcggtctttaatgaacatgggattctcggagttggaagcttctcttgctatagagagatgtggtactggtacgctttcctttttcttaacgtttcttccacgagatgtgtcataaacgccatacttgtatttgctatttgatctatgtaaagtcttagtcttagcttttgcttatgtgatgcatgccttagatttagtaatcgatactcttgttagatgtttatatacatctctctatcatatgttgtctccttctcggtacttaaggagaattatctgattaaaaattttcaggagaggatgtgagcattgcagatctcgcagacttcatttgtgccgctcagattgctcgagagttcgatgagttccatgctgaccctgaagaacaaaaggtatggttaaaccttctaagtccgttttatagtcatttcgtttcaaagtccatgaaaaggttgaatttgcggtctagttacattacacatttgcgttgcattttcattagaaatctgaaacatggattgtcctgtatgcagcctaatgtcaaaaagagacggatagagccaagaagagagccgaggtcatctgctgctgatgatgagccccttcgtctgccaaatccgatgattggatttggcgttccaaacgagccaggactcatcacgcagagatctcttccagccatggctcgaatgcctccatttttctactacgagaacgtcgcccttgctcccaaaggcgtgtgggacaccatttctagtcacttgtacgacgttccaccggagtttgtggattcgaaatatatttgtgcagcagcgaggaaacgaggatacgtgcacaacctccccatcagtggaaggtatcaggtccagcctcctccgaagtacacgatcagcgaggcgtttccgctgaccaagaagtggtggccagagtgggacaagagaacaaagctcaactgcatcctgacagtgaacgctagtgctcagctgacgaacaggatccggttagcacttgagccttatggtggagaaccgcctgagagtaagaagaagtatgtcattgagcagtgcaagaagtggaatctggtgtgggtgggaaagaacaaagctgcgccgcttgaaccagatgaaatggagactcttcttggatttccaaaaaaccatacacgaggcggtggcatgagtaggaccgagcgtctgaagtcactcggcaactcttttcaggtagctttcaacctcgcatttgcacagtcataactgttcttgtattcggcatagagtgttttgaactcatagagtagttcttgatcgctcttgtccttttaatgatgcgttttgcctatgattgaatggtttgtgattgaacttgttttcatcatgcgttttgcctatggttgaatagtttgtcattgaactttttttcaggtggataccgttgcgtatcacctctctgtcttgaaaccattgtttccatatggtatcaacgttctgtctctgttcactggaattggcggtggagaagtggcgctccacgttttgcctatgcgttaatggtttttgattgaacttttccatcttgcgttttgcatttgcatttgcataatcataactgttttagtattcggcatagagtagttcttgatcgctcttgtccttttaatgatgcgttttgcctatgattgaatggtttgtgattgaacttgtttccatcttgcgttttgcatttgcataatcataactgttttagtattcggcatagagtgttttgaattcattagagtagttcttgatcgctcttgtccttttcatcatgtgttttgcctatggttgaatggtttgtgattgaacttgttttcatcatgcgttttgcctatggttgaatagtttgtcattgaactttttttcaggtggataccgttgcgtatcacctctctgtcttgaaaccattgtttccatatggtatcaacgttctgtctctgttcactggaattggcggtggagaagtggcgctccaccgtctccagattccaatgaagacggtcgtctcagtggagatctcggcagtgaacagaaacattctcaaggacttctgggagcaaaccaaccagaaaggaaccctgatagagtttgcagacgtgcaagacctgagtaacgagaagatcgtggagttgatgaagcagtttggtgggtttgatctagtgatcggaggtagcccctgcaacaacctcgctggtggtaacagagtgagcaggagtggtcttgaaggtgatcagtcctgtttgttctatgaatattgtcggattctcgatgtggtgcgagaaacaacaaagacgatgagaagatcttag

SEQ ID NO: 345 - DNA, 3911 bp, Brassica rapa
aatagtataatttttctcataatcccaaaactatccctatatttaatctaattaaacacaatttaaaagttaatttgaatttaaaaaagaagttaatggaaaaaatgaaaaaaaaattgaaaggcaatcgaaaaaaaaaaaacggtatagatatgcatcatagagaacaagagtttgtgagaagaatcaaaagaaaaactatgggaaaaccatagattgatgaagaagagaagggagaatcattttttctttaattttttcaagtaaaatcgaccataacacgttttaggaagttagaatatttttaggagatttttataatatttccttaactgaaatttcattaattttcgcaaaaaatcaggtattcttatccgtagaaggcgacttctaaaagtttagaagaatgataaaaattttgaatacattttctactttgagtagacgtaagagtacattgtagaaaacacattccctaaaatttagaatactttataaacgtagaagatgcattcggaaggaaagtggatacctttacgattagtagaatgcacatttttagtagaacgtatctttaaaatcttatttaccaagtttttgaacaaaacaaaattaccagcttgtgtatatggatgttttattaattgtttatatttttaataatttttttgattctcaaaattatttatttcattagttttcagaaatacaaagggtaaaaaggagaaaaaatggacaaaactagttttataccaaagggacaacaacctggtttttttattctcttttggcaattttccctttttttttttgaacggcaaattattagcaacctagttaaaaaaaaaaaagactgttttaaaaagattcactttcctgtccctgtaacaatatagcacgcgcgactacagcgcgtgaaataaaaacagaggtttactacctcaacctcgaaatgaaacaagaactcattttgtccaaaaaaaatttgtccaaaaaaaactaaaaagaaaaaacaagaactcagaaaaaccaaaaaaaaaaaaaagaaaggttgaaatgaattagaacaaagttcttgggatcttcagaatctgctgaagtctctctcgagagcaatctctctttctcaggtaacgatcttacgtcttcatcgattgatttgacattcatcgtttcttcccccaattctcttctgtgttaattgattgattgattgatgccgacgttattcctttgacttttagggtttcacaattcgatgaactctagatcccaatgtttcatcatttctccagaaaccaaaacatgcatgctgtttttcatagaacttagagagacaatgaaacaattaactgtaggattgtgttctgttgtaaagctgtaacattttatcatgaaaaaggtttaaacttgatccaactatgtaactttttttttttaacaatgtgctccctttatgcagttcctttgatgcataaacaataatgcaacaacaacaagatggtgatgaagagcaacaatatgacagattatgaaaacaatctgtacaaaaagctcaagagcggaaagctcgaggtcagagtctcctaccgcactttcctctgtccttactgccccaagcagaaggttggtctctacatcgacatccttcagcacgcctctggagtcggtaacagcagctccaagaaacgaagtctcacggagaaggcttgccaccgtgctctcgccaagtaccttcgtaaagatctcgcggattacgctacggctacagtctctaggcgctcaaaggccttggcatcgttaactggcgatattcctctagcttatgatgatcagttcgagaaacttgtgtggccttggaaaggtaaggccctcatctctaaggcattcatgttagcatattactaatagaagttgtatctgtgtgttggggttaaggtattttggttaatataccaacaaagatgggacatgatggtctgtgttgtactggggagagtggaccacagcttaaggatgaactgatcagaagaggattcaaccctattagagtacgtaccgtgtccgtgtgggactgtttcggtcattcaggaaccaggatagttgagtttaacagacactggaatggacttaacgatgctttgctgttcaagaaggcttatcaagaagatggtcatggtaaaaaagattggctgagtagtggtggtggtgctgctgactcgagtctttacgcatggcttgccaatgctgatgattattatagggctaactatgtaggagagtacttgcggaagatgggtgacctcaaaagtgtttctaggtttgcagaagaagaggctaggaaagaccataagcttgtgcagcgtctgaacttaatctctgagaacatacagagtcagttgaggatgctagaggaaaaattctcaaagacttctattgcacttaagtgtgagactgaagaaaaagataagattctccatggttacaatcaaggtgaggtttttccctataactatgtagtagatatgtgtattgtttttgtttatattcattttacattttctgtagatctcacgggaagacaacaaagatcgactgatcatttcaacagaatctttgctgatcatgaaaagcaaaaggcgcagctggaatctcagatgaaggaacttcaaattagagaatctgttttggcgaaacgtgacgcagagaatgaaacacagaggaaaaacgtggcaaaagagcttgaacaggtatataaatgctaacttcctcatttcttaaactaagatctggtttgaaatctttcttctgaaattttttccatttgccatatataatcagagcgcagctaagtatagttacgttcaactagtagccgtggaacaacaaaaaaccagagagaaagttaagaaaatggctgttgatcacaaggtctgatcgaaaacacttccttcaaaaagaaaaaaagttttctctttaaactttatgtgacagggtcctgccttgtttttttaaccatagatgcaaaaggaaaagcttcgtgagagaatcactgcactggaaagagagcttggtcagaaacaagatcttgaacttgtggttgaacatctgaaacgacagttgagcgtgatgaggcacatggagttggacggtggtactgaaattgtgaacaaggtggagacctacctcagagaccttagtgagaaggaaggagagcttgcgcatgtaaacaaatttaatcaagatcttgtcgtacgggagcggaagaccaatgatgagcttcaagaagctcgaagagcactgatcagcgtatgtagattctatttcatacgaacaagggtctcacactacttgatttttccctctaaatggttttttcttcatttgattgtagaatttgagagacatgagatcgcatattggtgtaaggagaatgggggagcttgacaccaagcctttcatggaagcaatgagaagaaagtactgtcaagaagatctagaggattgggcagttgaaattatccagctctgggaagaatatctgaaggatccagattggcatcctttcaaacggataaagcttgatgctgcagaaactatagtggtacctaaataatatgcttcatgtgcatgttgtgacttggtttatgaattggtgcttgataatatttttttggcaggaagtgatagatgaggaggacgagaagttgagaacactgaagattgaactgggggatgatgcgtaccaagcagtggcaaatgcattgcaggagataaacgagtataacccgagtggaaggtatgtttcctcagagctgtggaactttagagaagagaggaaggctacgctggaggagggtgttacttgtttgctggagcaatggaatcaggcaaagcgtcataagccttaa

SEQ ID NO: 346 - DNA, 3628 bp, Brassica rapa
ttgatatgaaaaatgtgtaagcttgaagtaagactacggtgaagaagttttacatggaagtggtaagactagatgatcacagttcaggctgtagctatgttgttagagagctaatggagcgatgaggtaaagcaaaaggcgaagatggaggaagcaaacgagcttggtgatgaagctactgttgagtaacaaacaaaagaggtgttggctgttgagattcaacagttgcactacacttgattgatatgcgaggatggttttgcttgctccttcgacttcaaaagtgtaagattcctccacatatgagaggatttactccaaaaagtctgggtgtgcacaaggaaaatgaatattacaagcattactccatctccaaggcaagcaagatagataacagaatattgacaataaaatgatagacaaaaagcgtctgtagtccaacggttaggataattgccttccaagcaatagacccgggttcgactcccggcagacgcaaactatttttaactaattctttaaattatattttcaaatttgaaagttgaaacaatgccacggaggatttttatacaccgtttcggtagtgaaaaagagtcagaaatgcgtgtttttgtggatgtaagcaataaaatctggtggatgttaagcttaaatttgaatggtgctacttttgctttttttgaccttaacgctgtataataaattagtacagagacatctgagtaccaatttagcaattcttggactctaaaccttctccatgcaacagaagcttccgttttagtcttgtgccccaagtttttaaaaaaagttaaaacaaaggtttctgcgtggtgttggtcttggctaatcttttaccctctctggttgtccgaatttacaggattgccactgaggttgcttgcattgtctttatctacaacgtcccaacaattaactgagggaagaggaagagacttttgagcgtagcaacacacacacagtttctgtgattcactagcaaaagcacatcggagaaaaaggtatttggtttttatttagtaaaatgcctccttctctttcacatcctcaagtttgattgttttcattctgataaaatctagaaaataaaacaaaaaggttttttttcttcacaacaagtcatttctttttgttctctactcactttcatgtttgtagatgtgataaaacaagactgtggatcaaacatttcttcagtttttgttttgtcctgatctagagaataagaaaggtaacagctttaggtcttcgttgccctaaagaacctgactttggtcttatgagtaactaaaatctttggattatctatttctgcaaagcttttttcctaataaaaccaaaaaggtttgtctttttactcatagttcatgcaaaatcaaaactttgatgctctagaaacatggaaagtaaccaagtcttttcatttttggttgtatcttgcgttctcatatgggttctctttgttgaacctctaagatggagaagcaggagttttcagttggagattcgtccggagagacaaagaaaagtgagtgtactgaagagaagtttgtgtggccatgggttggtcttgtagctaacatacaaacggaggttgataaaacaggtcggagagttggcagaagcggttcaacgttccgtgatgagctcatcgagaaggggtttgatccaacaagagtccaacccatctggaacttcaagggacactctggtttcgccttggtggagttcaccagagacattaaagggttcgagaacgccatgaacttcgagaggagttacaaatcagacggccatggcaagaaagattgggagaaaggtaacaacaactgcttcttctgaggtttgagatcgttttgtttgctatatgacatttaaaagtttctttcttttttttttggatcaggtgttcacttgagagatgataagccctacggatgggtcgctagagaggaagactacaaccgaggtgggattgttggcaagaatgttaagaagaagagagacttgaaaactttatcacagcttcaagaagaggaggaaaggaaaatggttcagcttgttgaaagcatgtctcagtccattgagatgaagataataagcaagcaagagctcgaacacaaagtggatgagacttctcgtgttctggagagtgtggagttgcataactatcagctaaacgaaacgtacaaacaaggtatgaaaacacctgaactagtcttacagcatatgttacttgtttggttgttgacatagttatttttgtattcttgatgagaagaggttgagaagatgcacacgaacttgcaagggctgtatcagcagattctggcaggacatgacaagtctatgtctgacctggagacagagagagagaagctggagaatcgtgcgaggcagatctacattaacgaagctgagatggaaaaatccagactcgaaatagaaatggtgaatgattctttctttctttctaaattagaccaaaaggaatcatataacagagttaaaatctgttacctttttttgttcttacagaatcaaaaggcgatgatggagcagaatgaagcgaacatggaagccatgaagcttgcagagaagcaccaggcaagtacttctttagtttgactgaacatatcccaataccttttgagtgtctcaaaaacatgaaaacttattgcagaaagagaaggagaagcttcacgagaagataatggaaatggaagcgaaactaaacgaaacacaagagctggagctggagatagagaagctgaaaggcagcaccaatgtgatgaagcatatggctgggagtgatggagatggggagttgatggagaagatggtcaagactcagatggagctagaggctagagaaacagctctacatgataagataatggctgtgacacaaaaagaacgtatggccaacgacgagtaccaggaggctaggaaagagatgattcaggtacaaaacaaaaacaatataaaatccatttgtgtgtccttttagctgatcatattactttgatgagcagttctggaaggagaatgaggatttggtgagtggggaggagataagagtgaagacgatggggcacttagacacgaagccgtttgtggtagcagtgaagaagaaacttagatgttcagaagcaagggcagggctaaaagctatggagttgtgttcattttgggaaggacaaattggaaatgtgcattggcatccatttaaagtggatgaatctgatggaatcgcaaaggtatggatggggacttaaaacatattagatttttgaacatttcctttattattacaaagtattattatctcaagatgtcttacatgtgaaaattgcagctagtggttgataaaaacgatttgaagctggttaggctgaagagtgactacggtgaggagctttacaatgaggtggtgagagcgaaagtggagatagtggaatacaacccgagtggtggctatgtggtttcggagatgtggaaccttgagaagaaccgaaaggccacgatggaggaaggaacggatgtgatgttgaagatgaggaagaagctcgtggctatgaagaacaagcgaaagaggcgttga

SEQ ID NO: 347 - DNA, 2662 bp, Brassica rapa
cttcttcttgaatcttgacgacacttgagtaccaatcgcccgctttgccatcgtcaatcgtcatcttcttcttccctcggtaagttcattttttcttatttctttaatctgcattcttcagagaaactaggaacagaaacataaactgatgtgaagaccgatctcatctgaatccgaactcgctgtccaaattcccttaactctaagcatctgaggctccttaattacgaaaaaaatcttcataatttctttgaaaaataaacatgcaattgacataatgctttgtttaagaatgaaaaaaggaataacgttttgatcatatttttatttttggaacaacaagatgggtagcacggtggttttaagctcagacgaagaagattcagacatgagcgaatctgaaatggaagcgcatgcagacaaaatctacccaactcttaaaagcggaaagctgaaagtgaaactctctccacaagctttcaagtgtccttactgtccaaacaagaagaaaccaagtttccagtacaaagatctcctccaacatgcttccggagttggtaacagcaactcagagaaaagaacctcaaaggacaaagctagccaccttgctcttgtcaagtacctccaacaagatctttctgactcagcagctgcagagccttcatctaagcgccaaaagaccggagaccctattcaagactgtgaccaggacgagaagcttgtgtgtccttggaaaggtatggtaaataaactcactctgcatccaaatattgttactttattgattgtgtgtctatcacattcacaggtgttgtggttaacattccaacaagaaagacacaagacggtcgatcggcgggtgagagcgggtccaagcttagagatgagtatattcaaagagggtttaaccctactagggttcgtcctttatggaatcactgggggttttcaggaacagctattgtggatttcaacagagactggaacggactccacaacgctcttctgtttgacaaggcttatcaagtagatggtcatgggaagaaagactggctgaagaaacatgggcctcctaagacagggctttacgcgtggatagctcgtgctgatgattacaacggaagtactctcataggagaagacttgaggaagaagggtgatctcaagactatagctgaggttacggaagaggaggcgaggaaacagcagaagctcgtgcagaatctgacgcagcttgtggaggagaagaagaaaggggtgaaggagtttgaggagctgtgttcagtgaagtccaaggaacttaaagagaggttggaagagaaggagaagagtttgcaaaagcataacagagagctgaatgctatacaggagagaacaatgggtcatgttaacaagatctttgctgatcatgagaggttgaagatgaagctggagttggagaagaagaaacttgaactcaagggtattgagttggctaagcgggaagcacacaatgaaaccgagagaaagaatctctctgaagatctacaacaggtgttccacctactctcttattcaaatataagttaggcttaaaactgaatagttttggtctttgttgttatcagaatgcctccaagaatagctctcttgaactagcttccatggaacaacaaaaggcggatgaagaagttaaaaagctggctgaatatcaaagggtttagtgtctttcctcttcttattctcccttaacaaaggcttttattgttcattagtacttgtgtgatgttgtaaactctcagaggcaaaaggaggagctccatgagaaaatcataagactagaaagacagagagatcagaaacaagccatcgagctagagatcgagcagttgaaaggagagctaaacgtgaagaagcacatgggatcagacggcgacgctgagattgtgaaagaagtggaagaaatctataaaggtttaacggagaaagaagaagaactagcagacctggacaagtttaaccaaacgcttatactcagagagcgcagaaccaacgacgagcttcaagaagctcgtaaagagttggttaacgtacgtatcaaaagtgtttgttttctttctttttttcactcaaaacgttttaatcttttgtttttcttgtagattatgaaagagtggaagttaagtatcggtgtaaagagaatgggagagctggtgacgaaaccgttcatggatgcactgcagcagaagtattgtcagcaagacgtggaggacagagctattgacgttctccagctctgggaagactatctcaaagaccctgattggcatccattcaagcggatcaagctcgaaaatcaagaaagagaagtggtaagaagaccaaaatggttttgtactgcttttggttaatgttgttgtatcctttctctctgaaagattaaagcttttttttataggaagtgattgatgagagggacgagaagctgaaggagctaaaggacgatttaggagatggtccttataatgcggtaacgagagcattgttggagataaacgagtataacccaagtggaaggtacattacaacagagctgtggaacttaaaagaagacaggaaggctacacttgaagaaggtgtcacttgtttgcttgatcaatgggacaagtcgaaacgccgctga

SEQ ID NO: 348 - DNA, 3929 bp, Brassica rapa
atactgattcttttaataatttatgtatattttgtcatattgattgtttagaatttaaggcgaaaaccatattttgttatatatcctagaccagtttacaaataccgaaaaatctgttcgcaaggtttctcattcaacgagttaactccatcacaaattaggatacactgttgtttttaacacaatttgtcgctgttttctaatttaacacgagatccggctaacactgaaaacgaataagatgtcaaataaatataaaatatctcgatacatttgaaatgttatgtttcaaaatgcttgtgaaatctacgtaggaggatgatggaaaataaaactgaatgtagtatttaaacgagacccaaaactaactcaaagctaaaactgatccttctcctttgggctctacaaattgtaaaacgtctaaaagctcacaagtagaaatgggcttctaactttagatcgacccgattctctgtttagattcgaaagtacagaagtagatacgtaacatgtaacatgtaacatgtatcacataatactgaacagtacgacgacgcaactcaactactaactgtaaaagtcattacgcgtgtgacaaacgcgcatcagtgctacagcgatcatcaatcaaatcaagccttggaacacacaaaaattgtctttgttaagtgtactgtggcaaaaacaatgttttacagattccaacaagtaataaaaatagttacgagttacgactctctgatgtcagtgaaaaagaaagtttgtatgccactttaagaataaaaaataataaacggtaaaaaatctaaaagagtaaaaattaaaaagtggatggatatatggtgaggattgaaagacagtaaatattcgatacgtcagttttttagtcttgactactctctctcatctcttattgactttttcctttttactttaaaaaaaatctctgataggaaaagtaataaattaaaataaaggacatacataaactgtagagtatttttaatttggcttcaaccctaaagctagtgagaagagagagagaggttcgtcttcttcccgacactatcgccggcttcaccatctccatcatcatcatcatcttactcctcccctcctgtaagtttctccggtgaactattttatttttttcaatttgcattcctcagaagaggacaaaacagagtttcactttcagatcgatgatgtagtttgaattcccaactctcttctcaattccctccctctttaattacgaacacatcttcataaatctctttcaaaatatcaaacatgcaattcacttatcacttcgctcaacaatgtaaaggaataaactttaaataaaaaaggaatcatctttagaggaaaaagtaatggaagggaaccaaccacattgctaaaattcaaaaccagaccagatcagattctttttaaaaatattgataattgagttcatattctgttttgcaaaactgtaatcttaaaccaaggaacaagatggggagcacggtgatcttgagctcagacgaagaagattcagacattagtgattccgaaatggaagagtatggagacaagatctacctatctctcaaaagcggaaagctcaaggtcaaactgtctcctcattctttcacgtgtccttactgtccgaacaagaagaaaccgagtttccagtacaaagatctgctccaacatgcttctggagttggtaatagcaattccgacaaaagaaccgcaaaggagaaagcaagccaccttgctcttgccaaatacctccaacaagatcttgctgatgattcacaagctgagccttcttccaagcgaagaaaaactggtgatcctattcaagattgtgaccaggatgagaagctcgtatgcccttggaaaggtacacacttattaaactcttaagggtcccaatggcaacatgcggttctaatagtaacaaaaacatatatatatatatatatatatatagatttttgttactattaactgcggtgctgtttctaaacattcagactctaaagaaactcactttgttaggtaatcttgaggaagtttttattgattgttgtgtgtgtatgttctactgaaacaggtgttgtggttaacattccaactacaaagacagaaaatggtcgaaccgcgggtgagagcgggtctaagctaagagatgagtacattcaaagagggtttaatcccaccagggttcgtactttatggaaccactgggggttttctggaacagcgattgtggagttcaacaaagactggaatggacttcacaatgctcttctcttcgacaaggcttatcttgtagatggtcatggtaagaaagactggttgagaaaagatggtcctcccaagtcaggtctttacgcgtggatcgcacgtgctgatgattacaacgggaataacatcattggagaagacttgaggaagaaaggtgatctcaaaactatagctgaggttacggaagaagaggcgaggaagcagcagaagcttgtgcagaatctgacgcagcttgtggaggagaagaagaaaggagtcaaggaaattgaggagcttcattcagcgaagtcaaaggagcttaaggagaagttggaagagaaggagaagagtctgcagaagcacaacagcgagctgaatgctatacaggagaggacaatgggtcatgttaacaagatctttgctgatcacgagaggttaaagatgcagttggagttggagaagaagaaactggagatcaaaggtgttgagctggcgaagagggaagctcacaatgaaaccgagaggaagaacttggctgaagatctgcaagagaatgcttccaagaatagttctcttgagctagcctccatggaacaacaaaaggcggacgaagaagttaaaaaactggctgagaatcagagggttagtgtctttcttctttcttgttaaggcttttattttcataatcattattaaaaaatgtgatgtgtgacctctcgcagaggcaaaaggaggagcttcatgagaagatcataagactggaaagacaaagagatcagaaacaaatgatagagctagagattgagcggttgaaaggagagttgaacgtgaagaagcacatgggatcagacggagacgctgagattgtgaaagaagtggagaatatctataaaggtttaactgagaaggaagaagaactcgctgacctcgacaagtttaaccaaactcttatactcagagagcgcagaaccaacgatgagcttcaagaagcacgtaaagaattggtaaacgtacgtatcaaaatgcacataaacgtatatatctagcattatctaaatctttggttttaagttttatctaaatcactgcctttttttcttgtagattatgaaagagtggaaacaaaatatcggtgtaaagagaatgggagagctggtgacgaaaccattcatggatgcactgcagcagaagtattgtcagcaagatgtggaggacagagcaatagacgttctccagctctgggaagactatctcaaagatccagattggcatccattcaagcggatcaagcttgaaaatcaagaaagagaagtggtaagaagaccaaatgtttttactctttttggttagtaacttaatattgaatcattctctctgaaagattgaagcttctttttttgtgggtttattaggaagtgatagatgatagagacgagaagctgagggagcttaaggaagatctaggagatggtccttataatgcggtaacgagagctttgttggagataaatgagtataacccaagtggaaggtacattacaacagagctatggaacttaaaagaagacaggaaggctacacttgaagaaggtgtcacttgtttacttgatgaatgggaaaaggctaaacgcaagcgtggaatggcttaa

SEQ ID NO: 349 - DNA, 4116 bp, Brassica rapa
tcgtgtggcccatatttacaaaatattatatatataataaatataagaaaaatcagatgtatttatttgttaggcgaaattaatttgattcaaaaatgttttctaaatataccttaacgaatttctaaatgaagtaaaaatacagtgacattttctaaaatcatgaacataaatgtttgatagatatttgccttttttaaatcttacaataataattgcgctataaagttttattttacgaacacaatatgtctagatttacgatctaacaattactttataaatttcaacattaataatgatgatatataatattaccataaaaaggatagttttaaggttgctatatagatttaagattagtgtatagtcgaattaattatatatatagtatatcttcttttaaattcttacgtagaattaagttggtttcaacataatatttccgttttaataagatagatttttttcgtacgaatatctcaatagaaattataactaaactatgaataaaaacatagaaaatagaacaactccagttcaactccggtatggaagcgttagaccgaatcaaagcaaattcaattccagttaagacaactgagattggtttggtttggtctacaaagaccattcctatgcacgcgctagaggattaagccacacaatcgacgtgtttgtttgctactctgcatatttcgtcttcctctccactccaacaagcttacgtgcgtctctcccatcccacctgctcccaactcgtcgccttcctcttcgctctccaaaggtttcgcatctctctcctcccgcttctttcccttacacttctccttaaactgtatctacagacatctgcaaaatttgttctttctgaatttttttttatgggtttcatttcgtttcgttgatttacgagtttacagttttgagctctgtagaagagtaaagacctcaacttttctgatcttctcttttagttagcgaaatgtcgttggatttgagttagggttttgtgttctgtagctcagtctcactaaagttggtgtctttatgatcccctgggttgtttcttactctgatctttccaaagatgtgaacttttagtaagtttatgtaactgggttagtgaatctcaggttctgaatgggtcttgtgtgttctgtagctcagtcttactaaagttcgtgtctttatgatgttctctgttgttttcttactctgagctttgtagaggagtaaaaacgtcaacttttttcatgatcttctcttttgggtaacgaaaatgtcgttggatttgagttagggttttctctgagctcagtctctactaaatttcatgtgtttgtaacttccctgtgtcgttcttcttcgtctaagctttcaaaagatgtaaacttttagtaggtttatgtgaatttcaggtataaggttcagtgattagtgttaattatatatgtatttataccaagttcctttgcatctttgtggttgcaggttgcaatgtattcaagaagagagctggatgatttggagtacagatactactctgaaatgaaagatggaactcgcaaggtcaagatctctgactctctcttcaggtgtcccttctgctacttagaccgcaagcgtgattacaactttgacgacttgcttcgtcatgcttacaacatcagcggtagttcccgcactaaggatgggcgagagatagctagacatctcgcacttgagagatacatgaagaagtatctccgccctctggaaagaccatcatcagatgtctcttctcttcatacagaggtgttaaccggaagctggataacagcaggctcatcaagctctgctgcaggggaagtgaatagcagcgttgtcaaatccagttcaccatgtatcgctgaagctgaacctatgtctgtctcaggaggagatgatcctgtaccaagcggtgaagaaagacagatgttttctcctaaacacaactcctctttgagcaaccaagacaatacacacccttccaaaagagcttgcctcactgctggtggtaaagagggagaagaacctgtccaacagagtggtctcagccatggtgctccaagatatcctcagaggcgtgatcctttggctgctcgtaatgatggtctgatgtttgtgcatccatggaaagggatcttggccaacatcagtagaacttttagtgagaagacaaggaagttcactggcgagagtggaagcaaaattagggaagagtttgttagcaaagggttcaatccccacaaagtggagccactgtggaacggcagagttggtttcacaggttttgcgattgtttactttggcaaagactgggaagcttacaggaacgccaccatgtttgagaagcactttgaagtcaatcagtgtgggaagagagactatgattctgcacgtgatcgtggcgaagagctttacggttggatagcaaaaagggaggactactactcgagaactgtagttggagaccacctcaggaagcaaggggacttggtgactgtttctggaaaagaggcagagcaacaaagaagggcattcacgcttgtctccaacttggaaaacacactcgagaccaaaagcactaaccttgaagaaatagagagcaagtacaaagaaaccagtacagagcttcagaggagtatgaaagagaaggatgaaatgatcaacgctcataatgaaagtatgttttttctctctctcttacttactgatgaaattaaattagtattctcaagcttaatttgttttttaactaatttttcaatgtttagagatgagtagcatgcagcaaaaggcgcgtgattatttggcgagtgtgaaaaatgaacatgaaaaggcagctcagcatctggaagctcaaaggaaagagtttgaagagagggagagatatcttgataaatgtcaaacgctgaacaaaactgagcgacgaaagcttcaatggcaaaaacagaaggtaatgttcaacatcctttgtacaatccctttttctttgttaaagttttcgcaatgaaatcttttaaattgatttgtcagaacttaatggctactgaagagcaaaacaaaactgatgaagaaatgacgagagtggctaaacagcaacaggtgtaggctttttcttttagtgcatggataatgttgaagttgcagtgtctgttttgatttgctggctgtttgttttggcagagggagaaagatgagttacgtgagagagtcaaaaagctggagaaaaaactagatgatgagctggcattggagctggagatagagagaatgaggggtgggctgcaggtgatgggacacatggaagatcctgatatgaaggaagagatagaaaagacaaaggaaaaactaaaggagaaagaagaggagtcagagttccaagagtcactctatcaagctcttgttgttaaacatggctacactaacgacgagcttcaggatgctcgcaaggcgtttatcagagtaagcaattctcatcctctctcgctgtgtctttcttcctgtaaggggaagaagtgctttgccatttgatgttatgatactaaccacgtttaagctatgtgtgcagtcaatgcaagagttgaccttacgtggtcagatctctgtgaagagaatgggagctttggatgagaaacctttccaaaaactaactaaagagagatatccagcagaagaggctgatgtagaagcagcaaagctttgttccttatgggacaaccacttgagagactcggcttggcatccgattaaggtcgtcctaatagacggaaaccacaaggtaacaacaatacaattcaatacacctccttttctctctctctcttaaacaatgctgtatacaaattttggcaggaggtgctgaatgaagaggatgagaagctgcaggaactgaagaaagagctgggggatgaagtgtttgaagctgtgacacaagcgctgatggagaggaacgagtacaatggaagtggaaggtacatagtgcctgggctttggaacttcaaagaaggaagaaaagcgactctcaaagaaggtgtggtttatctgatgaagttgtggacgcacctcaagccaaagcccaagcgtaagtaa

SEQ ID NO: 350 - DNA, 7865 bp, Brassica rapa
catcaactctcgaggatcctttgattcacaaagactctccttctcccaccacaactctaacccgagttccttgcgagccatcaatacaccaatgtcctcttccatcggctcttccctaacaggagcaagacgccgtcccgtgagataagctttcacgacggcatccacggtagagtgaccgaaggagaagaaagagacgttggactgcgaagaaggaggagtcgccaagattgctatctgtgcgtcggcgagaagacagagctgcgcggctttgctgtaaagtccggaacaacgtttggagaaagtagtcgcgcgatactctctcttcgggatcttttccatcttatcgatctttctcttagtgcctcctcctcctactcttttcaccattctgatgaaactaattaaaccctaagtcgagagacgtttttgagtctataatttttctatgttgcgttgtggagaagaaacaagtcacactctctccgcgtagggtttgcttttataaactcgcttcaagttgatttttgttctttccttttttctaataaaactatcaccaattagaatgtttcgtgcatgttactcgcttacataaaaacggaaatattgaggagtcttgggaggcaagtatcaaaacatcaatctaattcacatggtcacatgtcgaagaatctacaaatatctttttcctaagtaacactaaatttacagataggtagagattaggatgaaggaatgactgaatttcgttcaattaggcaacaaaatatccactgtaaagtgaagcttaataattttataaaacttcgtactctcaggagaacaaaaacacagttcaagcttttgctagatatgaatgacaaatatgagactcaagtgtaatttctttagaaaatggtacaagctttttaccatgttgaattagtatgaaacaacactgctatgcgttttggccattgcttcttctctttttcttcttgcttgctgatacttccataccctcttgtgctccgcatggttctatttttcagtcaaaatgtgattttgttatattatgtaaaaagtaattttgctacttttcacatcaaagtgtatgcattttttaacctcagatttttcactcatgttttgaccaaaagtcttaacatagttttgatttggtggaatttagagaatttcattttagaaaaggatataaattttcaattttataaataaaaaatttgatgttgcagataaagaaaaggattatgaatatacatctcactgtgagaagttaaggatttttttctatataacaccctccatttttagccaaaatcttttttatatatattctacttaatagccgaataaaaatatacacaaaatatccgattccattttcagtcttttcataatggttatatatattctagtgttttaagccaaaatcttttatatattctaaagaaattcttgtaaagggatccccatatgtctcaatcaaataaaggaatggatgatggaaactcatggatgattgagtatgattcatcaatggtatcgatttcaatacatacagatgtggcctggtaagctttccattatatatatatttttttttgcaactagctttccattatattacttagagtatcctcctccctcgttctagagacggggatgctattacgtaccccaaagttttctaagttgcatgaaaactagagaaacgttaggtgtatactagagaaagtatattattatttaaaacattaagaaaagttagtgtttattgggtagttttgtatagcaacctaaaaatcataagaatttagttgtgttagtatgtttttaagttaattaacaccctaagcttatattaaccaagacaatttatacataaagtacctgagaaacgtaatctatctatactataatttgagaagagattttgcatatttatcattttttccatgattttataataaatcattagtccaattagcccaattaatattattattaaaaaacatatttaaatatatttatcataatatttaagataatgaatcaataaatagatataaaaattccaccaatctatatatgtactattatttaaaatataatataattatatatacttatgatgatattttgggttattagttaaatatattaacaataaatatttttcttttcttattcttattatcatgatattttgggttattaattaaaagatatatgcaattatactattggataattgatcataaattaatatgataaaactgtcaataaaacatattttcaagaaaaatataattcttatatatatattgtgttgctaccagcaaataatatttttctattataacaattaaaataattttaaaaaatatgtttcagaagcgattttgcttatttgtcactttctccatgatttaggataaatcattagtccaattagttaaattaatattattattatttaatatatttatcattatatataagataattaataaataaattaaaaaattctaccgatctatatatactattatttaaattattatttaagtatatatacttatcatgatagttttcgttattaattaaataaattaaccatagatgttattgttttcttattcttattatcatgatatttgttctattggataattgattatatatatgataaaattgtctttaaaaaaagatatttcttatatatattgtgttgttttctggaaataatattttctattatcaaaattaaaaaattaagatattaatcaagcaaaaaaaattgtatgaagaaagtttctaaaatatttcttatatgtgagtatttttaaaaatacaacacaataataagcatatatatatattgaagaaaaactttgtaatacacaataatttaatgtctgatttaaatttttgtgaataaaaataataacttatcatgttggttattgaattaaaaaaaacatagattaataaatattcataaaaatattttgactgcatgtgcgggcaaaatatctaataagtacataattaagacaaattgaggattattttgttgtataaataattttaaagtatagttgtatttcctattcgattaacaccctcgttataatctctaacctagaaaaattgaacttaagtacatgagaaacgtagtaactaaatatttataaaatgttagagatttatttgattgttttagtaacttaaatgttagttaagttatgacttataaatgtgaggttttctttttctagtccaaattattacttaaaagttaaaaactagaagtacatgaaaacgcaataactaaatatttaagaaatgttaaaaatattttgttaatttactaacttaagagtttaattaagtgatcataattagtgtgtgtgtgtgttttttcctaagtgatcattagtgcctatccatttgtgttttggtttccatgcaacctagcacctttttgtactgtttatttttctttccaattgctgacgtgtcaggtctatgcatgattgcaggtatcgacttgggaaaccatcaacgcaataccccccttggcgtgaacctactctgaaaacagcaagggttgcgaaaagcattatttccttgctggtgaagcaagcaagaatggctaggctttcatttcgagatgtcatcaaaaaagtttccgagttccaaaagaacgataataaagcttacatttcttctgatccctcagctgtggagagatatttggtcctccatgggcaagttattttgcagatttttgcaaaacaccctataaaggaactcaaaaagtgtgcatttattactggtcttgcaagtaaaatggaggaaatacaccacacaaaatgggcaatcaagaagaggaggaaaatattgccaacgaaacccaagaataaaatattgccaaagaaaccgaagagcaaactaaggataggtaagggatatgtggcatccaagaggagtgctatgcaagcaacaaaaactcacctggttgatagaatttggggacagtattactcagaatatggggccattggtgcagaaaatggcaaggaaaaggttcaagaggagagaaaaaatgaagaagaagatgatgtagaggaaccttcggtcctggaaacaagatgggaaggtgatattctaggaagaacatctgctggtgagcctctttatcaacaagccctcgttggaggagaggtagtggctgtaggtggtgctgtcctcttggaagtcaatgaaacttcggtcatctactttgtggagtacatgttcgaaagttcagatcactgcaaaatgctacatggaagacacctagaaagaggatccgagactgttctagggaacactgctaacgagagggaactattcctgaccaatgcatgcatgactgttcagcttaaggacataaaaggaacagtcagttttgagattcgatcaaggccatggggacatcagtataggaaagagaacaacgctgctgataagcttgaccgagcaagagcagaagagagaaaagcacaacacttgccggctgaatatttctgcaaatgcttatattcacctgtgagagggggtttctttagtcttcaacccaacaacataagtagcggtacaggatcttgcagtccatgtaagatcagggaggaggaaaaggagcggtcaaaacccaagctgaatgcaacaatgaccgggtttttcttcaacggggttgactattgcatggaggattatgcatatgtcaaccctaaatttatatataaaccgaaaaaggataagaagtttgagaggaacgttgatttaaaatccttcgttgtgtgtcaactacttgaagtagttcttccaaaggtatcgtcattaaatggtttatttgaggttatagtgagaagattttataggcctgaagatacacctttagagaaggcatattcttcaaacatccaagaagtaagtactaagaattatctcttatgtaatgatgtttgatgtaaaggaggttattatgttggtttgtcttataatcttttttcgtttttcttttttgcaaaatttgttataggtgtattacagtgaggacgtacatattctccctccaggggcttttgaaggcaaatgtgaagtaaggaagaaacatgatatgcccttacgcaatgattatctaacattagacaatatcttcttttgtgaggtatataactagtttgttaacattattgctttattcaatacaaagttgaagtgttactataaactgtcttgtaacagatgcctgtccatatcaaaccgaagttctctaccattaaagacgacacacttctcagaaagcaaaaggggaagggaatagagggtgaaactgattatgatgagttacctaaagagatgcgtctggctacacttgatatcttttccggttgtggtggcctgtctaagggactggaacagtcaggtatgaattgtctcaagtcaacacttttatgtatttgagcaagtttgattcatttgtatgctttatgcacacaaggtgtatctgaaacaaagtgggctattgagtatgaagagccagcagggcaggctttcaaacaaaaccatcctgagtcaacggtttttgttaacaactgcaatgtgattcttaggtaaaaatggtcaacaagattaaaaaaacttactcttaatgatgaaggtttatttcttgtgtttgtgatgagttgttttgagattaattatcggcagggctataatggaaaaatgtggagataaagatgagtgtctctctactacagaggcaaatgaacttgcagctaaacttgatgaagaacagaagcttgctctgccactgcctggtcaagtggatttcatcagcggaggacctccatgccaagtatttttttttcaatattgctgctatattttgtctacagtctttgttaaagaagtgactattaaactgcttcaattttgcagggattctctggtatgaacaggttccaggaaggctcatggagtaaagttcagcgtgaaatgatactagcattcttgtcctttgctgagtatttccggccaaggtattttcttctggagaacgtgaggaactttgtgtcattcaatggagggcagacatttaaactcactctggcttctcttcttgaaatgggttaccaggtaaaaacatcctagtgctattagtagtgttttcaaaaccgggcgaacctgatgattcaactaagttcggccatggaccgatcagatactgtgttgggttttaaaattattcaactggataaaaactattaagattatcaaaagttcatgaaatgaattaacaaaaatactagttaatacttcagtgttctatatttgatatttatttatattttaactatatattatatattttaactatatattatatttactaaaattaattttacatttattgaacaaaattagtatccatataatttttgtgaaccaaattcgatctgatctaagcatattaaaacatgacccaaatatttatcgtggttcaacttccagttcggtcttaaaaacattggctattagttagtcacattctctttgtgttcaacacttgattactatttagtagaagttggcatgtccacttacaaagtctgtgaagttgaactcagcatctgtttaacaatggaagtgttttccaggtgaggtttggagtgttggaggcaggtgcatatggagttgctcaatctcgcaaaagagcttttatttgggcagctgcaccaggagaagttcttccagaatggcctgagcctatgcatgtctttggtactccagagttgaaaataaaactatccaaaagatcacactatgctgctgttcgtagtactcaatatggtgcacctttccgctcaatcacagtgagagacaccattaacgatcttccacctataaaaaatggtgaatcagagaccaacagagaggtatgtatgatataacacatcatgaaaaaatatatttatgatacatatatcgaatcatttttttttcttgtgtcttgtagtatggagctgatccagtctcttggttccaaaagaagataagaggagacatgttagttctcactgatcatatatgcaaagagatggatgaaacaaacctcatccggtgtgaaaatataccaaagactccaggtgctgattggcgtgacctcaaaaacctcaaaaaaaaaaaggtcagtctaatgcatcatcctaactagcttaggggaactaaaaggaactcaactgtaaaatagagacaaacttaaatgctttgcttttcaaatgtaatacagattaagttatcaagtgggaagatggtagatatgattccagcctggctgagaaacaaagctaagactcacaacgggtggaaaggactctttgggagattagacatggaaggaagctttgcaacttccatcaccgatcctcggccaatgggtatggttggaatgtgcttccatcctgaacaagacaggattatttctgtccgtgaatgcgcccgatctcaggtaataataaaaactcttctgtgcatcagtaaacattgtggagatggcagagtacttgtttgtatggatggaaagatgtttcagatgttatgttgagtgttttcaatatatatagtaactgattggtatataaacaatggtgcaggggtttccggatagctataagttcgtagggggaatactagacaagcataggcagattggaaatgcagtgcctccaccattggcttttgctctaggtcgtaagctcaaagaagccgtacttctcaagaaacctcctcttcaacagaaaccctaa

SEQ ID NO: 351 - DNA, 6995 bp, Brassica rapa
atagacttcacaaaccaaacattcaacttttctgtataaagctcaatggtttgtaacagtgtaacgaagtgtatatcagtatatatatcattcagaataagataaaaaaacgaaaaactgacatgaaatctttggcaaaaatattgtaaggtatagttggctatagggggggcgttcagatacacattcggattcggtttagatctattcagattacagattttcatggtcaaagatttcaatttcattcgaatatttacaaatttcggtctggattcagttcggatcttttcaggtttgttcgggtttggataacccgcttaaattattttttaaaattttaaattcgttatatactttaaatttcttaaaatttaaaaataaaataatatattacatataaatttgaatagcgtatgccaacatgcctaaatttaacatataaattgttttgactagaatattttcatagagaatcaatagatatttcaagtgtttttttgaagtattgtttaactattttagacatttactttcaactatttgtatatattttaaagtttttttggaaacttcaaaatatcttatgtattttggatatttttatatattaaatctaaaaattattaatatattcaggtatataaatttattttgaattcattcggatattcgaaatactggttcggatcgggttcggggattcggttctctatatacaaaattttgaaaccgttcgaataattgaccaattttggttctggatttgatactattttcggatcggattctgttcaattttcaaattcgaatttttggtccagtcctactcgcatggttggataggggttaagtcccgttatgtcaataaaaatctctaaaaatgctggaatatcaattatgaatttttttcatggggggtaaatggaattaaatatctctcggatttctggactgccctaagagacgcgaaagagattttaggcgggatttgtcttttattttttccccttttagaacagaattttttagcgccggttgttgccgcgcgtcgcgtcgtttccctccttcttataccttctctataactcagcgaccccttagccaaatcctaatcctcctcgtcgtcctatcttcaatcgctctacctctcataagatcctttcgcatctctcctctcgatttcgcttctcaacgtaagtcttccactgttccgatctctaattacaacgcttgttaaacccctagcgctcattgctcaaccttataacctagattcgaactatctaacccgaaattgccatgaatctttagttgcttcgcctcaatttcgcttttaataataaaattttctgctgttttgatctcaattttaaaacccttgcgctctaattattcaacatttcaacctagattcttagtatctaactgttaattttgtttgtttcgcggcgattaattaattaactttgtgttttgctgacgtgtaggtttacggagatggtgagaaacggaaccaaggctggggagcaaaagaagagacctctcccagagatcaaatcagactctgacggcgaagacctctccacgaggcacactaggccgaagcgcgccgcagcatgcaccaacttcaaggagaagtccgtccgcatctccgagaaatccacaaccgtcgaaaccaagcagcaccagactgtggaggacgaagttgtagctctacacttcacagcatctcctcagggcggcggcgacgagcctcgtcagaccaggaggctgactgatttcatcttgcacgacgagtacggagtcccgcagcctgtggcgatggttgagatcggtgacattttcgtcacgggcgttatcttgccttctggtgaatgcgatgataaggagaaagggaaaggcgtgaagtgtgatggctttggacgcgtggagaattggagtatctcggggtatgatgatggctacccggtggtttggttctcgacggagctggcggattatgactgtggtaagcctgctactagttacaagaagatgtatgactatttctatcagaaggcgtttgcttctgtggaggtttataagagagtggctaagtctgcgggtggggactctggtgttagtcttgatgagttgcttgtggcggtttcgaggtctatgagccttgaaagtaaatgcttttctactgatttcttggttattagaaatttccttatacggcaaggagagtttatatataaccagcttgctggtttggatgagacggcaaagaaagatgaagctagctttgcggagattcctgtgctcgttgctcttagagatgagaatagtagacttgacaatggtgctgttattcagatggaaggaagaccttctaacggggttttgaggattgatggagtttctgaagctgcgaagtgcgaggccttgacatctgatcaagaaatggttgacgaggatcaaagatatgctagaattatgcaagacgaagaggataggaaaactatgcagcggcctaaaagaaaaaacggcgcagctttggcttctaataaaggatatgtaaaaaccactgaggatgagattgctggtgattatcctctcccggcttattacaagaatttcaaagatgaagcagatgagcttatagttgctgatgactatgaggttaactacgaggacctgcctcgcaggatgctgcacaactgggcactgtacaactcggattcaaggttcatatccctggagcttctcccgatgaagccctgtgcggatattgatgtgacgatatttgggtctggtttgatggcagaggacggtgggttctggtttggtctagatgatcctgatacttctacctctggacagccaaagaaggatcttgaggggatgcccgtattcctcagtcaaataaaggaatggatgattgagtgggggtgttcaacaatctctatttcaatacgaacagatgtggcatggtaagctgtctattctctattatttgtacccccatgtttctgcattgctttcttcttcttcttctgctgatgtctcgggtatatgcaggtatcgacttgggaagccgtcaaagcaatacgccccttggtttgaacctgttttgaaaacagctagggttacgataggcatttttggtctgctagaggagcaaactagaatgtctaagctctcatttgaagatgtcacgaaaagagtgtctgagttccagaagaacgataaagctttcatttcttctgatcgcttggctgttaacagatttctagtcggccatgggcaaattattttgcagatgttctcagaatttcctaaaaaggatatccagaggtgttcatttgttagtgatcttgcaaggaaaagggctgaaaggcacaacacaagatggaccatcaagaagaagaagattttgtttaaagtaaattgtaatccaagggcaggcatggcacctgtggtatccaagaggaaagctatgcaagcaacaacaactcgtctgatcaacagaatttggggagagttttactccaattactctccagaggaacccgtgcaggcagttggtgcagaaaacgaggaggaagaggttgaagaggagggtgaaattgaagaagatgacgcagaggaaactgttccagaacctgttgaggaggttgaaaagtctcatacccctttgaagaaaattcgaggcgtttctggtaaaacggaatcaagttggagtggcgagagtctaggaaaaacttctgctggtgagcctctctatcgacaagccctcgttggagaagaaattgtggctgtaggtggtgctgtcgtgttggaagatgatggaaacgaggtcatctattttgtggagtacatgtttgaaaaatcaaacaactgcaaaatgcttcatggaagactcttacagagaggatgtgacactgttctgggtaatgctgctaacgagagggaactattcctgaccaatgaatgcaagactgtatcgcttaaggagataaaaggaacggtcagttttgagattcgttcaaggccatgggggcatcagtttagaaaagagaacaccaccgcggacaagcttgaccgggcgagagcagaggaacgaaaaacgaaagacttgcctacggaatacttctgcaagagtttatattcgcctgagagagggggtttctttagccttccattaaatgatatgggctgtgcatctggaacctgcagttcatgtaggataagagaagatgaagagaagaagacagagatcaaactcaactcttcaaagacggggttttcgtgtaatggggttgactattccgttgatgattatgtctacgtaaagccagaagatatagatggatcgaaggaggctaatgggagatttaagtctggtcgtaacattggcttacgaccattcgttgtttgtcaaatactggagatcatcgtcctaaaagaatctagaaaggcttcctttgaggttaaagtgagaaggctttataggcctgaggatgtttctgacgaaaaggcctatgcgtcagatatccaagaggtatatagcgatgttcaaattaagttgctttgctggtttcttcatttgtgtttattacaatctttttaactctttttttttttcttctttttttggaatttgttttagttgtattacagcgaggacacagatgttctccaaccagaagctctagagggaagatgtgaagtaaggaagaaaattgatatgccctcacgccgtgagtatccaatatcagataatatcttcttctgtgaacagatctatgacccgtccaaaggttctctcaagcaggtacatatttttctaaaatcatataataggtgttcatataactcatttgttatgattattgctgtttccgatacaaagttgaagtgtttctttgatctgacctgtaaacagttgcccgtcaatatcaagccgaagtacactactgttaaggacgaggcacttttaagaaagagaaaggggaaggggttagtgactgaaactgattctgtgactgacaagcctgaagaggtatctaaagagacgcgtcttgctacactagatattttcgctggttgtggtggactgtctcagggacttgaacaggcaggtatgtattatctccagtaaacgcttctttatcaaccataaaaccctagaactagttggattcatgggcatgctttttatgtacaaggtgtctcggcaacaaagtgggcgatagagtatgaagagccagctgggaaggcttttagaaaaaaccatcccgaaacaacagtttttgttgacaactgcaatgtaattcttaggtaagtagccgacaaagataaaacactttctcttccaatgtggctattttctgtgttgagatctgttgtttgtaattatctatagggctataatggagaaatgtggagatcaggatgaatgtatctctactaaagaagctaatgaactcgctgagaaacttgatgaagaccagaaacgtacgctgccactgcccggccaagtggatttcatcaatggaggccctccatgccaggtatatgttctggtctttacaattgtcgttgaataagtgaagaaaaggtgttaaccagtgcaatttttcagggattctccggtatgaatcggttcaaccaaagctcttggagcaaagttcagtgtgaaatgatattggcattcttgtcatttgctgattatttccggccaagatactttctcctggagaacgtgaggacctttgtgtcattcaataaagggcagacgttccaacttactctggcttctcttctcgaaatgggttaccaggtgacactcgtgctctgtattttccacatatgaatgctcccgagtagtttagaatgtgaatttgacatgtgtgaatatgatgtgatgtgtggtaggtgagatttgggatcttggaggcaggtgcatatggggtttcccaatctcgcaaaagagctttcatctgggcagctgcaccagatgaggttctccccgaatggcctgagccgatgcatgtctttggtgttcctgagttgaaaatctcgctgtctaaaggtgtacattacgctgctgttcgcagtactcaatacggtgcacctttccgcccaatcacagtgagagacacaattggcgatcttccatcagtagttaacggagaatccaacacgaagagagaggtatgatgatgtcacacatgaggagaaaaaagtatcaacatgtaggaaactcatatgattcttttatcttgcagtataaagctcaaccaatctcgtggtttcaaaaggagataagaggagacaatattgctctcactgatcacatctgcaaagagatgaacgaactaaacctcattagatgtaagaaaatcccaaagaggccaggggctgattggcgtgacctcccagaagaaaaggtcagagtcttttgtattatcacactgtaaatcaaaggaatagttcagtgacgttaaatgctacatcttgtttacccttttttttcaggtgacgttatcaaaagggcaagtggtagatttgataccatggtgtctgccaaacactgcgaagcgacacaaccagtggaaaggactgtttgggagattagattgggaaggcaactttccaacatcaatcactgatcctcagccgatgggtaaggttgggatgtgcttccatcctgaccaagacaggattatcactgtccgtgaatgcgcccggtcacaggtatatagatattatgttcctagtcaagacggaagcttttgatttgttcctaaagtctaagtaatgaaattgattggttgtattataaaaaattgtggcaggggtttccggacagctatgtgtttcaagggaacataatacacaagcataggcagattgggaatgcagtgcctccacctttggcctttgctcttggtcggaagctcaaagaagcggttcaactcaagaaggtcaccaaaacaaactag

SEQ ID NO: 352 - DNA, 7049 bp, Brassica rapa
tcccaaaagaaggcaaaaaatcgtttttccaccaaaacgtaaaatttattttaccaccaaaacctaaaatttcatttttctgataggaaaacaaaacttgtttttctagcaaaaacaaaatttgttttcctgccaaaaagccaaattcagtttccagttaaaaaaacaaaacttgttttcctgctaaaacataaactcgttttttcgcctagaaacaaaaaaaaatcatttttccaccaaaacgaaaacttgtttttcccgctaaaacgtacaatttcattccccctccccccctcccaaaacacaaaaaaatagtttcccgccaaaacacaactcgttttcccaccaaaatacaaaactcgttttccctatagaacatagaatttcattttccactagaaaaaaaaacttgttttcctatcaaaaacacaaaaactcggtttccaaaaagtaaaatcttatttttctctcagaaacgtaaaatttcatgttcccaccaaaacataaaattttgttttcttgccaaaaacacaaaaattgtttctcaccaaaacgtaaaatctggtttttccaccaaaaacaaattttcatttccgccaaaacacataaattttgtttttcgcctaaaacgaaaaatcatgctcccaaaaaaaaatattaggtgtaactgttaaatataaaatagaattagtagaataaaaatgaaataaaggaatgaaatatgatgaaaaatggaatatatttctttccatgtattcatgaccaaaattgtaagtaaatgattcttttaaattttgtttacttttttatggaactgacgaaatgaacatttcatttcattaattacaaatggtaaaaattactgcggaataaatgaaatagaaattttacattatttcattccaaaaatcgacaatccagtcgcaacttcaaatgttgttttatctcgtttgcccaaaaataaaataaaatttcccaaggtgtacacactattcatgccaatgcgaaagacaatcaaggcgggcttattatttttaagttttttttattaattattattttacgaaaaatgtttaagcgccgatgatagccgcgcgtcgtttcactctgtctcatctccttcttatatactcttcaacccatcctcaagccctacctacctagtcatagcctcctcactcactcattcgctctcctctcgatctctccgtaacctaacgtaagctctcttctgctccgatctcaaagtagagtcattgttaaaccctacctctctcgctgctcatcattctaacctaaattcaaacgatccaccctgaagcttatatcgtatgttttattctgcttcgattttcaaattgctcactgttccaacctagattcgaaggattctacttaaatttctgtgattattgttgtttcgaagcgatgtaatgtttgattctcatttctagagttttgatcatgattttgagtatttttttctgtaggttttagaaaatggtgagaaacggaagcaaggctgcgaagcagaagaagagatctcttccagagagcaaagagaccgaccacgacgatgatctctccacgaggaagacgaggccaaagcgagccgcagcatgcacaaacttcaaggagaaatccatccgtatctccgagaaatccgccaccgttgcagcaaagcaccatcagactgtggatgacgagattgtagctctacacttgacagcttcttctccccagagcggcggcggccacgagcctcaccaaaccaggagactgaccgatttcgttttacatgataccgacggagtttcgcaggctgtggagatggtggaacatgtcgacatgttcatcacaggtgtgatcttgcctactggtgaatgctctgacaaggagagagcaaaaggtgtgaggtgcgaagggttcggacgcgttgataactggagtatctccgggtatgaagatggctccccggtggtatgggtgacgacctctctggcagattacgaatgcgttaagcctgctaccacctacaagaaggtgtatgattatttcttccagaaggcgtatgcctcggtagaggtttacaagaaagtggccaactctgacttgatgagtcttgatgagttgcttgtggcggttgcgagggctatgagcctcgagactaagtgcttctctagcgattacttggccatcaaaaatttcgttatatcccaaggagagttcatatataaccagctcgccggtttagatgatacggccaagaaagatgatgcaagattcgttgagattcctgtactcgttgctctcagggatgctagtagtagtagcatacttgaatatgatgctggtcaaccttctaatggggttctgaggattgatggagctgcggagaggaaggccatgtcatctgatcaacacatggttgacgaggatgaaaaatttgctcgacttgtacaagacgaagagtatatgaaatccatgcaaaggccgaggaaaagcagcagctcagcttctgtttcaaagaacggatacataatgaccactgaagatgagatcgccaatgattatcctctcccagctcattacaagaactcccaagtagaaacagacgagcttttgttataccatgacgacgactacgaggttgacatcgatgacctgcctcgtaagatgcttcagaactgggcgctttacgacatcgattcacggttgatatccctggagcttctcccgatgaagacttgtgctgatatcgatgtgaccatctttggatccggtgtgatggcagatgatcaagggatctggattgatctagatgatcctgctacctctatgccgtcagaggaacatggtgggatacctatattcctcagtcaaataaaggaatggatgattgagtatggggtgtcaacggtctcggtttcgatacgaacagatgcggcctggtatcgacttgggaaaccgtcaaagcagtacgccccttggttcgaacctattctgaaaacagcgagggttgcggtcggcgtttttgctctgctggaggagcaaactagaatggctaagctttcgtttgaagatgtcgtaagaagagtgtgtgagttcgagagtaaccataaggcttacatttcgtctgaccgcgcggctgttgacagatacgtggttggccacgggcagataatcttgcagatgttttcggagtttcctaacaaggagatcagaaggtgtgcgtttattactgggctcgcgaataaaagggcggagaagcacaacacaagatggaccatcaagaagaagaagattttgctgaaagtgaatttgaaccgaagggcgggtgtggcacctgtctccaagaggaaggctatgcaagcgacaacaacgcgtctgatcaacagaatctggggggagttttactccatttactctccagaggagccgttgcaggcagttggtgcggaggaagaggctgaagaggatgaggaggaggacgaggaggaaaatgaagatgacgacgcagaggaaactgaacctgaagctgctgaggtcgaagaggctcatacgcttccaaagaaaattgtaggcaaatgtggaaaaatggaaacaagatgggatggtgagagtgtaggaagaacttctgctggtgagcctctctatcgacaagccctcctcgaaggggaaagagtggctgtaggtggtgctgtcatcgcggaagtcagcggaagtcaggccatctactttgtggagtacatgtttgaaagttcggatcactgcaaaatgctacatggaagacttttacaaagagggtccgagactgttctggagaatgctgctaacgagagggaactctttttgacgaacaaatgcatgactgtacagttcaaggacgtaaaaggaacagtctgtttcgagattcgaacgaggccatggggacatcagtttagaaaagaggacgccgttgcggataagcttgaccgggcaagagctgaagaacgaaaggcgaaagacttgcctacggagtacttctgcaagagtttgtattcgcctgagagaggaggcttctttagtcttccgctcagtgatatgggctgtgcttctggatcatgcacttcatgcagattaagagaggatgaagtgcagaggaaaaagatcaaactaaacgcttcaaagactggtttttcctcctatgggattgactactgcgctgatgattttgtctacgtatacccagactgtatcgatggatcgaagaaggctaatgggaagtttaagccagggcggaacatcggtttaagagcctttgttgtgtgccaacttgttgagatcattgtcccaaagaaatctagaaagggttcctttgaggttaatgtccgaaggttttataggcctgaagatgtatctgaacgaaaggcctatgcttcagatatccgagaggtagcaattatttgttctgtaatataatatgcttcataagtttatcgtacaatctttttaactctgtgtttttttcttcctttttttgcaatttgttttaggtgtattacagcgaggacacctttgttgtccaaccagaggctctaaagggaaaatgtgaagtaaggaagaagaaagatatgccctcttgtagtgagtttccaatatcggagaacattttcttttgtgaacaaatatacgacccatctaaaggttccgtcaagcaggtatataatattgtttatataactcatttgttatgattgttgctgttcaaatacaaaattaaaattaaaatgtttctcttaactatcttgtaacagttgcccctcaatatcaaaccgaagtactctacagttaaggacgacgcacttttaagaaagaaaaaggggaagggagtagagagtgaaactgattctggtattgttgtcaagcctaatgagttacctaaagagatgcgtctggcgaccttggatatttttgctggttgtggtggcctgtctcaaggactggaacaagcaggtatgtattatatctccagccaacacttttatcaaccaaaagcgcttgaataagctggtattcatgtgcatgcttttgttatgtacaaggtgtatctgcaacgaagtgggcgatcgagtatgaagggccagctggggaggcttttagaaaaaaccatcccgaaacaacagttattgttgataactgcaatgtgactcttaggtaattaattagtagacaagatacagcgctttactctctctctcaatgtggatgtttcttgtgttgtgatcagttgtttgagattatctgcagggctataatggagaaatgtggagatcaagatgagtgtatctctactacagaagctaatgaactcgctgctaaacttgatgagaaccagaagcgtactctgccactgcctggtcaagtggatttcatcaacggaggccctccatgtcaggtatatatacatatattaagattgtttctcgtttgcataagtgaagaagagactttaatctatccaatttggcagggattctctggtatgaaccggttcagccaaagcccatggagtaaaattcagtgtcaaatggtattagcattcttgtcttttgttgattatttccggccaagatactttctcctggagaacgtgaggaactttgtctcatatagtaaagggcagatgtttaaactcactctggcttctcttctcgaaatgggttaccaggtaaaaaagactcatgctctctgtaagcattgcaatgtgaaaataaaattctcaaagtgtgtgctaatatgatgttttgtcaggtgagatttggggtgttggaggcaggtgcatatggggtttctcaatctcgcaaaagagcttttatatgggcagctgcaccggaagacgttcttcccgaatggcctgagccgatgcatgtctttaatgtttcacagctgaatatctcactatccaaaggtttacgctatgctgctgttcgtagtactcaacatggagcacctttccgtccaatcaccgtgagagacacaatcggcgatcttccacctgtagagaatggagaatccaatatagacaaagaggtatgatataacacacacacacacatcaggagaaagaagtgtttttatgatatgacacatatcaaaatatgtcttgtgtgttgttgcagtatgaaactgatccagtctcgtggttccaaaaggagataagaggaaacaagaatgttcccactgatcaccttagccaaacgatgaacgaacacaacctcatccgatgtaaaagaatcccgaagaggtcaggtgctgattggcgtgacctcccagatgaaaaggtcagagtcctataataagactcttatgcatatccgcctagacaaactttactaaactcaattatttttaacactctaattacaggtgacgttatctactggactggtggtggatttgattccagggtgtctagcagcgaaacctggtaaaaaaaagcagtggaaaggactgtttgggaggttagattgggaaggcaactttccaacttgcgtcactaaacctggtcccatgggtatggttggtaagtgcttccatcctgaccaagacaggatcgtcactgtccgtgaatgcgcccgatctcaggtaatatatgaacctcctttttctctttattagttaacgttttaggatcgcgttggcaaattaataaaatattttttacgattactttacaataaaaataaaaatctgtttaactacgataaaacaaaagctacataacacaaaggttaatgaatttgacattgaaaactaaaattagcatataaaaaatctgtaaaaatgtcaaatatttagaaagagagtaagtattgtgttccaagtcaagtaatgatattgatttggttgttatgtggcaggggtttccggatagctatgagttcgaaggggacatagcacacaagcataggcagattgggaacgcagtgcctccccctttggcctttgctcttggtcgcaagctcaaagaagcagtacagctcaacaacttcgccaaaagtaattag

SEQ ID NO: 353 - DNA, 2310 bp, Brassica rapa
gagtgtgggtcgacggaaggtctaaaagaacagacgatgtctttgtatttgtctgaaacgctttctaagaaaaagcacgggttcgaattcggtgcactggacatcaagagccacttggagaagctcagtttctcagagattgtttcaacgtctatgataatgttggtagcgtgaaactgtcttttctttcaatggcttctcctaacaaatgtttatctttggttaatagattttctccgaggacaaacacaaagatgcctatgagctcgtgggtttgccattttcacatctccaaggtacaaaaccacatacatgtgtgtctatatatggaataatattctaaaggaatttcccttttttttttttttttgtaaatgtgcagaaagttctgaagcagaaacaactggatgtcgaatctgttgtctcttcattaaacaagcagtatgcaaacaggaagaaagagctgaagcttgatgtaattgatttggagatacaaagcacgtaagatacatcctcaaaaatacagtattggcatttttatgtctatattcaatactaatctgttatatattttatgtgttgttgattagaaaccactgttcttgggatgataagtcaatggaagatgatagattctgcatcacagttactgttcttgaagcctccacacacggttctttggaacttgatgctattcgacttgtcttgatcccttttcttctcgactctccggtgaaaggtaaaaaaaaaaaaaaaagaacggacagttcttgttttgttagtagtacgagttgtgtcatatgatgtttcttgcaggctacggagagattaaaaaggtggagatcttatgggctgacagaccaaaagcgccgaaaaggaacaagaaacatatggcgggtgagcttttcgtgaaggttacaatgcatggagttcgtggcaaaaagaacatctggagcgctcttcttgaaacctgtcttcccattatggatatgatcgattggacaagaagccatcctgataatatccgacaatgctgctcggtttatggaattgacgctggacgtagcatcttcctagcggttagtttcttttgtacagtttgtgggagtcttgcagcttctaaagttttggtgatggttgcaggatttggagtctgctgtggctgatactggtaaggggatgctgcgagaacatctgcttcttgtagcggattgtctctccgttacgggagagtttgtggcattaaaccccaaaggttggagtaaacaaagacaggctgaatccactcctgcaccttttactcaagcttgcttctcggtattgtaaactaaactctaccaacttctttttccggttgtgacatttggtttaaatatctacagagcccaagtcaatgctttctcaaagctgctaaggaaggtgttacagacgagcttcaaggatctatcgacgcattagcttgggggaaagttccttctttcgggactggagatcagttcgaaatcatcatctccccaaaggtaataacttcttctttaacattattgtttagtcacgacttcttgtaaaggtttttaaattagtggtgtattcatgcgttgattaggatcatgggtttagtagtacaccagtaaaagtgtatgactttctgagtagtacagcaacgcttccaaagagaaaggcaagctccttgcccaaatcagacaacttcacggtccagccgttccccttactcgatactgctctctccaaagcagtgaagacactcgatgggaaaggactcaccaggtcgcagctcagaacgatctttacatgggacgacattgaaaagctttcccggtcactgaaacgtattctctacaagtaaggaaacaaaatagtcttttcttgctttcaaaccttttgacattcagattcttttgttagttacgagatcgatgctacgttgaatgagagggatgaaagacttttgatgatggctcttctctttcaccccaacagagatgagaagctaggaccaggcttccaaggaatcaaggtaaatcatcctaagaaaaaaaaaaaaaaaaactctttatatgtttcttgaaaaacattataagattctgacctggttttgtcttacaggtggctaattctaagcatgggaatgctcgttgcttcgaggtggtgagaacagacggaacaacagaagatttctcttaccataagtgtgtgttgggagcgacagagatcattgcccctaagagagttaacttctacaaggccaagtaccttagaaacggtacggtgcaggccggtgctatctaa

SEQ ID NO: 354 - DNA, 7444 bp, Brassica rapa
accaattgatgaacaaatattcttattttctgacgtaaagattataattttcaatttaaacatggttttaaacccccaaaaaaatctaatacagctaataaaatagtgttaaggaaaagtggggatcgcaggattataaagttctgcttttcaaggcagattcaaagtcttatacaaataaagtaactgaactaaacagagaaacaaataaaagaaaaaattaaaaagaatgaaataccaaaaaggtaaaagtaattgtagtacaagtcaaggggtaatttcggtattccaactacatcttcttcctctttttttttcttttttttttcaattttcacaaaccaaaagactctgaaggcagatttttcgtttcctctgcttcctcctctggcgtttccttcgggagaacaaacgccggtcatcgggtttcgaaaaccagtaaggagcttttactacattgttctcagttctctcagtcttcttctttgctggtttacttttttttctttctctcttcttttccttttttggttatttacgatcaatctctctgatttctcgtctcgattttctttgtttttgatcgaccctcttctgtgaaatccaagtttcttttactaacctctgtaagattctcgatgattctgtgaatttgcgatcgtcaaaattttgcaaagttgagtgttttttttagtgagccttcttgaaaagggttcttgtctttctttctttctttctcagaactccattagtggggttcttagctctgtgagttttaaagtacataaaaataacaaactttcagtaacatgtgttcaaagttgaaacctttttgtatgcgtttgtgtttggaaatgattttctcttctgtgggtcttgttgaagttttttctaagatatttaaataatgtgtgttcaaagttgaaaccttttctgggggttgtgtctggaacagaatctcctttttacgatctgtagatgatttgtctcctttctgggttttgttgaagacttctctttgatattcaaccagtgaatctattatatgtgtactattaagtttaaagttccgaaagtttgtacactttgtgtgttcaaagtttgaacctttttttttgtgtcttctgcaaacaaaaaaagttttttttttccagggttgggaaagatagagaatctgctttgtctaaacatgtttttctcctttttgtgggttcatgctagattccatctgtgatttcaatataaaatctccacttttttcttttaaaaaaaaatctatcttgtttgtgataggccagtgggagagacatactttgctcagtgttttgtccgtacacaatagttgtctatttatctgtaaacagtggtgtatcttgatcatgtgggagacttttttggttctgtctgattggtgaactatataagttactgatgaaaaatatggtttttttttcacttggccttagtgatgaactttcttgttgtaggtgattctgcaacatggaggaaaaatgcgaggagcttgaggtgcccatggggactctaaagtcaataagctttagcatttcgaataacaaagaccgagtaagtgttgctttgaatattcaatatcctatagttacatcaacttacgtctgttgttagtgagtgcattaagccaaaacttaaatgtaaatggtatattatagaaaaacatgtctgtcatggaggttgaagcagcgaatcaagtgactgattcccggttagggctcccaaatcgggatgatatatgcaaatcatgtggcagcaaagatagaaaagtttgtgaaggtatatattaatgaatccagttttggtgatatatacatgtggaagcttattaatgattgtttttgtttagggcattttggggttataaacctcaggtacccggtgattaacccgcatttacttaaggaggtagctacattgttgaacaagttctgccctggatgtaaatacacgaagaaaaaacagtctcagtctcaggttcaagagtttttttttttaattacatgtaagagagtaaatgtaaagactaatactgactttttggtttggtacagaatcctgaagaccggcctgacagatgtagatattgcattgtaagattactgctaataataacattctccttttttaatgaaagtaaaaacttgtgtgtttcttcttacaagtgtttttgttttttttgtttttgaatctcttcagtcaaatacagattaccctctaatgaagttcagggtaacaacaaaagaagcctttaggcgatctggaatcgtttgtgaagtgagtgaagacaatgtgttgaagctcagtaaacggggactatcagcattacctccagattattgggattttatgcctaaagacccaaatatcgacgaaagctgtttgaaaccaagcaggcggattctaactcacgcacaggtgtgtgtgtatacaagtgtgacatgttaaataatccaaatactcatttgttttttgggtttgaattaaaaacttttcactttattttgctcgtaggtttatgcactgttgagtgggattgatgagagggtgatcaggaaggagatccccatgttcgactctcttcctctggcatcttttccagttacaccaaacggtcatcgtgtatccgagatggtcactcagttcaccgggcctcgactagtttttgtaagttgcaaaaaatctataattattttcttttcttttttttgatgtaatattatgtctcattgttacacttttgtttctaggatgaacggactcgtatctacaagaaactagttggctttgaaggaaatggtcttgagttgagttcacgtgtgatggaatgcatgcaatactcaagagtaagcagtagcttccttccctctcttgtaatgatctgtgatggttagttaattcttgttttatgtcacagctcttttcggaaaacgtgtctccgagtcaagaatccgcgaacccttaccagaagaagtcagatactcccgagctacgcggtctaaggttcatgaaagatgtgcttctcggcaaaagaagcgaccacacgttccgcacagtggttgtcggcgacccttctctcaagctcaacgagatcggcatacctcggagtatcgcagagaggcttcaagtatccgagaatctcaacgactggaacagagatcgtctcgtcacttcctgtttccacaagctcctcgagaaaggagagactcacgtgaggagaggaggtcgcttagttggtatcagagccatcgacgatctccaaacgggagacagcttcttacgcacgttaaaggatggagacacggtgctgatgaacagacctccttccattcatcagcactcgctcatcgcaatgtctgttaaagtcctccccactacctccgttgtctctttaaaccccatctgttgcttaccctttcgtggtgacttcgatggagactgtcttcacgggtacgttcctcagtctatccaagccaaggctgagctcgaggagcttgtggctttggataagcagcttgttaacagacagaacggtcgtaacttgctttcgttaggacaggacagcttgacggctgcgtatctggttaacgtcgagacgaactgttttctgaaccgagctgagatgcagcagcttcaaatgtattgcccctttgagcttcctcggcctgcgatcatccgaggttcgtctacgagcagtgagccgcaatggacggggaagcagctgtttgggatgcttttccctcccgggttcgagtacgcttaccctctgaataatgtggttgtaaccaacggggagcttttgtcttcttccgatgggtctggttggttgcgtgacggagaaggaaacttcatccagggtttgatgaagcacgataaagagaaagttcttgatataatcttctcggctcaagagatgctctctcagtggttactgaatcgaggactgagtgtttctttatctgatttgtacttcgcatctgataaacactctcggagaaacttgacggaggagattagttacggcttgcaagaagctgagcaagtctgcaacaagcagcagctcatggtcgagtcccgcagagacttcctcgcggtcaacggagaagaagatacggtcgtcgctgatgatttggagctgttctgctacgagagacagagatcagctaccttaagcaagctcgcggttagtgccttcaaggacgcgtatagagacgtccaggctctggcgtatagatacggagaccagtcgaacgcgtttctcgtcatgtccaaagctggtagcaaagggaacatggggaagctcgctcagcacagtatgtgcattggtcttcagaactcttctgttgcgttgtcctttgggttcccacgtaagctgacttgcgcctcgtggaacgaccccaacagcccgcttcgaggcgcaaggggagaagaccgaacggctcatgagtcttttgttccctttggtgtcgttgagagttcgtttctgacgggtctgaatcctttggagtcttttgttcattccgtgacgagccgagacagctccttcagcggtaatgctgatcttcccgggacgcttagcaggaagctgatgttctttatgagggatatatacgctgcttacgacgggacggtgaggaactcgtttggtaaccatttggttcagtttcgttatgagagtagtgatgatgcagaagaggacatgactggtgaagcagttggatcactttctgcttgtgcgatcaccgaggctgcttacagcgctcttgaccagcccattagccttcttgagacttcgcctcttctgaatcttaaggttctctctcttcttgttattacttctcctcttggcgtttttgataaatatatctttcttgtgcagaatgtgttggagtgtgggtcgaagaaaggtctgaaagaacagacaatgtctctgtacttgtctgaaacactttctaagaaaaagcacgggttcgaatacggggcactggacatcaagaggcacttggagaaactgtgtttctcagagattgtttcaacgtccatgataatgttggtaactttaactgtgaatctttttttccagtggcttcttctaacaaatgtttatttttggttaatagattctctccgaggactaacacaaggatgcctatgagctcgtgggtttgccattttcatatctccaaggtaaaaatataaactcacccacatcacatgtcttataatatggaaaaaaaaacattctaatttttttgtacctcttttctaacattgcagaaagtactgaaacagaaccagctggacctcgaatctgttgtctcttcattaaacaagcagtatgcgaacaggaagaaagaactgaagcttgatgtaatagatttagatatacaaagcaagtaagtacatcctcaaaatattcgcatctttatgtctatattcgatactaatttgttatacgtttattatgtgttgttgagtagaaaccactgctcttgggatgataaggcaatggaagatgatagagtctgcatcacagttactgttctcgaagcctccaggcacgattctttggagcttgatgctattcgccttgtcttgatcccttttcttctcgactctcctgtcaaaggttaaaaaaaaaacgaacagttcttgctttttgttattgttaccgttcttactagttgtgtcatgttgtttaatttcttgcaggctaccgagagattaaaaaggtggatatcttatgggttgacagaccaaaagctccccagaggaacaagaaaggcttggcgggtgagcttttcttgaaggttacaatgcatggagttcgtggcaaaaggagcttctggagcgctcttctcgaaacctgtcttcccattatggatatgatcgattggacaagaagccatcctgataatatccgacagtgctgctctgtttacggaatagacgctggacgtagcatcttcctagcggttagtttcctttatacagcttttgatcttgcagcttctaaagtgttttaagactttttctttggtggtgatggcaggatttggagtctgctgtgtcggatacgggcaaggcgatgctgcgggaacatctgcttcttgtagctgattccctctcagtcaccggagagtttgtggcgctaaaccccaaaggctggagtagacaaagacaggccgagtctactcctgctcctttcgctcaagcgtgcttctcggtattgttaactaaaccgtaccaagttctttttcccggttatgatattggttttgacattggtttaaatatatctacagagcccaagtcagtgctttctcaaagcagctaaggaaggtgtcacagacgagcttgaaggatctatcgacgcattggcttggggcaaagttccttcttttgggactggagatcagttcgagatcatcatctcccctaaggtaacaacaacttactttaacatcttgtctaacaatattcaacaagggcacatgggatgtttgatgacgtgttatgatttagtataagtattaggaaggaataaggagaaaggttatctagagattagatcacactattaattcggcatttcactatcaaatcaacgtttctttgctttgttctttgtttctcgtcttcttgtaatggttttttaattagtctattaatgcgtttcatcagaatcatgggtttagtacaccggtggtagacgtgtatggctttctcagtaggacggccacgcttccaaagagaaaggctgtccgtgcaacaagctcctccttgcccaaatcagacgagttcacggtccagccattccccgtgctcgacacggctctctcgaaagcagtcaagacactcgatgggaaaggactcaccaggtcgcagctcagaatgatctttacatggaacgacatggaaaagctttctcggtcgctgaagcgcattctctacaagtaaggaaacataacttttgactattctggtccaagaacagtaaagattcatcatcctcttggctttttgttttattagttacgagattgatgctacgttgaatgagttggacgggagacttctgatgatggctcttctcttccatcccaacagagatgagaagataggaccaggcttcaaaggaatcaaggtacaatcatcataagaaaaataactatttatatgtttcttgaaaaaaacatcgaaagatcctgacatggttttgtctttggaggtggctaattctaagcacgggaatgctcgttgctttgaggtggtgagaacagacggaacaactgaagatttctcttaccacaagtgtgtgttgggagcaacagagatcattgcccctaagagggttaacttctacaaggcgaagtaccttagaaacggtacggtgcagcccggtgctatctga

SEQ ID NO: 355 - DNA, 9819 bp, Brassica rapa
ggaagaacaagttaacattagtaaaagacataatacatgcgtaaaaattaactcatcttaaactatatacacaaataaattcaaatatattgtttcatgcattaattcttttaataatcaaacaaaaatttgataacataaatatataataaaagcgacaaatacatgtgacaatttaaactttagcatataaattgtaaaactacaatttattgtatttgaaatagtcatattagcatttaaatatatgtttgatgctaaaatatatatcactaataatgtaaaacatatatatatatatatatatatatatatatatatatatatatatatatatatatatatatatatatatatatatacgtttgcggaagtcaagatttagttttttattttatttcggatatatgtttgagtttggatcacatttttggtctcattcagattgttagcttttaaatattcttcaaaataaacatgaaaatgtatatttaaattacttatatagttccaaaattattttggatctaattcttttacagattattttcagattttcaatctgttcgaacctaattgaattcagataatacacaaaacctaaaataaaattttacaagatccattggtataactatacaacccgaccggtttaaagtttttgtggtggttgggattccaaaagttcttagccctagattttaaccattttcaccatcatcgtttagtgctatctaactcgtaagactgtatcacatttaataatttactcagaaaattaaagcgagcatcctttttttggtcaaagtgagcatctttttcccactttgcatgcaatgtgtattgtttagaggctgaggaagaaaggattttgggagaaaatcagattcttgggtctctctctctccgtcactttcactcttttcttcactcagattctccctcctctcttctcctccaaaaacccttgtctccggttaactgggtcaaactcctccgtcgatccttaggtattttgcctttacccagctctctctctctctctctctcttccagtgtggatcatgaacttacgccgccgtgtttctgggttttattttatccgttctgggtttagggtttcaaatgtagcttctttctctcggtgtgaaagtttggagatttcgttgttttctgctttcgatttcgtgaaaaacagaacataaaggttgttcctttacctgtggggttttgaaatgtgggtttctcccggttcgaaagttacgagctttcgcctttatcttgtctcttctgctctcgattttgttgaaaacgagcagaaaggttgttcctttaagcagttttttttttcgattcttcaaaaaaatgggtttctatttagagatttgtgggttttagtgagacttgatactgtcttcgtttctctgtttggttgatctggtaagtgctctaactcggtctcgctgttgtctggattaaacttttttttagggttttgtcatggaggaagcatcttcatcagatattctagaagcagagattgttggaatctcattcgctcttgctactcatcgtcagatcgtaagttaaccaagagtttgtcctctctggactacttgcatttttgtttggagttgcatgtatggctttgtttagttctaagttagaatattcatgattagttagttccaaacacaagaagtaaggaagacgagtagccaaaacccctttctatgtttttggttaagttcgcaccaagttttgaagtgataagtgagctcagctctgttatatagtcgcttcagctatagtgctatatgtttgttctgagatatatcctctgctactcttgtattactcactggtctatctttctttcttgcagcgtctagcatccattagtgacgctgggatcaaccatgctagccaactctctaacgcattcttggggttacctctggagtttggtaaatgtgaagcttgcggtgccactgagcctgataaatgtgaaggtaaactagttctgttttcttgctatcttcttgttcttacatgggttgttgtaatattgatgttcgtttcttcatttttaggtcattttgggtatatacatctgccagtgcctatataccatcccgctcatgttagtgagttgaaacagatgctgagccttctctgcttgaagtgtctcaagataaagaagattaaggttagtacctcattgagttttctcaaatttagtaagatctagcatgaaccgtaaaaaaccttgaccaattgtgttcaccttatgattacagagcacaagttctgggcttgcggagcgcttactaggcgtctgttgtgaggtgagtaatgccatacacattctgattgtttcatgtcgcctttctatagttgggttgtcttaagtttaactaactgagttactcttttaggaagcttcgaacatcacaattaaagataaatcatcagatggtgcctcatatcttcaactgaagctcccatctagaacaagacttcaggagggcttctggaatttcctggaaagatacggttaccgctatggaagcgaccatacccggcccctgctagcaagagaggttcttactttcttctccatgcttttgtttcttatgcgttaccttaaatactttgttttgtatttatataacatgtgcagaaccttttgctaggatttttctgtaaattcaagttcttttggtataatctaggcttcctatcagattagttaacgttgttggatacaagcatgctaagctaaatatctatacttttgaatttctgtgcgaatgtttgggcagaagaagcaattagtatacatttgtaaatggctgctatgtgatcttatagtttcctggatcttctagggttttaatgtcacaggcattcttaccttctgtccttgtcaggtaaaggaaattttaagacggattcctgaagagacaagaaagaagctcacagcaaagggacatattcctcaagaaggatacatcttagagtatcttccagtcccgcctaactgtctgtcagtgccagaagtttctgatggttccaactccatgtcagtggtaaggccgtcgaaaccaaaatgctttcttgagttcattgattacttttggcttgtttacaaactaacccggaatgtatgccattcttttttttcaggatccgtctagaatcgagctaaaagacgttctcaggaaagtggtagcgatcaacaactctaggtctggtgagacgaactttgagtcgcatagagctgaagccaatgaaatgtttagagtggtggatacctatcttcaggtgaggggtactgcaaagccaacaagaaacattgacatgagattcggggtgtccaagatctcggacagttcctcctcaaaagcttggacagaaaagatgagaacacttttcattcggaaaggttcaggcttctcttctcgcagcgtcatcactggagatgccttcaggaatgtgaatgaggtggggatccctatggaaattgcacatcggatcacatttgaggagagagttagcgtccacaacattggatatctacaagagttggtggacaacaagatgtgcttaagctatacccaaggttctactacctattctctgagggacggttccaaggggcatacagtccttaaacccgggcagattgtgcatcgcagggtcatggatggagatgttgtgtttatcaaccgtcctcccacaacacataagcattctctgcaagcacttcgagtgtatgttcatgaagacaacacggtgaagatcaatcccctgatgtgtagccctctcagtgctgattttgatggtgattgtgtccatctgttctacccccagtctctcacagctaaggcagaggtactggagctcttttcagtggataagcaacttcgcagctcacatactgggcagctgattctgcagctgggtttggattctttgctgtctctgagggttatgatggagcaggtgtttttggacaaagcatctgctcaacagttagctatgtatggctctcgatctctcccaccaccagctgtagtgaagtccagtaaatctggcccggcttggacatttttccagatattgcagcttgcctttcctgagcgtcttagttgcagaggggacgggttcatagttggtggaagtgatttgctgtcctttgattttggggttgatgcgttggcgtctataatcaatggaattgtaaccgcaatcatggtggagaagggtccaaaggaagcactggcattctttgattcactgcagccgctactgatggaacatctagatcctcagggatttagtttaagtctggaagacttgtccatgtctagggaagacatgggagttattcacaatctcatcgtccgggagatttctcctatggtgtctaggttgaggttatcgtatgaggacgaactccaactagagaacagcatccagaaagtgaaggaagtggctgctaatttcatgctgaagtcgtattcgatgaggaacttgatcgacatcaagagcaactcagcaataaacaagctggtgcagcagattggcttcctgggtcttcagctttcagacaagaagaagttgtacacgaagactctggtggaagacatggctcagttttataagaaaaagtatgtcagtacttcttcctctggagattttggaattgtgaagggctgcttttttcacggacttgatccttatgaagagatggctcattcagttgcggcaagggaggtaattgtccgctcttcaagggggttagctgagcctgggacgctcttcaagaatcttatggctgttctgcgagacatagtcatcaccaacgatggaactgtaagaaatacatgcagtaactccatcgtgcagttcaagtatgagctgagttctgacaatgagaatcaaggtttatttgaagcgggagaccctgttggagtattggcagctaccgccatgtcaaatcccgcctataaagcggtgcttgattcttccccaaatagcaactcttcatgggaactaatgaaggtaaagtgttctcggtgctgtcttctcaataaagctttgttcttctgtattgttgtatgcttatactgctttctgtttttgttcttctaccaggaagttctactctgcaaagtcaacttccagaacaccaccaatgatcggcgcgtgattctttatctgaatgaatgccgctgtgggaaaaagtactgccaggagaattctgcttacacagttaggaacaagctgaagaaagttagtctgaaagatactgcagtggagtttctagtcgagtaagtactggtcttagtaaattatgttgttcgttttagtgtttttttttttttttgcttttacttatcctctttgcgttggtctatgtctttacttgcatgcagatacagaaagcaacaagcgatttcagaaatttttggaatggatatatgcctacatggccatattcatcttaataaggtttgaattctaatctctgtactgttaaatctatctggaagactctacctgccattgaatctttttaattcttgcttgtaattggtgttttggtttactagacattgttggaagggtggaacatcagcatgcaggacatacttcagaggtgcgaggatgcaatcaactcactagtccaaaaaaagaagaagaaagctgaggactttaagaaaatgaatttgtctgtcaggtatgtccatgatatgcttttcctatgaacatcgcctctggttgaattattgatggtggtttctcgcttactagttctttctgtccatcatctttgttctttgtcttattatgtatacttgtctagcttcttaaactttgtgctctgattatgtttaatttcttctcgaatgaacagtgaatgctgctctttccgaggtccaggctcgagcaaagattctgatatgccgtgcttgatgttttcctcctacaatgccactgatcctgatctggaaagaactctggatgttctctgcaatacaatatacccagttctgctcgaaacagtgatcaaaggtacttgaagaatgctttcattataactgtcaatcactttgatttatcgaacagggtagagtctttcttttgaaatctttctagttagattgattacctgacggataaaagatttaaaatcattttcctcaactagtctgaatgagttgtcttccacgttgtagttgtgctatcaagcttatgttacagtagactaatgttgttttataatacttctgtctctaggtgatccacggattgcctcagcaaatataatctggaatagtccagaaacgacaacctggatccggagtcgtcatgcatcccgccgaggggaatgggtattggatgtcaccgttgaaaaatctgatgtcaagcaaagtggtgatgcatggagggttgtgattgactcatgtctttcagttcttcatctaatagacacaaaacggtcgatcccatattccataaagcaagttcaagagctgcttggtttgtcctgcgcctttgagcaagctgttcaggtactcaattactttactcctgatccgtgcacttaaagcatgatactttgtcatatttaacgtatggtatcatatgtgctcattgttttgcagcgtctctcagcttcagtgagaaaggtctccaaaggagttctgaaagaacatatcattctcgtggcaaacaacatgacctgttcaggggatatgctaggtttcaattctggaggttacaaggctttgactcggtccttgaacatcaaagctccattcacagaagcaactcttattgttagtcttctgatgcttgaatgtccaattacaaagtattttctatactggccatccatactaacaagagttacttcttatgctttcaggcgccaaggaaatgtttcgagaaagcagctgagaaatgccataaagattctctatcaacagtagttggatcttgttcttggggaaaacgcgtggatgttggtacaggttcacagtttgagcttctatggaacaaaaaagaggtagacattctcaccagatattgagttttgtcttctaaatttttttcgtgcaatctgatgttctttatttgtcaacttatttgcagactggtctggagaatgatgatgaaactgatgtattcagctttctccagatggtaagatccaccaaaactgcagatgcatacgtttcttcccctggttttgatgtcacagaggaagaaatggctgaatgggctgagtctcctgagcgagactctgctcttggagagcccaagtttgatgacagtgctgagtttcaaaatctacttgatgaaggcaaggcatcggaatccaagtgggacaacggttctctttgggagaatggttgcagtagtggctcagaatggggagtctcgaaaaacgcaggtggtgaggagaacacgcagtctggttggggaaaggctgcaaacattgagaaggaagatgcttcgtctggttggaacagtaaaaaggatgctcaagaagctaccaatacagattcatggggcgcttggggatcaaagacaaaagatgatgctgaaaatgcaacaccgaactggggaacaaaaccagctcaaaatgattctgttgtcatagaaaacggcgagccttcttctgacgtttggggacccaaagctgtttcagacaaaccttggggtaaaaagaactctgaaactgagccagctcctgctgcatggggtaaaacgaactctgaaagtgaatcagctgctgctgcttggggctctactaacaaaaagaacacgggaactgaatcagacgctgctggttggggctctactaacaaaaagaacccggaaactgaatcagatgctggtgcttggggttctggggccaaaaacaaagaaacagaaccagctcctgctgcatggggttcctggggcaaaaagagctcagaagctgtatcaggtggtgcggattggggtaataggggcaaacgggtttctgaaactgaatcaggtgctggtggttgggcttcccggaacccgagcttggaaactcagtcaggtggtgctacttggggttccagggataaatctaaatttgaaactgaatcaggtggtgctgcttggggctcgcaggctaaaaataattttgagagtgagtcaggctcgggtgctgctgcttggggtaagaagaaaccagaaactgaatcaggtggtgctgcttggggttctcaggctaaaaacaaatctgagattgagtcaggctcaggtgccgctgcttggggtacttgggacaagaagaaatcagaaaccgaatcaggtggtggtgcttggggttctcaggctaaaaagaactctgaaactgagtcaggcgcaggtgcttctacttggggtgcttgggacaagaagaaaccagaaactgaatcaggtggtgatggtgctgcttggggttctcaggccaaaaataattctgaaactgagtcaggctcaggtgctgctgcttggggtaagaagaaaccagaaactgaatcaggtggtggtgctgcttggggttctcaggccaaaaagaactctgaaagtcaattaggtgctgctaattggggttctaaggacacaaacaattcggaaaatggatcagattctgctgcttggggtaaaaagaagaattcagaagctgaaccaacttctgttgcttggggttcttggggacagccaagcccccctgcttcagacaaggatgcccaagaagatgatggaaacccgtgggtatcattgaaggcgaccaacagcggagagaaggaagggaatgagacaagtcagtggggagttccaaacaagagatatccatctgctggctcacagtcacagggtggtggtggcggcgcagattggaagaggaaccgtcctcctaggacccctggatctgagagtattatgggtccaatgttcacagcaacaagacagcgcgtagacatgttcacctctgaggagcaagagcttctctccgatgtcgatccagtcatgagaagactcaggaaaataatgcatcagtccgggtatgcctttccagctctatgtgtcacttacgcagttacagattccatatatatatatatacatctttgtaaaactgtgttgtttcgatgaaggtacactgatggagaaccaatctcggatgaagacaagacatatgtactggagcagattttgaactaccatccagagaaagatgctaagcttggtcccggtcttgatttcatcacggtaaaaatagctttcaactttatagcatctcttctaaaagcttacttagccttatataggtctgatgtgaaaatattcttgtaggttgataagcacacaacgttcacagagtccaggtgcttctttgttgtgtcgactgatgggacaaaacaagacttttcatacaggaagtgcatcaacaactatctggtggagaagttcccaaacctagctgaagagttcatcgcaaagtacttcagaaagagggacaatgaaaacagagacaagaacagccaagaagccacaccacctggtgaaaaagagtctcagactcagcctattgataatggaagccaagactcccagcctcagtctattggtaatgaagatggcgacactcagcctcagtctcaagctgaagacactcagcctcagtctcaaattgaagacactcagcttcagtctcaagttgaagaatctcagcctattggtaatggaggtgaggactatcagacagagcctcagggttag

SEQ ID NO: 356 - DNA, 6581 bp, Brassica rapa
ccggatttgtctatgtttgcatctgctgatttgaacagagaagcagttgtatgggacagagcctccagagaggtaactaaagattttttagaacctgaccatgaatctccaacactaacactgatcttacatctttttttttctttcaaaaaaacagatgaagctgaagaacatgctgtaccatagcgcccgcataaactgcctagcttggtctccaaacagcagtatggttgctacgggatccttagacacatgtgtgattgtgtatgaagtggacaaaccagcttccacacgtatgaccattaaaggagctcacttaggtggagtttatggtctgggtttcgctgatgatacccatgttgtgagttctggtgaagatgcttgtatccgggtttggagcttaactcctcaataaagacttgaggtgtgaattttataaatatctctggaaagctccccttgtctccttttgaaaaagtttttacttcttttgaaggctttgggtcttttgtatggccgtgtgtctgtgacactttgttggtgtgtgcgagtcttgttgtctgcatatctttgtcaaaaacaatactttctgttcttttgtgtgtgaaaatgagattgtgagtttcttctatgttcattgatttttggatgattttggctatgatatatgtttcataacttcattttttttctttactgaaattgttactctcttaagttgctcactatacagcaatacctctggagaattcatctaaaaagttggaccaagattaaggctggttcgaccttatgggattacattgcttaatctatctatacatatgatgatgatatgcagatgcaaataatgagaaaccaattggtccaaagggtgagtaatgattttatttgacatattccaaagcaacaacaaagaagacgttgaagcaccagtaaatttgcattttccactcttgtcacttccatatttcattaaacccctatggaatatgaatttgcatttttgcaacaaaaatatggaaaagctttatttttcatttcttggttaattgaaaaatgtaaaaaaataataatacctgtgttaagcaacttccatcaaatagacattactaccctttttaatcacacagacacgagaacaagcgtaggggcacatccgtcatttagaaaaggacactctttttggttttatctgcacagtcctcgttcactgagcgagagcaagggtttttccactcgacattttagaaactttcccggcgacgacggttaactctactctccccgccaccgccgtttcactccgaataggtactcatcctctttatcaaactctgattctaccatttacctctggatttcccgaaattctgctttatttgtttacacggtcccttgttctggagaatggtgaaaagttttgcgatcgacacatgcatttgtgttgttgatgacattagcgaatccttttttttttctgtgtaggtttctgtaaacatgactgatatagacattgaagagattgaggccgccggggaagtcgatttacgcgacctaggggatccttttctccagagcttctgcaagaaagctgcgacgtccttcttcgacgagtacggcctcgtcagccaccagctcaactcctacaacttcttcatcgagcacggtcttcagagcgtgtttgagtcctccggtgagatgctcgttgagccgtcctttgatcctacgaagaacaaggaccatgagtggagatacgcgacggtgaagttcggagaagtcagcgtggataagcctaccttgtactctgatgataaggagcttgtgtttctcccgtggcacgctaggcttcagaacatgacctactctgccaggatgaaagttaatgtcgatgttgaggtaaggaaaatgattaaaagtatcacctttttgttctaaattgtgttaatgtggttagtcttaaagagttaataacgtatggtatgaaatataacgggaaacgttttggggttaacttagttttactacatctccctcacgtcctgcttacattgtgtgtgatctatgcgtgtatgcaatggctcttatctgtcaaacttttgatgaagtttttggtttgctgccttcttattactggttattttgttgtgtaactgactcttccctttataaattgactaggtgttcgttaagaaagttgttaaaagagacaagttcaagacgggacaagacgaatacgtcgagaagcagatattgtctaagaaaacgcaggacatcccaattggtaggatacctgtgatggtgaagtctgtgctttgcaacacaacggagaaagggaagcatgtggaaagctacagaaagggggagtgtgcatttgaccagggtggatactttgtgataaaaggagctgagaaggtgagttactccaaatagttacattcccactgtcatggattactattctgaactattggattgtgtgttcttcacataatatgcatattgcacttatttgcctaaactgtttcaactgctgacaacgttttttgctttctttcgttccaatactgtatatatatatactggaaaagatatccaagctgttatacaagttactaacgtgaagaaatgtgttttgcaggtctttattgctcaagaacagatgtgcacaaagagactttggatttctaattcaccatggaccgtctcctacaggtccgaaaccaaaaggaatcgtttcattgtgcgtctatcagagaatcagaaagctgaagactttaagagaaaagagaaagtactgacagtgtacttcctgtcaactgagatcccagtctgggtcctgttctttgcgctgggtgttgcgtcagacaaagaggctgtagatctaattgctttcgatggtggtgatgcaagtattaccaacagcgtcgtagcttcgatccaggaagctgattcggtttgcgaagattttcgccatgggaggaatgctctggcatatgttgaacagcagataaaaggcacaaaattcccacctggtgagagtgtggatgaatgcctaagtctgtacctgtttccaggcctcaagagtttgaagcagaaagcacgtttcctgggctacatggtgaaatgcctttttagcgcatatgctgggaaaagaaagtgtgagaacagagacaactttaggaacaagaggatcgaactagctggagagctgctggaaagggaactaagggtgcatttggcgcatgctagaagaacaatgaccaaagccatgcagagacacctcacgggggatggcgatctgaagcctatcgagcactacttggatgcttccattataacaaatggacttagtagagccttctccactggagcatggtgtcatcctttcaggaagatggaaagggtttcaggtgttgtcgctaatctgggtcgtgcaaatccactccagagtttgattgatctgcggagaacgcggcaacaggtcctgtataccggcaaagttggagatgctagatatccgtaagtggaatttccaaaaccccctgctttgtttgaaatataagtatatgctcggtcttacatgttcttcagtctgttttagtggtattagactctttcatatagttgtgatgatgaccactgtttcctgcagatccttctgtgtttgacccaaatgtatactgattttgtttaaattttactgccattaagcaattccgatactgtttttcgtgtttcttttagtcactctatcttgtgaatttttcctgatgtcgacaatgaggttatccattatagttacattgtaatgtgagctgtgaaatgttggaacgttgttgggaacttaacattgtgtttttttttggctttaaaaactgaaatgtgactgcatttgtttataatgtatgcaacaggcatccctctcactggggcagagtatgctttttgtcaaccccagatggcgaaaattgtggtcttgtgaagaacctgtctctccttggacttgtcagcactcaaattatggagcctgtggtggaaaaactcttcgatagtggaatggaagagctggtggacgataccagtacaccactgagcgggaagcacaaggttctcctcaatggagactgggttggagtatgttcagattctgactactttgttgcggagttaaaaagcaggaggcgtcaaagtgaattacctcgtcaggtatctcctgttttaacaaatttcttgtattgcatttaccttggatcttattacagttctcaaatgtttttatgtcattctttgcagatggaaattaagctagataaagatgacaaggaggtacggatttttactgacgctggcagacttctccgtcccctcatggttgtggaaaatctccacaagttgaagcaaagtaaaccatcgaagtacacctttgagcatcttcttgaccaagggattctcgagctgatcgggattgaggaagaagaagactgtaccacagcatggggaaccaagcagcttctgaaacagcagaagagttacactcactgcgaactggatttgtccttcctgttgggtgtgagctgtgcgattgtgccgtttgcgaatcatgatcatggtaggagagttctctaccagtcccagaagcattgccagcaagccattgggttctcctcaacgaaccctaacatccgctgtgataccctgtcccagcagctgttctatccccagaagccacttttcaagacaatggcgtcagagtgtcttcagaaggatgtgttgttcaatggtcagaacgcaattgttgctgtgaatgttcatctcgggttcaaccaggaggactccattgtgatgaacaaggcttcgctggaacgtggtatgttccgttcagaacagatcaggagctataaagctgatgttgacagtaaagactcggagaagaggaaaaagatggacgaggttgttcagtttggaaagacacacagcaagattggcagagtagacagcctagatgatgacgggttcccctttgttggtgctaatatgcacagtggtgatattgtcattggcagatgcaccgagtctgggactgatcacagcgtgaaactgaagcacactgagagagggatagtgcagaaggtggttctatcatccaatgacgatgggaagaattatgctactgtttctctgagacaggtaagttatcagaccttagtgagctgtctttcagataacacatacctttgagctattatattgtttccattgatctgtcttttacatcttgcaggttcgttctccatgtcttggagataaattttccagtatgcatggccagaagggtgttttaggctatatagaggagcaggagaattttgctttcacgaatcaaggcatagttcctgacatcgtgatcaacccgcatgcattcccttctcggcaaacaccgggccaactcttggaggctgctctgtccaaaggaatagcttgtcctatgcaaaagaagaagggcaagtctgatgcatactccaaagtgacacgccatgccactcctttctccactcccagtgtcgatgacataaccgaccagcttcacaggtaccttcttcacactgtcacttggtttgatcattgtctacatagtgttgaaaaggactgaaacagtacagggatgtgtgctaaagtcggtagataatctgagcgtcatttgccttgtgattatgtgattttattgaatatatttcattgaaactgtacagggctttgtgctaaagtcagtagataaactgagcgtcatttaccttgtgattatgtgattcattgaatgtgtttcattgaaacagtgcatggctttgtgcttaagtcagtaagtagtagataaactgagcgtcatttgccttgtgattatgtgattctttgaatatgtttcattaaaacagtacagggctttgtgctaaagtcagtagataaactgagcgtcatttgtcttgtgattatgtgattaattgaatgtgtttcgtagattattcttgattcttgacacctgatccattacggattataaaatgtttgtctgtggtctcagggctggcttttcaagatcgggaaacgaaagggtctacaatggaagaacaggagagatgatgcgttcactcatcttcatggggccaaatttctaccagagactcatccacatgtcggaggacaaagtcaagttcaggaacaccggaccagttcacccactcacgcgccagccagttgcagacagaaagaggttcggtggaatcaagttcggagagatggagcgagactgcctgattgctcacggtgcatcagcgaacctgcacgagcgtctgttcactctgagtgactcttcacagatgcacatctgcaggaactgtaaaagcgcagcgaacgtgatagagagggtggcgagcagtggaagaaggatcagaggaccgtattgcaggctgtgcgagtctccggactatgtggtgatggtgaacgtgccgtatggagctaagcttctgtatcaggagctgttcagtatgggcatctgtctcaacttcgaaaccaacctctgctga

SEQ ID NO: 357 - DNA, 5397 bp, Brassica rapa
catcttcactatcagcttccgaagaggaacagctttccagaacaacttcagtaagagcaggaacagcttcaaccatgaccagttgtaaagcaagtacaaatcctttaactgcgatgttgctcagggacaaggccaccacatcccgctctcggatactaaccataagcaagtcaacgcaagtcttccccacggatatgcaaaaaattctccaagatcttcgattgcttctgcatgctctctacaaatcttcatcttcaagcttgttggaagaagaacggaggacagaatcgccaggcaagcatatttgatacggattttcgtatcagttaccgtcctcctccgaagcatcttgatcacagaagccaccgttacaacttcactcttaccaaatagcaccggccagtagggtttctccgctatggattcttttaacttcatctttgatctccgtggaaacggcccgcatggcaatccggtgacaatcgcaaattcccgtaacgaaaaccgaatcggttttccagcaaagcggaaccacgcctcgaacttcttcttcgttttcaactgtctagacattatataacgagcaaagcgaccggaaaataccggtttcgcagcaatatcgacgattttgccaaaagctgaatccctgataacatcaatttcttcatctcccaacgcatttaagattctttttatcgctccagatgattggtaagtaaggacgcaaaccccgactggttcttcgccggccgcaaacatcatctccggaaccagcttcctcgtcggtccttccggtgaatcgggtaaatcaacaaggcgcgacgaaaccatcgactcttctcaaactccgcctgatctcaaacggttctctcgagcttatcgaaaagtaggataagaaaagtaggttaagaaaagcaaaaagactgaatagagttgttctaataatgtagacaaacgattctttgcttctttcgatatttccagacgcgtgagataaacagtggtatagataggtattattgcaagtctagctctgtctagatgtctaggacctataatctaaggtatagactactcggactagtgttgtaacgagatagggataagagcgtcattaatgaaacagtaaatagcgacgtggtgcacatgctcatatttgcaaataatgtttcaaacgtgtatatagagtgcaattgctctaaattttaattcgggaaaaaaaaagaaccggtcactggtgaaatattagaaatcaacggttgagatcaatgatatatgatcgtatggttattatcataagctgtattaaactttaagtatacgagaaacacactaacccttctcttttcctctcgaagctttatgattccagaaaaaagtaacttttttcgagaaaggcaaactttctgattcttcgctctactcactctttctcgagaatctctctctctcttcttcactctctctttctctcgattctatctgctctccacgccaatcatggtctcagagataacgcgatcgacggttaaactcaccaacgtccctcaaaccatagttgccgacgaactcctccgcttcctagagctccacctcggcgcagactccgtattcgccctcgaaatcccgacctctcgcgataactggaagccacgcgacttcgccctcgtgcagttcacctccctcgaagccaagtctcgcgctcagcacctctcctcccagaccaagctcctcttcaagtcccgtaacctaagagtctccgaagcctacgacgacatcgtccctcgccccgtagatcccaggagaaggctcgacggcgtcgttttgaccgctgggtttccggaatcggaggaagggaggttttgtgccctacagaaatgggaaggcgtgaggtgttgggttatagaggagaagcggagagttgagttttgggtttgggaatgtggtgattgttacaagtgtgaggttaggtttgaggatgtcgttgaaactgttccctcctgcgtcgatggcgtggatgagatcaatgcgtttcttctcagggtaaacgttttgactcgcaatgtgtttgtgacaatgtgcatgtgaaagttctctactttcatagttttatctgatccttttgttcaactatagagattcaagaaagtaacttggtgaaccttagttctgctgagagttaagtttacaatgcaagagtgccttacggttaggtttaggttagggttttgacaaaactcttcactgatttataatttatataactaacgtttcaagtgagtttattttgcttgctgttggttttttatgttgcttggtttgttaagtgctgctacgttggttagtgtcttcttacttttgtttacctcttgtcttattttttagctgaaatatggaccgaagatatacaaacaagtatcaggacctcatatcgccacaaagttcaaatctggccgctacagtttctgcaaggacgattttgatttcatgtggattcgctcaactgatttctctggtctaaagtcaatcggtacatccacttgcttctgtttagaagtggataacgcctcagcgatgtctgacatcttctcaagcttaccttactacagagaagacactttgagcctaaccctggtgaatgggaatacatttgcctctgctaatcaaattgtccccctcttgaatgcagctaatctggggatagagattccatatgagatccttttccaactcaattcgctggttcatgcgcagaaaatcagtcttttcgcggcttcaaatatgggattgatcagcatcctctgtggtttgagcttggaaaccgcattggtggtcctcaagaaactgcaccagcaaagatctatttgttatgatcctatctcatttgtcaaggctcagtcgcagtatgtggttaagaagacggcgcattcccctgcatcagcctataagagattgactgagcagaacataatgagttgtcagagagcctatgttacgccttcaaagatttatctgctgggtccagagcttgagactgccaattacgttgtgaagaactttgcggagcatgcctcggatttcatgagaattacttttgtggaagaagattggagcaagattccagcgaatgcgctttctgtgaactccaaggaaggctatttcgtgaaaccctttagaaccaacatctatcacagggtgttgtcaatccttggagaagggatcaccgtcgggcctaaaaagtttgagttcttggctttctcagcgagccagctgcgaggaaattctgtctggatgtttgcttctaacgagaaagtgaaagctgaagatataagagaatggatgggttgttttcgtaagatccgaagcatttcgaaatgtgctgctaggatgggccagttgttcagtgcttctcggcagacacttaatgtccgtgcgcaagatgttgagcagattcctgacatagaagtgactactgatggtgctgactactgcttctccgacggcatagggaaaatttcgttggcatttgctaagcaagttgcacagaagtgtggactgagccatatcccttcagcgtttcaaattcgatatggtggctacaaaggcgtgattgccgttgaccgcagttccttcagaaagctgtctctgcgtgatagtatgctaaagttcgattcaaacaacaggatgctcaacgtgaccaggtggacagagtcgatgccttgcttcttaaaccgggagatcatttgccttttgtcgactctcggaatagaagatgcggtgtttgaggcgatgcaagcggggcatctatctatactggggaacatgcttgaagaccgccatgcggcactgaacgttctgcagaaattgagcggagaaagttccaagaatcttctagttaagatgctgctacaaggatacgcaccgagttcagagccttacctctcaatgatgcttcgtgtgcaccacgagagccagctttctgagctaaagagtaggtgcaggatacttgtaccgaaaggacgtatcttgataggttgcatggatgaaatgggtatactggagtatggccaagtgtacgttcgtgtaacactgactaaagcggaattggaatctcgcgagcagagctacttccgcaagattgatgaggaaacatctgtggtggttgggaaagtggttgtgacgaaaaacccatgccttcaccccggagacatcagagttcttgacgcaatatatgaggtcaattttgaacaaaagggttttctcgattgcatcgtctttcctcagaagggagaaaggtatatattataaaactatcctttaaaaagctatggcaccatagtagaaagaaaccatatgcttctgattcttgagttgatggtttgtttttgcctttacaggccacatccaaatgaatgttctggtggtgatctcgatggagaccagttttttgttagctgggatgagaagcttataccgagccaaatggaccctccaatggactacgctggaagcagacctcgtataatggatcatgatgtcaccttggaggttagattctcgaaatggttctgataatgtgaaagttttctaatctttggagcctaagctgctgattctcactgctttttgtaggaaatccacaaatttttcgttgattatatgataagcgacacactgggggtgatctcaactgcacatttggttcacgcagaccgtgacccggagagagcccggagccagagatgcatagagttagcgaaccttcactctagagccgttgatttcgcgaaaaccggagctccagccgagatgccttacgccttaaagcccagagagttccctgatttcctggaacggttcgagaaaccaatgtacatctctgggtccgtgtttgggaagctctaccgtgctgtgaaaagcactttagcacagagaaagccagaagacgctgagagcgaggacaagaagaagatggcggcttatgactcgacgcttgaagaagctggctttgacaactttatagagacggccaaagctcacagagacatgtacgccgagaagctgagctcgttgatgaactactacggagctgctaacgaagaagagattctcacggggattttgagaaccaaggagatgtatctgcagagagataaccggaggtatggtgatatgaaggataggattacgttgtcggttaaggatttgcagagagaggctatgggatggtttgagaagagctgcgaggatgaacagcagaggaagaagctagcatcggcttggtactatgtaacatacaacccgagctattgcgatgagaagccgagattcttgagctttccgtggatcgtaggcgacgttttgctggggataaaggctgaaagtgcggagagatag

SEQ ID NO: 358 - DNA, 5406 bp, Brassica rapa
ttcagatgttttgacgacggtgcttgggaccatggccgtttctactcctctatgactcgaccttctccgggttcaccttctcctctttccttctcgttcagatcactttgattcaacgggaccgaaagattcttcgtacgaagcctcctatattgatgcatgactagagttttgattctactaggattccaatttcaaatccctcaagaatgggaatgtgatgattaaaaagagagataaatgtcgattgaagaatgagtgagagagagtgaaaccgcaatgacttagacggttttgggaagttatagagaagaagatcttaattttatgggtcggatctggatggtccgcaaataaaataacccttggtaggatcgtagttatacaaattttccttggtttcgtggtattttacaaattttcttcatttaaataaagttttattaaattaataaaaaagggaaaaatatcacagaattttttttttcagttaatagtattggagcatttgactggtctctttctcggttatttgggataaaaaaaattggaactgttttataatatttctaaatccacgtagtatttataaattcaagtaaaatatacagatttttaaactttttcggattagtatttacaaatccggaagtttttcctcggagttgaatcattgtatatttaacaaaaaaaaattcaaacaaatctattcaaatctattataaaatcaaatttattagtaaatatgtacgattgaataacacttgatatagatcaatttacgaatcattaaaccaataacgccgcttatacaattgaaaagaataaaaaggcttggaagagaataaaaaggcccatatttaaaagcccataaagaaacgtctactcatacgattaacacaacactgtctcttccgttgactggtagaagacgatggttgatggttttaacttttggctatggcggttccagtgtcctagtatactaatcgctcactgtccttttcttctccgcattgcttccatgtctcttccgatctcactgccaaccttgggatcgaagatatcactttgtaagtctccaggttctctttgtataattttgtacggtcgttagggttttaattatctgcataattaaaccatcagtatcgtctcttaatttgatgtttcttctctttgtacgttatttgtctctgatcattggttgatgatgatgttaaatgctacttattaagaagaatctgagatgtatctttcagtgactcagagcattattaattcctcattaccataaacaatcaaaggtgcttatggcgtcactttcctttgttgatctcacctgtttggttgtctatgcatgatgatgattctaatgtctttttcattgcatctgcttattttcttggtgttttttttttcttttttaactattgtgtatttttggtgatctgattactgtgactcagaacatttgttctttttttgtatcttaggagaatggggtcagagggaaacatgaagaactcggttgtgacacaagtaagcattggtgggtttggggagtcaactactgcaaaagagcttacagattaccttgaagaagaagtaggactcgtttggcgatgcagattaaaaacttcttggactcctcctggttcttatcctgatttcgagatcactgacacttcaaacatccccacatttgatggttacaagagagtggagcctcatgcgtttgtccatttcgcggtccctgagtcagcaggtcgtgcaatggatgctgcggggcagtccaagctcatcctcgacggccagcctttgaaagtcagcttggggcctaagaacccgtacacacttaaccagagaagaagaacgacaacaccttataagctgactggtgtttcgattgagattgggaccttgattgcccgggatgagtttcttgtttcttggagagctgaaggggttgatttcctcgtagacccttttgacaacacctgcagattttgcttcacaaagagcactgccttctcgttgaaggacacaatgatgtatgctgtgatcaactgtgattataagttggagttattggtgagagacatacgaacagtaaggcagtatagaactctggatggctatgtgctactcttgcagctggcttcatcaccccgtgtctggtacagaactgctgatgatgatatatatgaaactgtccctgtcgatctcttggatgatgatgacccttggatccgtaccactgattttacccaagctggggccattgggcggtgcctttcatatcgagtgctcatctctcctcggtatgagaagaaaatgaatacagcattggactatctaagggcgcggagagtgcaagaggaacgtgtgaggtggcctcccaggattcgtgatgagccctgttttggggagcctattacagatcatttcttctgcattcaccacagggaaggaatctcctttgagatcatgttcctggtaaatgcggtgctgcacagaggggtttttaaccagtttcacttgactgagcgcttctttgatcttcttagaaaccaacccaaggatgtcaacattgcttctctcaagcatctctgtacctataaacgacctgtttttgatgcgtacaagaggctgaagcttgttcaggaatggattcagaaaaatccaaagcttttagggagtcacgtacagttggatgatatctctgagatcagaaggctagcgatcactccaaccagagcgtattgcctacccccagaagttgagctctccaacagggtactcaggaaatacaaagcattgtctgatagatttttgcgcgtaactttcatggacgaaagcatgcagaccatgaactcaaatgttctttcttactttgttgctccgattgtgaaggaccttacatcaagctctttctctcagaagacccacgttttcaaaagagtgaagaccatattaaccgatgggtttaaactatgtggtagaagatacagttttctagcattctcggccaatcagctcagagaccgctctgcatggtttttcgctgaagacgggaaaacaagagtgtcggatataaagacatggatggggaagttcaaagacaagaatgtggcaaaatgcgctgctaggatgggcctgtgcttctcctccacatacgccactgtggatgtcatgcctcacgaggttgacaccgagcttccagaaatagagagaaatgggtatactttctctgatggaattggtacaatcacacctgatctcgcgttagaaataatggagaaacttaagttggattcgcactgcagcccttgtgcttaccagatacgttacgccggtttcaaaggagttgttgctcgttggccatcaaaagatgatggaatccggttagcccttcgacacagtatggataagttccactctaagcatacaatcctggagatctgttcatggaccaggtttcaacctgggttcttaaaccggcagataattaccctcttatctgtgcttggtgttccagacgaaatattctgggatatgcaggaaactatgctctgtaaactgaaccgcatccttgatgacacagatgtcgcatttgaagttcttacagcatcatgtgctgaacagggaaacactgcagctatcatgctaagtgcaggtttcaaaccaaaaactgagccacatctacggggaatgctgtcttcagtcaggattgcacagctctggggtctcagagaaaaatctcgtatttttgttacgtcaggaaggtggctaatgggttgcttagacgaagcaggggtacttgaacagggccaatgctttatccaagtctcgaaaccgtctatagaaaattgtttctccaaacatgggtctcgttttaaggagacgaagacagatctgcaagtagtgaaaggttatgtagccattgctaagaatccttgtcttcacccaggggatataaggattctagaagctgttgatgtacccgagctgcatcacatgtatgactgcctactttttcctcagaaaggcgagaggccacatacaaacgaagcttctggcagtgaccttgatggcgacctgtactttgtggcttgggatcagagactcatccctcccagcagaacaagctttcccgcgatgcaatatactgcagctgaagaatcgagtaagggccgtcctgtcaaccaccaggtcaatatctacttacccactactcttttttttccggttagctgagattatgacgcttaagatggatagatgatttgtttttggatgcttgtagtgattatttatgcttgcatactgagttcatcctgctgcaggaactcagatgaatgaaatattagaaaactttgaatcgttgattctgattttcttagttattatcaaaagtgcagtagtctcatgatgctagcgtctgctaatctagtaatgatttctttgttttactttcttttctacgacaaggactttggtaactggtcggttttgttacaggacataatagagttctttgtcaaaaacatggcgaatgagaatctgggtacaatatgccatgcacacgtcgttcatgctgataggagtgagtatggagccagggacgaagaatgtttgctactggcggaactagctgcaacagcagtcgatttcccaaagacagggaagctggtgacaatgcctttccacctgaaaccgaaactctaccctgatttcatgggaaaagaagagtaccagacttacaggtcggagaagatcttgggtcggctttacagacgtgtaaaagaggtttacgacgaagatgcagaagcttcctcagaagaaaactcagacccgagtgacatcccttatgacactgatctcgaagtaccaggatttgaagattttgtccctgaggcatggggtcacaaatgtagctatgacgggcagctaattggtcttctcgggcaatacaaggtgcaaaaagaggaagagattgtgacgggtcacatctggtccatgcctaaatacacaagtagcaaacaaggcgagctgaaagaaagactgaagcattcttataactccctgaagaaagagctgaggaaagtattcgaggaaacaaaaccggagcacgagagtctcagcgaagaagaaaagaacgtcatgtatgagaaaaaagcttcagcttggtatcatgtcacttaccatcccgagtgggtgaagaagtctacagagctgcaagaacctggtgagtcgtctggtcatgcggtgatgctgagctttgcttggatcgcagctgattatcttgcgagaattaaagtccggtcaggggaaatgggaatgaaaatggactcggccaaacctgttgatgctttggctaagtatctttctcaacgtctctaa

SEQ ID NO: 359 - DNA, 3682 bp, Brassica rapa
aattccttttttaactttattaaaaaattcctttttttattatatgtatatgtttttggaaattttttaaaagaaagctaaaaaaaataatagtatttaatattttaaatttgttaagggtatcattgtaatcaaccattatgatagttaatgtgagagcgacacatatgataacgacttctcaattaatattatagagaatagatataaagaaagtattttattacttcaagctaaaaaaaaataatagtatttaatattttaaattcattaagaatatcagtgtaatcaaccatcgtgatagttaatgggagagtgacacatatgataacgacttcttaattaatattatagagataaaagtcaagaagaactgttttgctatattggtatctaacgttttgtttttgttttttttttccaaataaaatagtcaatacgttttattgtaaatatatagataattgtttatatacgtatatgtttataacggttgtttaataacagttttagcccttacctaccaatctaatagtacatttaaagtaaatagaaaatgtatttctaatgtttaattaggataacatttttaagtttttatcacaaaaatagcattcaatgaagaaaatgactaaaataagttttattaaaagataaaaaatgtatttttaccaaagagttaactaatttatacttagagtttagagttaagagatgaggttttggggatatgattttaaatttaaaaaattaaaaaataaatattaaaattttcataataaaaatgaactattttggtcatttttttctgagaacgatttttgtgataaaaacttcaaagtgttattatagagaattgccaaaaacaaaaaaatatatttctaccttttgcagtgtttatatgagtagcacaaacaaacaaatcatgttcgtacgtattaaatgggccaaattaaagttgggcagagaaaaaaaaaagaaaaaggtcgaaaacaaaatcaaatcgaatgaaatttggagtccggaccggacccggagaaaataggcccttctatatagaagcgacccactcagcttttctcatttgtctctgttcatcactctctcctttgtcctttgctcctcactagtactcaactgtctccgagcgtttcatccatctcgcgaaatctccgtcgccgtttgctctctgtaagttcttcatcgtcgatcgctctctgcgtacacaccacatgcttgatttcgttttcttcctcggataaacattaccctagaattctctatttttaagagtttttgttttatatttttgtatataaagatgtctcctttttgttgtgctctcctcgtttgcgccaagtggtgcttagtcgttgatgttttttttttgttttcacagcggaaaaatctcgactttttgagttttacctcatgtttttggcttgatctatatgagtggtgactgttggcttttggttgatgcaacaggtttggttcgatatgggttcaaggggtgataagggaaagaacgtctcttcgggtggctctaacgcagaggttgaacagctggcgaaaggcttttcggagacgaagctgggtccttcacaagacggtggaggagagtgggaggtcatctccaaacggaacaagaacaagcctggaaacgctgctgggaagtcatgggccacagctcctaaccagaaccctcctagagcgtggggtggtcagcagcagcagcaagggaggggtaacaatggctacgggagaggaaggggaacgcaagtctctactggtcgcggagctgggcgtggacaagcgatgaacagagggtatggtggtgcttcggctcctgttgctcgacctcctctggaaggaggatggaattggcagtctagaccgggtgctgctcagcagactgtgactgaggaggttccagaggtggatgatgatgatgtttctgagggagaggaggaggatgattgcgatgctttggatgattctgatgaagacctggcgagtgatgactacgactccgatgtgagccagcaaagccatgggacgaggaagcagaacaagtggtttaagaagtttttcgacagcttggatagcttgtctatcgagcagataaacgagccgcagaggcagtggcattgccctgcttgccagaacgggcctggtgctattgactggtacaaccttcagccgcttctagctcacgcgaggacaaagggagctagacgtgttaagctccacagggaactggctgaggttctggacagggatctgcagatgaggggagcatctgtcattccctgcggtgaaatttacgggcagtggaagggtttgggtgaggaggaaaaggatcatgagattgtctggccgccaatggttgtcattatgaatactaaactggacaaggacgagaatgacaaggttaacttttaattcattttctcttgcgttctgttgactataggtggaaaaactaactaatgttaatacatatcagtggctaggcatgggcaacccggagctgctggagtactttaacgagtatcctgctattagagcacgccattcgtatggtccgcaggggcatcgtgggatgagtgttctgatctttgagagtacagcgactggctactttgaggctgaccgcctacacagggacttagctcaaaaggggttagatagagacgcatgggagcgtcgccgcagttggttttctggaggtgttcgccagctttatggcttccttgcgatcaagcgagatttggatttattcaatcagcattgtcaaggttctctctctcccttacaaatatatgtttgaagtcttgattaagagttttgttggtccttgtttaaagttccatgtgttttttttgttagggaaagcaaggctcaagtacgagatgaaatcgtaccaggagtatgttgtgaaggagctgaggcagatagctgaagacaatcagcagctgaactggttcaagaacaagctgacgaaacagaacaagcacgccaaggtgcttgaggaatcgctgggaattttgagcgagaagctgcgtaaaactgcagaagataaccgtatcgtgagacagagaacaaagatgcagcatgagcagaacagagaagaggtgtgttctttttctctgaaaacacacttgatgttttgaattagtaccttctgatacacttttttttttattttggaaaaaaaaaacttggtgggttgatgaagatggattcacaagacaagtttttcaaagagtccatcaagcagatacatgagaaaagagacgcaaaggaagaaaacttcgagatgctgcagcagcaggagcgtgctaaagttgttgatttgcgaaagaggtatatatgtatactatcttatagaaatcctctgcgtttttagtgaaacagaagagcaaactaaattcttcgggtttgattcttctgcagggctgaggaggtatccagcttcatagagtgtcaagagaaagagatgaaagagtttgtggaggagagggagaagctgatagaagagcaggagaagaagatggcagagttgaagaaaaagtatttcgaggagatgcttgatctagagaggggatttgataaggcgttggagcagctcatgagcaagcacggcctccacgatgcagatgacacagatgactactag

SEQ ID NO: 360 - DNA, 4202 bp, Brassica rapa
tttaaaatcaaataatagtgcgtctcattttaattcttttcagaaaattaagatatttgaaaatattaaatatcgatattataattttttcataatataaacattacagattatattttttataaaaactataacctttttctgaatatagtaactttatgttattaaaattatttgttattctttgctatattatttataccttaaataaatagatatgtaaataaaataattttctaatatttctcctattttattatattggtgattcacaatatgaagaaaatatatgtttgctttgccgtaaaacaactatttgaaatgatttaaaacagaaagtacccagaaccgaaaaattcgaaatttttatatatccataccacacaaaatatcaatatatttaatcactttaaccaaaactcaacttcatatataaccagaattgttcatatatttctaaaccaaaaaccacaaccaaactgaaatcgaaaaccaataaaagcaaattagaatcgaacgaaaaccaaaaatatttataacgaaataaattagttaacaaacagttatatcaacaaatttgtcaacaaatatattcctgcgctttgaaagcgcgggtcaaaatctagtatttttataaagttggcatttttatatgctaatttctttttaaaatactgtttacatattttcttatattagtttaattattttattgatatttagtaagaaatacatgacacatgtttaatttaactacattttaaactttcagtaagaaatcatctaatgaaacatcaggacgattcaaaatattcgacatgtacccttaaaaaaattactgttcgtaagaaatgaaaaaccaaaacttgatcactacattttattttttcctattagtcaataaattttagatacaatgtaactaattttatttaaatatttctttccttaataattttttttgtatcaactattttctattaaatactaatttcctaattatgtatttttaatttctttattaaatactattagtttttgtgttttatatatgaatttaaatttccattaacgtttaaaaaatacccgacatgtgtttactttactttgactacttattaaaagttttagtaaaaaatagatgtctcatctacatatacttatgaaacgtcgtgaatctaagtatataaatcgtcgaagttttattttctcagtaaatcacattttattttttatatcaactatttttttattaaatactaattttctattttttgttttaaatttctatagtaaatactatttacatttttgttttctttgtaaatttaaatacccattaatgtttaaaaatatacacgacgcgtgcttactttattttgactaattattaaaaaattagtaaaaattagatatgcaatatatatatacttatgaaccgtcgtgaatcttacttgagaagaaaaaaaaatcaatcgaagctttgcatcttctcaagaaatgaggtattccgtcaacttttaattttgattctctttattttcataatcaattgtggctacaagctaccacgcatcttaggagggcttgttggattgatagtttggtgcgatttcaattttttttcccaaatctcatcttattagatctagtgtttgtaaaagttatcttaaatccttgcttattggacttatcatttattcaaactctagttgtagaagaactccaagtttttgaatccttataaatagaactgatgttaaactgaagtatttttttcaatattatgtaaagaactctagatctcaaaaaatatttaaactttcaaagatctaaaatgtatcctttgcaactgatacaacatggatgcatattcaatcattgaaatgtttaacatgtcttaacattgatactcatatccatatgacaaggtatgtggtctcgatattgggatttgtcaaaatagctcaaaataattaaattaataatacctgaatattataaatacaatataaaatatttagattatgtaagaaaactaaaaattacgaagaacattagagttcttttgatggaattttatggatataaaaacatacatatctgttctttctttttctttttgacaactcatatatatgtgttcttataaatagatttttttccattcttgatattttaaagtattttaaaatttattatattataatttggtgatattttaaattatttctagacttttatacttttttataatccaaattatctcaaaatctgaatatattattaaatccttagaagaatcgtaacctccttcttctggttgtaacatctggatgttgtcattgtaatctctgcctaacaggaaccacaactacaactccttgaacaacgtgaacgcacctggaaatgatgcatggtctgattcggatcgtggctcaagttctttccggacgcgaagcccaggtgctgttctgcctctctccgcttcatttgggagaatgactactctagtcccgttccccgaccttaatctcatgccggattccccaccccccgaaacctcctccaacacaagaatcaccgccgtacggtcattggctccgacactaggtgttgagagaaactccctcgcgatcttccccgtaccgggtcacgaaaaccaccatgctcgggtggttcaaacactccaccaagacaaccaggaacttgcccggtatgtcttcaaacggactcgaatgatctacgactctctcctgcttcagctcactgtggagtacggacctaatcccaagccagccgtcaatgtcagggcttcgaaactgatggaagaacgtgggttgtggctgaacaagggccaacacttggtaggtccagtccccggggttgagatcggggacatattcttttaccgcaaggagctttgcatgtacggcttacaccgccattcacaagccgggattgaatacacaaaggctaggctaagctcctttggcgtgcctatagcaaccagcatcatcgcatcgggtggctacgaggacaatgaggacagaggagatgtactggtttattcgggccagggtggtcgggacaaatccgggcagcaacgtcagcaccagaagctagtacgtgggaatcttgctatggtacaaagcatgcaactcggtgtcccggtacgcgtcattcgcgggtttcactacaaaaacgaagtcagctcgaatgtgttcatctacgacggcctgtacaggatcgtaaagtccagccgtgttagaaagtcagggtttgatatcttcaagtttacacttgttagaatccaaggacagcccgagatgggcagtgcaagactgatgcgtgcgctaacacttagaaacacaccattggcttggatgcctgctgggtatataagctttaacctttatggtaaaaacgagggtgtcccggtgtatctgtataacgacattgactatgaccgctcaccgctgaactatggctacatctcgcaatctgacattagtagtgtgattcttgctcaaggagggaacaacggtggatgcgattgtaacctctcatgcactgatgattgtatatgcgtgaggaagaatggtggtgagcttccttacagcccttatggatctttgttgagagggaaacacgttattttcgaatgcggggttacttgcaagtgcacttctggttgcacgaaccgtgtcgcgcaaagggggttgatgaagaagatggaagttttccgaaccagggaagctggttggggtgttaggtcgctggatttgattcacgcgggcgagtttatctgtgagtatgctggtactgtggtcacaaaagagctaggggagattatgtcgatgaacggggatggtctggtctatccgggacggtttgctgcaaactggaagttgtggggtgatttatctgatgtttacccgggtaatgtcccgccgagttatcctactattccgccagttgattatgcaattgacgtgtcgagggtgagaagcgtggctgctttcattcgtcacagcagagaaccaaatgtgatggctcagtttgtgttccatgaccataacaacttgaagtttcctcgcgtcatgctttttgcactggagaacatctcaccgttaaccgagctaagcctggactatgtggtggtcgatgaagtggacgagagactcgccatccgtggctga

SEQ ID NO: 361 - DNA, 3506 bp, Brassica rapa
tgaagatgaatacaccaatttaagtgctacagatcgaatcaatttgataataaatatagtgaattgagattagtaatgatgcattctccgactttatgtttgtatatctttgactcacttcgagtctgatcatgattgtttcttgtaacatgtatcttatcatctgttgttcctgtataagcttgaaaggtagtagcttgattagtctgctgagacatgagtcagttttgcttgcaggtttctgtgatctgtatagcatctaaagcttcagacttttcactgaggaagctttgtgttttgattaacaggtcttgcaaaaggctttggaagtgtggaacttacaagtgatccctctcaattgccgcgatgcagagcctgcgcagatagaccccgagcttgaaaacgcattcatctgccacttgcacgaccattggttctgcataaggaaagtgaacggtgaatggtataacttcgacagcctcctcgctgcaccgcaacacctgtcgaaattctacctttctgcgtttctcgactctctcagaggctcaggatggagcatcttcattgtgaaaggaaacttcccgcaggagtgtcccctgtcctcttctgaggcttcaaacggttttggtcagtggctttctcctgaagacgcagagaggctgttaaagaccacgggagcagtgcggaggagttctccttcttctgccagtggaaacagaactagtgataatgttgatcaacagagaccatacgaggcattgtcgagggaggaagtgagggctttttcggagatggaggatgatgacttgaaggcagcgattgcagcgagtttgctggatgcttgtgcggctggtgctaatcctggagcagttgggtcttcttctcaaaaggaaactgagaaacaaaagtagctgagaaaatagagaaccaaaggcttttcattgatgtgggtgaaggaacacttactttgattctgtttttgtttttgttgtctaaatattttacatacagaacatagaagctttacatcgacagagaccaaacgtttttgtgatatggtgttttgtttgagttcttttttttttttggtaaaacaacccatctttaattctgaaaatcttaaatactgaaatggtaaatgtttcaaatatttgtttatatattcatttaagaaaattaaaataaaatagataaatacttcttttttctgcgacatgataaatattaaatactgctttcgtaagttttggattcagtattttttgcttcagtacttttataaactgtaattgattttgacaaaatattaaatacttttagttaaacaataaatgtttcaaaagtttgtttatattgatcatttaagaaaatgaatgaagcttcttctcggcttagcttgaagaaccaaaaattaaaaaaaaaccctatttcttcgatttatcgctcaaaacctagttacccccttcttcttcttcttctccttgaaagagagagagagagatgacttctcacatacctatggtgatccctaagccggagccagtcactgattcctccccacaaactccgattccaccctcatccttcttcaatttcaacaccaccaccacccaatctcccctcgaacctaacttgtacaccgagttcaccaacgtcgccgagactttccgctccgccttcgcacagcgcctcaaacgccacgaggacgtcacggtcctcgattccctaaccggcgccatcgtacccgttcccgaggagcaagatccggatccggatccggtcagttacccttcgcagtccctcaagccgcgtaaacctcaggagcgctcgtctgagctcgtgaggatcaccgacgtcggccccgagggagagaggcagtttcgggaagtggtgaggaagacgaggatgatctacgattctctccggatcttcttgatcctcgaggagactcgtgaagtgctcggaaggaggagaggcaggcccgatagcaaagccgcctcgatgatgaaagagcgtttcctttggcttaatcgggacaaacgcatcgtcggttcgatccccggcgtccaggtcggagacatcttcttcttcaggctcgagctctgcgtcatggggttgcacggacagacgcaggctgggattgactatctcattggctcccgcagctctaacggagagccgatcgccaccagcgtgattgtctcaggtgaatttaaaccggttcagtcagattccggtttagttagattaattatggtttagttttcttttgagctgaataacaaactttctattgattgatttgattgaattcaggtggttatgaggatgatgatgatcaaggggatgtgattatctacacgggacatggagggcaggacaagctcgggaggcaggctgagcatcagaagctcgaaggtgggaatctcgctatggagaggagtatgtactacgggattgaagtgagagtggttagaggttttaagtacgagaacgctgtttctagcaaggtttatgtttatgatgggctgtttaggatcgttgattcttggttcgatgtggggaagtccgggttcggtgtttttaaatttaggctggagaggatcggagggcaggtggagatggggacgtcggtgttgaagttcgccaagacgcttaaaaccaaccctttgtctgtgagaccgagcgggtacatcagcttcgatatctccaacaggaaggagaacgctcctgtgtatttgttcaacgacgttgatgacgatcaggagccgttgtactatgagtatctcgccactacttctttccctcgcggcatattgggtggtagtaatggtgataatgcgagtggatgcgaatgtgtcagcggttgtagcagcggctgcatctgcgagaggaagaacggtggcgagtttgcttatgattacaacgggaatttgataagaatgaggccgttggtgcatgagtgtggaccggggtgtaagtgccctccgacgtgtcggaaccgcgtgacgcagaaggggttgaggagtagactcgaggtgtttaggtcggtggagactggctggggggttcggtgtttggatatattgcacgctggcgcttttatttgcgagtatgttggggttgctttgacgagggagcaagccaacattctgacaatgaacggcgatactttggtgtaccctgctcggttttgttctgataggtggaaagattggggagatttgtctcaggtgtttccggattacgagcggccttcgtatcgtcagatccctcctgttgattatgcgatggatgtttcaaagttgaggaacgttgcttgttacataagccacagtaatgattcgaatgtgattgtacagatggtactgcatgatcacaacaatctgatgttccctcgtgttatgcttttcgctgctgagaacattccgcccatgactgagctcagccttgattatggagtctctgatgatgaatggagccccaagctcgccatttgtaattaa

SEQ ID NO: 362 - DNA, 3473 bp, Brassica rapa
ttagctggtatatcatcaacatcaactaaattagatgatacgaccgctgatattatatatgttttcgacaaaaagtaaatattatgtatgtcatttaaattattcaaaagtacatatatgtttttccacgatcatataattcggatatgaattgaacatatcgcgatatgttggttatgaaaaagccattttctcgtctatgtacaatataaaatcataccaaaattaaaagattaatttctaaataaaaagatcttatttttaaaacagaatgttgaatagtttatacttctaatttagatcgtattttatataggaggtttattgaatccaagattcgtgtaaatctaagattcgagtaaatccaagaaaatcttagatttgagtaaatcttaaaaagattttgttccaatgtttatgagtttttgtagaattttttaaatttaaatatttatttaaaattatatttttatattttaaactactataggtcgatatttttatcgttttatgaaatatataaatatataaaaagaaattgtattttcccaaatatatgctcatgtagatgtagattaatacgtcagttaatttttcttatgaagataacacatatataatattattatttaaaaaaatatagttaagagcaatgttttttatagaaaatgtaaacgaatatatctcttatacaagattacatttttaattttactaaataatgaaatttataaaattttacatttcccaagaatatatttttataaaataactatttagatttattttatttaaaaaagtattctacacatgggatttcgtcggcaaaattagctggtatatcatcaacatcaacaaaattagatgatacgaccactgatatggcgacttatatatgttttcgacaaaaaagtaaacattatgtatgtcatttaaattattcaaaagtacatatatgtttttccacgatcatataattcggatatgaattgaacatatcgcgatatgttggttatgaaaaagtcattttctcgtctatatacaatataaaatcataccaaaattaaaagattaatttctaaataaaaaagattttatttttaaaacagaatgctgaatagtttatatttctaatttagatcgtattttatataggaggtatatcgaaccaaagattcgagtaaatccaagattcgagtaaatccaagaaagtcttagatttgagtaaatcttaaaaagattttgttccaatgtttataagtagactataagattagaaaaattcaaataccatcctatcatttccttatgcctataagtaggcaataagatcaccatagtctgttgtccaaaaagaaaaaagaaaaaaaaagatcaccataagtctttcaaagcatttcgaaatcattaaaaaaaaaaccaataaagtcggatccggatccggatctcggcccaaagcccaggtgtactttccgtctccgtcccgcttcatttagaagaatgaatactctattcgcatttccagaacttaaccgcacgccctccgccgccgcgatgatgtcactgcctccgagactacgcgtcaaggccgaaccaattgacgatcctacccctcctcctactcctactcctactccaactcccaccctcaccccctccgatatctacgccgagtactacagcctctgcgaacgtgtcgcttccgcattggctaaccgtaacaacgacctcctcgcgatcgtccccgtaccggaagaaaaacctcccctcctccactctcctccaccgatcccaaccccgccgggatcaggagacaaccgcgctctctcctcccgcctcccgccgaggttccagagaccgcatgagctcgctcgcgtcgccgacctagggcgcgaagaccatatacaccgcagagagatcctgaaacggactcgagcgatctacgactccctccgcctccatataatcgcggaggcgatgcggcttcccggtcggcggcgtaaacctagagccgattacaacgcctcgactctgatgagggagcgcggactgtggctgaaccaggacaaacacgtcgtgggttcgattcctggggttgagattggagacatgtttctttaccgtttggagctctgtgtgattggcttacacggccagccgcaagctgggattgattttctaacggctaaccgaagctcaaacggtgagccgatagctactagcattatcgtctcgggtggttacgaggacgatgaggatacaggggaggttcttgtttactcagggcacggtgggcaggacaaagtccacaggcagtgtcagcaccagaggctggaaagtgggaaccttgcgatggagaggagtatgcattacggtatcgaagttagggtgattcgtgggtttaagtatgataatgtggttagctcgaaggtgtatgtgtacgatgggttgtataggattgtacagtattggtttgatgttggcaggtcagggtttggtgtgtttaagtttaagttagttaggattgaagggcagggtgagatggggagtaggaggatgaagtttgctcaagcgcttaggactaagccgttggcggttaggcctaatgggtatataacgtttaacctttctggtggtggactaagccgttggcggttaggcctaatggggatataacgtttaacctttctggtgggaaggagaatgttccggtttatctgtataacgacattgattttgatcgtgaaccggaggggtatgactacattgtgagatctgcgattccctgtgtgatttctgctcgcggaggggctaacaggggctgtgattgtaactattcgtgtggtagtgattgtttttgcgcgaggaggaatggtggtgagcttccttatgatgacgacgggactctgttgaagggtaagcctgtggtgtttgagtgtggggttttgtgtgggtgtggtccgagctgtaagaaccgtgtgactcagaaggggttgagtaagacgctggaggttttcaggtccagggaaacaggttggggtgttaggacattggatttcattcaagccggggccttcatctgtgagtatgctggggtggttctcacaagagagcaagccaagattgtatcaatgagtggggatcctcttctctatccgggtcggttcacagagaaatggagtagtttgggtgatttatctcaagtgtacccggagtatgttcagccgagttatccttctctgccgccggttgattttgggatggatgtgtcgaagtttagaaacgtggcttcttacattagtcacagcaaagaatcaaatgtgatggcgcagtttgtattgcatgaccatagtaacttgatgtaccctcgggtcatgctttttgccctggagaatatctctccgttgaccgagctaagcctggactatgggttggacgataagctggaagagcggctcgccatctgtaattga

SEQ ID NO: 363 - DNA, 6169 bp, Brassica rapa
attaaccaaatctattcggagaagttaatatattttaaacaggaatcttcaaatattttgttaagattacaaatagcaattacaaattaatgaaatctatagtcttaaatggattcttattattgtaagtttatcatattttttatatatattctatcggctgatccgcttggttatttaacaattgttttaataaccaagttttcgtttatgccaatatatttaatggattattatatattttaacctaaatttattaatattcggaattaacatttaacacaatataaccttcgtgtaactcagccatataaatagtcatgcatttctaactttctaatctttacccttcagaaaaagacatgacttatactatgattagtctcactgatattaacccaaactctttattaatgaatgaatagaatcttgttgaaaaaaaaaaaattatagtataaattttagttattgttacgaatgttgagagtcagtcatgctcgggttcttacattatatttgcacttttgtaacccactatatttgtataatcaattttggtttggtcctcaactttctaatataattgaattggtccattaaactgataaccgcgtgaataaagaaagttagtcttcgtatttgttgtcccgtttttaactttttctcatattaaagtagctcaatacgaaaaatgctgctcaatatgcaaataaattaaaattcacaaatatctttatcgcgatacaaatccaaaagtaaaaaaaggcgagcgatcgtacaaaaaagaagataagaactaagaaaaaacaatattcctaaatcttcatcattattgaaatcatcgtttaccgatgcaaagatggcgcaagcttgtcatgatggtctgcatttaaaacggtaattatggatactgtcagatatcatatcaataactatcacattagctgagataatttttactattaatgttttttagaattttaactaaacgaaaatagtaatcaattgtcagacgtttcacctacgtgcaactaaacctatcctgataaatttgtgacaaagaatattgcataaattgaattagctgagctggtctacatttattcctaatcacaaaaagagcaaaaaacgtaccaaagatatctctttctttgggtagcaaacagaatcaaatttggaaagagtagagcctggtagggatcaaatacaaattacagaatagttattaaaaagcagtaatcgtggtattgttacagagtaggacccacaaataaagtagaggaaaaaaccacgaacttggagccaaagcaacaagggcataatcgtcatttcccgaaggttaattagttatttttacaaaatagtaaaaattcgtcaaccgtctcttcgctcctttaaaataaagtctcctcactcccctctctctacactactctctcctttgtctctctttccgttttcgaattttgttttcttccttcgtaagcttcccttcgaaaaatgtcgtctcgtggtggtcgcggcggcggtggaggacgtcgatctgaccagtcccccggtcccgttgcgtggcctgcactgcaaagctccggcgctcgcggcgggagaggtcgcggtaacgccgctcccgtcgcttcgagctcttcgtctcctccgtcggatgctgtttccggcgccatcggagcggttgacgtcgcttcgtcgtcgtccgtacgtgagaaacccaaggcctcggcgtcttcggattccgattcgtctctcggtcaggagttagcggagaaagtccagatcacgacggctcctccgtcgtcgtcgaaggcggtgacgtttccggtcaggccagggtttggtcaggcggggaagaaagtgacgattcgcgcgaatcacttcctcgttcaagttgcggatagagatctctatcactacgatgtaattagtctccttcgagttttctactttattgtaacaagtttgttacattaaaacaaaaaaaaaagtttgttatatttcttcagcttactgtatttgcgttacggttagggttgtttgttgcgttcgtggatgggactttatgtgtgttgattatttgtctgcgcacaggtgtcaatcagtcccgaggttatttcgaagaaggtgaacagggacgtgatgacaacgttggtgaagacgtacggagaatcacacatggcgaagaagattcctgcgtatgacggcaggaagagtctctacactgctgggcctctcccttttgagtctaaagagtttgttgtggatctgaacgacaaaaaacctgctgcgtcatctaagtaatgcatattgatctgtttgttgattggtttatagtggtagcgaaaagcacgttggttgacagtgttttggctctttttggcaggagggacaggaagttcagagttgctataaagctggcgtcaaggcctgatcttcatcagttgcaggagtttctccgtcggaaacagagagatgctccatacgagaccatccaagttttggatgttgtactcagggatctgccatcccaaaagtacgttaagaatttaaacatttactctattggactaaatattgactgaatatggacttagcattgactgtattgctttctcttcaggtttgtttccgttgggaggtctttcttcgaccccagtttgggaaggaggggtgagcttggtgatggtgttgagtactggagcgggtatttccaaagtctaagactcactcagatgggactgtctctcaacattggtaagaacttattataaatttttttcatgggttagttgcggttggttttgttgactgagatttgaattgttcatgtgttcatttcttatgatgcagatgtgtctgctagatctttctatgaacctatccttgtcactgaattcatcggcaagtacctgaatctgagggattttagcaggccactgagggactcggatcgtgtcaaggcatcttatctgatgtttattcaaccagttcagtagttatcttatagaagatattgcagttgttcatacggtttttattttgtggtggctaggtgaagaaagcattgaagagcttaaaagttgaattggcacagtttgacttcgcaagaagtgtcaaggtcagtgggatttccagctgtcccatcagcgagctaaggtatggttgcttgtttcaagaaaacctaaataaaatgcggactttgtttctgatctttgatttcctagttgctgatagtacttggtttttcatttcaggttcacgttagaggacaacacccaaaaaactgttgtgcagtactttgctgagaagtataattacagagtgaaatacccggctctacctgctatccaatcagggagtgactcaaggcctgcttacttcccaatggaagtatgattcagttccaaacaatttcatttttttctttaccttcatcatttttctgaattcaggtttctaccattaaagatctgctcactttgttttttttttttgcagttatgccggatagctgaaggccagagatacaccaaaaagctgaatgagaggcaggtgactgcgttgctaagagctacctgccaaaggcctgacattagagagaattcgatcaaaggggtatacttagtcctccttgaatcacatttacacagatgtctttatttttgcattcctcttttaatagacataacgtttgttgtttatattgttagatggtcaagaataataagtataacgagattgatcttgtgaggaaggagtttggaatgtcagttactgatcagctagccacagttgaggctcgggtcctacctccacccctggtgattttctcgactccatttttctattgttttttcttattgctatacaaattctcttttcaatgttggtcactgcgaggttctatttctgtctacagttgaaataccatgaaagtggcagagaaaaaatggtgaatccaaggctaggacagtggaacatgattgacaaggtaagtgatggatatttgtgcctactgcttctattggttttacatgtaatatcaaaattttcagccttttacatcgttttgattgttgtatatcttgtgttttagaaaatgattaatggagcaagagttgcatcttggactagcgtgtgcttctctactaggattgaccggaatttaccacaagagttttgcaagcaattgattgacatgtgcgtcagcaaaggaatggtatgacttagttgtgactctctccttttattctagaaagatcgctgactgttttttatatatacttccagcaattcaatccacagcctgctattccgttcatctcttgccagcctcaaagaattgaggaagcactttgtgatatccacaaaagggcacctggtcttcaaatgttgattgtaatattaccggatgtcactgggtcatacggtaaaccactaaatccttattgtaatattgcttagttggtatttttgtgatgtaaaagatgccaacaatttggttgcttccacgttatttatatatgcagggaagatcaaaaggatatgtgaaacagagctagggatagtatcccagtgttgtcaaccaaatcaagttcgtaaactcaacaagcagtacatggaaaatgtcgcattgaagattaatgtcaaggtcttgtgatctatttttcattttctttcatagttccacatgtttatatttatgatactgtaaatttaagggttaatttgtatcagactgggggacggaacacagtccttgatgatgccattagaagaaggattcctctgattagtgatcgcccaaccataatctttggtgctgacgtgactcaccctcaacctggagaggactcgagtccttctattgctgcggtattgtatcttcactgcttttacttttctctcactatcttttctaattcagcttataagtttctatttatatattttttactaaaggttgtggcctcgatggattggcctgagataaccaagtatcgtgggctggtgtctgctcaaactcatagggaagaaatcatcgaggacctgtataagctggtacaggatcctcagcgagggccagtccacactggtatgataaggtaagaacagaagctctttctcctttttcttcttgtttgctttgatttcgcagattcacaaaaacaagaacattatgtatctgaatgcagggaacatctgatcgcattcaggagggctacaggtcaaaaacctctgaggatcatattctatcggtaagtcaatattgatatagggcctgaaaataataatctgttttgctaatcgttttacctttctatgcagcgatggtgtgagtgaaggacagtttagccaagtgctgttgcatgagatgactgctatacgcaaggcgtgtgcctctctcgaagagcgttatcttccgcctgtaacgtttgtggtcgtccagaaaagacaccacacacgtttgtttcctgctcaacacgggaaccgtgagacaactgataagagtgggaacattcagccaggtatctcgccacaatctgctctttaattcgtttggatcattgtcaacatatacaaatttgaaatatttttttgcatcttcttcttataggtaccgtcgtcgataccaaaatctgtcatcccacggagttcgacttctatttgaacagtcacgctggcattcaggtaaatcaagaacttcccctagtatagttaaacatctttagccagtttcatcattaggaactataagctgcttttgtttggttatagggaacaagcaggcctgcacattaccatgtgcttgtggacgagaacgggttcacagctgatgccttacaaatgctcaccaacaacctttgttacacgtaaggaacaaaaacttacatttcccttttgacatgtttgtagtagagaatttttctgaaaattggtcttaaaccgtaggtttgcgaggtgtacgagatctgtttcaattgtgccaccggcttactatgcacacttggctgcattcagggctcgttactacatggaaagtgagaactctgatggaggttcaagcaggagcaggaacacaaccgcaagcacgagtgctgttgtctcgcttcttccagcaaccaaggataacgtcaaggacgttatgttctactgctga

SEQ ID NO: 364 - DNA, 3519 bp, Brassica rapa
atggggaaaacgattcaagtgtttggtttccctaacggcgtgagcgcagaggaagtcaaaaacttcctcgaaagactcactggcccaggcacggtctacgcaatcaaagtcagacaaccgaaaaaaggcggtcctagagtctacgccatcgttcagttcacatccgagagactcgctaggcatatcgtcactctagccagccagcgtctcgactacggaagatcttacctcaaggccttcgaagtcgaacaagacatcgtccccaaacctagagcttcgttgcacaacatgccgaatttaaaaatgtacttcggatgccaagtctctcccatgaagctttccgttttctggagtgctcaaaacgtcgccgtatcgtacggaacggggatgcggaaattccacttctcattgtcttggtgcgagaaagagtatcgcctcgagcttccttacgaaaacatatggcatatcgatttgcatttccctcaaggacgtagagactccaagtttcttgtgattcaggtcattggtgctccgaagatcttcgagaaagaagatcaacctgttaacctcttgttcgggttgctagacttctaccgcgacgggtccgacgagcagtggataagaactacagacttcacttcctcttcatgtataagccaatcatcagccttctgtttagagcttcccgttcatctcaacgtctctgacttcagagagaacttcgccaactacgcggaacacgaagacagcactttcgccctcgaatccgggcgtagcttctcatcaaacgcgaacaaactcgtccctgttgttgaccctcctccagggtgttacctccctttcgagatcttgttcaaagtcaacacactggtccaaaacgcgtgcatcccagggccagctctcgatcccgccttctatcagctccttaacccgcagagattcgatagagctctcatagaccactgcctcgagaagctttttcaccttcccgaatgttgctacgctcctgctcgttggctacgcgaagagtactcaacatgggtaacgaaagggaagcttccacagtctcctatgatatctctagacgatggactcgtgtatatgtatcgggttcaagtcacgcctacaagagtctatttctctggccccgaggtgaacgtttcgaaccgcgtgctacgtcactactcagactacatcaacaacttcctcaggatctcgtttgttgacgaagatcttgagaaagttcgctccatggatctctctccacgctcctctaccgtgaaaagaacaaagttatacgagaggattaactctgttcttagggacgggatcgtcatcggtgataagaggttcgagtttctcgcattctcttcctcccagctgagggagaactccgcgtggatgttcgcgccggtcaacgggatcacagcagctaacatcagagcttggatgggggatttcgacaatatacgaaacgtggctaaatacgctgcgaggctaggccagtcgtttagctcgtcgagggagacgcttactgttaggagagatgagattgaagtgattcccgatgtcgagatcagatattctgacgttcactatgtgttttccgacggaatagggaagatctcagctgagttcgctagacgcgtagctaagaaatgcggcttgacggagtttttcccgtctgcttatcaaatccgttacggcgggtataaaggagtggtggctgttgatccgaactcctcgaagaaactgtctttgaggaagagtatgagcaagttcgagtcggagaacacaaagctggatgtgttggcgtggagtaagtaccaaccttgttatatgaacagacagctgatcacgctgttgtctactctcggagtcgaagacaatgtcttcgagaagaaacaaagagaagttgtgaaccagctcgacgcgatcttaaccgatcctcttgaggcttttgaggctctcggtatgatggctccaggggagaacacgaagattctcaaggagctgatcttgtgtggttacaaacccgacgccgagcctttcctctcgatgatgcttcagaatttcagagcgtcgaaactgttggaactgcggaccaaaactcgggttttcattcctcgcggaagatcgatgatgggatgccttgatgagaccagaacgcttgaatacggtcaagtggtggtgcagtatacggatcccactaggccgggaagtaaatacatcgtcacgggacttgttgtggttgcgaaaaacccgtgtctgcatcccggtgacgtgcgtgttcttcaagctgtcaacgtcccagctttgagtcacatggtggattgtgttgttttcccgcagaagggcccgcggtaaactcttgtctaatcttgattataatttttgccaaacttctttaatagtctagaacttacattggaatctgatgttatttttgtgcataggccacatccgaatgagtgttccgggagtgatttagatggagatatatactttgtatgttgggatcctgaactcattccacaaggaacgtctaacccaatggactacactcctgaaccagctcaaatcttggatcatgatgtcactattgaggtaaaaatatctttgatcgcttgtttattttattttattttttgttatttttgcatttggatagtaattttgatatgctaaacctttttccaggaaattgaagagtatttcacgaactacattgtgaatgatagtcttggaatcatcgcaaatgctcataccgctttcgccgataaggaacctctcaaagcattcagtgacccgtgcattgagcttgcacgaaagttctctatcgctgttgatttcccaaaaacaggtgttgcagctgagatacctcagcatctttacgtgaaagagtatccagattttatggagaagccagataaaccaacgtacgagtcgaaaaacgtgattggtaagcttttcagagaggtgaaagagcgagctcctccgttgatctcgatcaaatcgtttactcttgatgtggcctccaagtcttatgacaaagacatggaagtcaacggattcgaggagtatgttgaccaagctttcttccacaagggaaattatgattacaaattaggtaatttgatggattactatgggattaagacagaggctgagatacttagtggcggtatcatgaggatgtcgaagtcattcaccaagagacgggacgcggaatctattggaagggcggttcggtcgcttaggaaagaagctttgtcgtggttcaatgcttctgaagatgaagaagaggtggttaatgaatctgcaaaggcctcggcttggtatcatgtgacgtaccaccgaagttactggggagtttataatgagggtttgaaccgtgaccatttcttgagctttgcgtggtgcgtttatgataagcttgtgaggattaagaaggctaatgttgggaggcgtcagcggcaggagactcttgagcggttaggcctcatgcgtttgagttga

SEQ ID NO: 365 - DNA, 10545 bp, Brassica rapa
ccactcaacgtacatccgccactgattagaagtagggcccggcaaataataagagaaaacattacaaaataataacatgaacaaatcgaaaatattcctactcatatatagattcataataacctgttttccaaccggttgataaatatatcctcccagaacaaaattcataaccttccctgcagcaacactttgactcctaccatatggctaagaagcccataccttggaaaagagaccacccatcagacctgcaaaatgttcccgggaaagtatgagatgctcccgtggtccaccaagtcacagtagagtattcaaaggtaccctgcagaatattgctttccccacaacttaagacatctctgcttctaaataatttgtgttaaaaccactatgggaccacagaatctagagctacgaggctgtggttatatgcggactatgccaccatccaccctacaacagtggaaagaaaaagtagatgtacaattcccatagagtttttcgtttcatggcttcacatctgacttaaaactttttttttcttttgaaaacaaaattaatataatgttaaccatataacaaaatgactcggaagattcgacgtaaccagaagcgagaaagaaacacctatagaaataacacatggtctgttcctatcaatctgaaatacagaccaaaaagaacaaacaacattataaacagaaacactaaatcatacacatacaaattgaacacgaatgagccactgaacactgacacacaaactacaaagaagccaacaaaccaggccaaatacatggcaaaagccaacaacatatggtcagacatatattattgtatactgctacacctcaagtaagggcacatcacaaaacatatactctactctaaaaatcatatatacataaacaatacaaattccatacactgcaaaactggatatagatacttcgagcaactaaatatatagaactccgcgcgaagcgcggaaaaccactagtgtttaaaaaaatagctaactagatgttttttttttcaattttgacggagtatggaaatgttttaaaacactttcattaaagtatcttacgatattcctaataaataataaaataaatacgttattaaacaatgattatgcatatctaaataatgaggataaatccctctagctaatcgaatttgaatttattaacaaactaaatcacctatcaatgtgtagtcgaatcatttcaaaggagacgacgacaaaagagagagaaaaaaaaaaagagaggaatcatttggaaggagacgtgcgaacgatcatgaataatgtgtgagagagcagttgacctcagcttgacccagagagaaaataaaaaagaaaaaagaaaaagagaaaaagaaataacttcgttggggaggcaaagctctgggaaaaagcaaaaagcaagtaagccaagccatctcaattctcactgccacactctctcaagtttcttcccttcttcaaccatgccggaccgcgaaatcggcgacgatgcttctgacactaacctctcctcttccttctcttccttcgcgtcttcctcctcctccttctcttcctcctactccgctgctggcgcttggacggatgatcactccgccaaaatggagaaagatcctagaaaaatcgccaggaggttcgatttccccactttcgcagctcgatttcacctttccgttagcttgctttcacgtttcggtttccgtacagtttcgtttatcttttagattgcaagtttgtagctgagtaaggtcatcggactagtaaattaacatgttatccaaaggaaatctgatgagatcgtctttgattgcagaagaaaaaaaacgagtttgttgttgattgtgctgagattcattggtgtggtttggttttgtgcatgaaggtatcagctggagctgtgcgagaaagcagtggaggagaacgttatcgtgtatttaggaactggttgtgggaagactcacattgctgtgatggttatatatgagcttggacctttgattctcagccctaggaagagtgtttgtatctttcttgctcccactgtggctttggttgaacaggtgagagcataaccctcttgattacgctttatggatctggttgattttggctctatgttcttactctcttgtttgtgcttttttttttctctttctcagcaagcgttagtcatagcaaagtctatcaacttcaaagttgcaacacattgtggtggcaatcggactgtgactacccattctgactgggagagagaggtttcagagaatgaggtgatctttctatccttttaaccctataagtctcattaagttgattgtttttttctctaacctttttatgtggtaactatcgttttgatcgatgagatcatcgttattggggctgtctgtttcctgcaggttctcgttatgaccccacaaatacttctgcataacttacagcactgtttcatcaggatggagtggatttcccttctaatattggatgagtgtcaccatgctcaagaacaaagcaaccatccttatgcacaaatcttgaaggtatctttctccgccttcttggtatgtggtgactgatcacatttaacatataaccaacttttaggggcttgcaaatgcaggttttctataaaacagaaggtgtaaaaggacctcgtatatttggaatgactgcatctccagtggttggcaaaggtaggccccatttctgtgatgtgaattcctgattacagttccatttctgtccaaatcattcattatcgcattatgaaatggtcaaaaattcccaataccagtcagagaaactcgtaggaagatttttttatattttttctttaccatttaaatttccctttataacggtgaaggaacatatgttccgcagaaatcctaaagcaagagatttagctcctacattgcttacctttcgtttttctctttcgatcatgaggtttatggtgaccttggtattagctgcgacctttgatcatattcgttctatacatgttcgagtgtttgacagcactacctgcttttcagggtcttttcaatcagagaatttatcgaaaagcataaatagccttgaaaatttgctcaatgccaaggtatgctggttcttaaatcccctaattttggcatgcaagatatttttgctaggcgtgattggtgatagcttatatgttaagacctgtcacactgtgttgacttgagtgataccgaagtagaaataacactcggctgggatcttctcgtcccaagattatggtgccaaacttttttttgatgcaatctaaagcaaaaatatcattctcttggttggaatcatgataatggtcttacactcagtttactttcgaacaatgttttaatatttccctttttgtgtactgatcttaaaggtttactcagtggaaagcaatgtccagctggatggttttgtttcatctcctatagtcaaagtatattattatcagacagctgggactgaagcatctcaatcgaccaacatatatgaaaacatgctggaggacatcaaacagcgggttgtctaatgtgtctcataactttttttgtcaccgtagctggatacatgaactgatattcttttcctgatatgaacagtgtttgacatcacttaagcagcagattgataaccatcaaacacaggtcctcttaaatatgaaaaagcttctgaaaagaactcatgataatctcatatatagtctggtgaatcttggcctttggggagcaatacaggtaagacatttcatactgaagctatttatagatttgatatacagttttctggttttggtttcagatgtctttatttccgaggctccttatattgagtgttgatcacttgtattacctggtttcttcaatgtttcacgaagcagcaaatgatatattttagggtgcagtaataatcacaattgccaagtaacttcaactttgcattagttgtttactagatcgaggtctaaggttacaccgactggcataagattccttactgtggattatttccgatttcccaattttataaaagttcctagagaaaaattatcggcaaggttccaagcatttttctttaatgtatgatgaccatttaacctcgatatgtaaaccttacatctagccaaaatgattctgtgttgtttcttgtttgtctcgtatgtgtctatatacatgctgtggcctcataatgtttccctcttcatttattataggctgctagaatccaactgaacactgaccgcaatgtacatcaagagcctttggaagagaataataagtcaaagatatgtattacatatctctctctggctgccgaagtcctttcttctaaagttgctaaaggtatgatggcatggtatcctagtttgtgttttctttaaaattaaaattttcttccaataatgcatatgctttttcggagttgcaacttgtgaaacttttaactatattctgcacttcattttgttattttcatgtgaatgccctgataaagaagtcattgattgcctcattatttgtttgcggtctttgtgattgtagatgagaatgcatctgaacttatcagcttaccagcgttgaaggaaccatttttctcaagaaagctattacaactgattaaaatcctttcggcattcaggttggtacttgggagaggtgacagagtcttggaatacttttgtgctgattattccaaagctattacaaatgtgctttagtttatttttttttgtaagatacgtttgagcacctagaagctagactttatagatacatgaaaaattggccataatcaatagatctatgttccgagacagaatatggcttttcctgaatagacaatttctagctcttacttcaccttcaaaagacattggatttttatatggaaatggtagttgttattgtccactagtcctgtgaaaccttgattgctttttattacatcgtgtttgattcaactgtcatgctaatgaggccattttgaaggaccacggtatattttgcagtaagcttcaatttgtatttttctttcaggatagagccacacatgaagtgtataatatttgtcaatcggattgtgactgcgaggacgctgtcatgcatactaaatagtttgaaacttctagagtcttggaagtctgatttccttgttggacttagttctggagtgaagagcatgtcaagaaagagtatgaagacaattcttgaacggttccaatccaaagaggtgatctttagccatctttgaatctatagttactattgggagatccatgtacactgtatgccttacggttcacacatataatatagaaacaaaatacaggcaaacacccgtttagacagacatgtattttctaggatcaattttcaagccacttccaactaacttctaagacttcctctttttgttccagctcaatctactggttgccactaaagttggcgaagaaggtcttgatattcagacatgctgtcttgtgatccgttttgatttgccggagactgttaccagcttcatacagtccagaggccgtgctcgaatgcccaagtctgaatacgcgtttctagtggacaggtctgtaggaatgagaaattgataaggccataattatgagatcgtttgtgctcctacgcatttacattttttcttctttcgtgattcaggggaagcgagaaagagatggatctgattgaaaattttaaagtaaatgaagatcgaatgaacctggaaattacttccagaacgtcagaggaaacttgtcctagacttgatgatgaggtatacagagttcatgagacaggagcttgtatcagtggtggaagtagcatctcccttctctataagtattgttctaggcttccacatgatgagtaaggcttccaatttttctgttggtgcttcttgtattcactttccacagtaagcaggcgtgtcataactgaatttccatttgccgccttttgttccaccagattttttcagcccaagccggagtttcaattcaaacctgttgacgagtttggtggaacgatctgtcgcataactttacctgctaatgctcctataagtgagatcgtcagttcactactaccttcgattgaagctgctaaaaagaatgcttgtctaaaggctgtctataagttgcacagcttaggtgtacttaacaattttctgttgccggattcaaatgaagaaactgaggacgagttgtcagatgaagaatttgactttgataaagttgaaggtgcgtaagtggttcagttataaatcttagttgtttatactgatcactcgttatataacggtcttttttttcttgccaggtgaagcctgttcacgaggtgaactgtatgagatgattgttcctgacttgtttaaacaaaagtgggatccatcaaagagttgtgtcaatcttcaatcttactacataaggtttgtgcctcatcccgccgataggatctacaagaagtttggtctcttcatgaagtcacctcttcccattgaggctgagactatggattttgatcttcaccttgctcatcaaagatctgtaagtgtgaagatttttccaaaaggagacgccaatttcgacaatgatgaggtattgagctttttaatttgataaaaatttaactagattgacgtttctaatttgatttatgttttatgcagataaggctagcggagcgtttccaggaggttgccctgaaaattatttttgaacggcgggagctaattacggaatttgttcccttggggctgcaagactcttttagaactagcaaatctaccttctaccttcttcttccaattaatctggatgcttcagaaagtgttttatttgttgattgggcgactattagaagctgcttgtcgtccccaatcttcaaggctccgtctggcttagtagaagatatggatcctcctgtgggatctcatttaaagcttgcaaatggctgctggagtattgatgatgtgaagaacagtgtggttttcgcaacccacaaaaagcaattttattttgtctcggatatctgccatggaagaaatggattcagtgctattagaaaatcaatcaccgaaacccatctggaaagcatatataattcgtaagctactaaactactactatttagtgattgttcgatggcatcttttctctggaggtcctgcgttctgcgttttctttgtgtcgctctagcttgattttgttacaatgttcttttcccagtttccagagaacagtataacaatccttatcactttgggtgggactgtagaattttataggatcacatgattttctgagtttaagaactttcccattttaattaacaaaaccaggtatggcgtgaaactcaagcatcctttacagccactcttgcgtttgaaaccgctttgttatgttcggaacttgcttcacaaccgaaagcgggagaatttgggtaattttcttatttgcctttttcatattacaaatttcttgtgcatgtacgcataacacaccttgtatactctaattttaccattctctcattaccaaaaaacagaaccaaatgaacttgaggaatatttcatagaaattcctccagagctttctcagttaaagataaaaggattatctaaagacattggaagttcgttatccttgctaccatcagtcatgcaccgtatggagaatttactcgtggctatcgaactgaaacacatgctgtctgcctctatccctgagatagctgaagtttctggtcacagagtataatctcatttcaattgataacccatttacttgattttcttaaaaatttgttatgtttgatcttttaccgatcgagtgaattggtataggtactcgaggcgctcacaacagagaaatgtcaggagcgcttttctcttgaaaggcatgcggtgcttggggatgcattcctcaagtttgctgttagccgacacctgtttctacaccatgataggcttgatgaaggagagttgactcggagacgctcaaatgctgtgaacaattccaacctgtttaggcttgcaaccaggagaaatttgcaggtcctcaaaacattccttagaaatctttggtggccggtacattttaaatatagtttgagctgttgctgcacagaacgcacatactgatatggtgcatagattaccaccagaacccttgcctacattgaatatattctcagttacatttgttcgaaatcaaatctcagatagaagcagactgagatgtagtaattagttaagtctagctttggattatatttaaccttggcattttcccaggtttacatccgtgatcaagcattcgatcctacacagttctttgcattgggccatccatgcagagtaacgtgtgacgaggtagcaatgaaagaggttcattccttggataaggttcctgggcttttggaatcaagtactggtgaaatcagatgtagcaaaggccatcactggttgcacaagaaaacaattgctgatgtggttgaggctcttgtcggagcattcttagttgacagtggcttcaagggggccattgaatttcttaaatggattggcataaatgttgattttgagtcattgcaagtaagagatgcttgtgttgcaagcaagcggtacatgccactgactacttgctttgatttggcggcccttgaaagcctgcttggatataagtttctccacaaaggtctacttttacaagccttcatccatccatcttacaacaggcatggaggaggctgctaccaggttatttttcttcttattatttttcatttctttttgatatccatctatggtaaccaaaattctctaatttggggtctgcagagattggagtttcttggggatgctgttctggactacttgatgacatcctattttttctcagtctttccgaaactgaaacctggtcaactgaccgatctaagatcgctctcagtaaataataaggcgcttgcaaatgttgctgtcagtttttcactacagaggtttctattttgcgattctacatatctccatgatgctataaaggattataccaacttcgtgacagcatcaccattggccagcggaccatctgaaggtccaaaatgcccaaaggtgtgtgtttggatcttccttccatatgaaggcagtattggctgcttatgttctgtatattagtgtgttttggtggaacctatgataattcgttgaagttttcttttagaacttgtcttgtttgatgtaatgtggatatatatatatatatatatatatataaagaactaatgtagttattatatttgcatgcaggttcttggtgacttgatagaatcctttttgggggctcttttcctcgactgtgggttcgacttgaatcatgtctggagaataatgctatcttttttagatccagtgaaaaacttgtctaacctgcagcttagtcctgtgaaagaactgcttgaatattgccagtcttacaagtgggatcaggagatatcagcgacaaagaaggatggtgctttctctgttgaattaaaagtgaccaagaaaagttcttgccttacagcttctgcaactggtcggaacaaaaaagagagtaccaaaaaggctgctcagctgatgcttacgaacctgaaggtagttgcggcttaactaccttctatttatgtgatgtatttctatcttatgctacctagtgttcagttttgtaacgggtttcttaacaaagtctttgggtaattcatccacaggctcatgggcatataaaaacctccaatccgttggaggatgttctgaagaatagcatccgaaatgaagctaaattgattggctacgatgaagagcctatagatgttgtggatcgtgatgggctggacgttgaaaacctaaatatccaagattcttttgaggaggatcctgtcactgaaagcaagactagtgaaacaagcagctcatacatcatcagacgagttctcaccaatgcaccaccatctgaaaaagaagaaagccttcctcaaaagaccatcaaagacgcaggtattttgatgacgaacttttgaagtaaaatgattggatattacttcctgcatctatatatcctgagttattaatttgatgactaaaactgaacaggtgggtcgatcatcaaaactgcaaaatctctcttgcgcgaaacatgtgttgccaactgttggaagacaccagagttcgtatgttgtgaggaagggccagcccacctgaaaacgtaagtaaattgatcaagtaatgcctacatctctaaactgctaggtactggatttgttgtcgtcaactatgtgcatgtttacaggttcagctataaggtaatcctggaggttgtagatgcccccaatatgacactggagtgttatggtgaagctaaaccaactaagaaaagtgcatcagaacaggctgctcaagctgctttatggtgtctcgagcatactggattccttcgccgatga

SEQ ID NO: 366 - protein, 922 aa, Brassica rapa
MDATTGNGAELESANGSGVSDALPPPPPVIPPNVEPVRVQTEVAVKKNLRVPMARPGFGSKGQKIQLLTNHFGVKVANLQGFFYHYSVALFYDDGRPVEQKGVGRKVLDKVHETYHSDLDGKQFAYDGEKTLFTFGALPSNKMDFSVVLEEVSSARTNGNASPNGNEEPSDGDRKRLRQPNRSKSFRVEISYAAKIPLQALANAMRGQESENSQEAIRVLDIILRQHAARQGCLLVRQSFFHNDPSNCEPVGGNILGCRGFHSSFRTTQGGMSLNMDVTTTMIIKPGPLVDFVIANQGAKDPFTVDWSKAKRTLKNLRIKVSPSNQEYRITGMSDKPCREQTFEYRPRNAPKNENGESETVEITVYDYFLRERNLELQYSADLPCVNVGRPKRPTYIPLEHCTLIPLQRYTKALNTFQRSALVEKSRQKPQERMNVLSKALKVSNYDAEPLLRSCGISISSNFTQVEGRVLPAPKLKMGRGDELFPRNGRWNFNNKQFVEPTKIDKWAVANFSARCNVRQLVDDLIRIGGMKGIEIAAPFDVFEEGHQFRRAPPMIRVEKMFEEIQSKLPGAPQFLLCLLPERKNCDIYGPWKKKNLTEYGIVTQCMAPVRQPNDQYLTNCLLKINAKLGGLNSMLSVERTPAFTVISKVPTIILGMDVSHGSPGQSDVPSIAAVVSSRQWPLVSKYRASVRTQPSKAEMIESLVKKNGTEDDGIIKELLVDFYTSSGKRKPEHIIIFRDGVSESQFNQVLNIELDQIIEACKLLDENWNPKFLLLVAQKNHHTKFFQPNSPDNVPPGTIIDNKICHPKNNDFYLCAHAGMIGTTRPTHYHVLYDEIHFSPDELQELVHSLSYVYQRSTTAISVVAPICYAHLAAAQLGTFMKFEDQSETSSSHGGVTAPGPVSVAQLPKLKDNVANSMFFC

SEQ ID NO: 367 - protein, 906 aa, Brassica rapa
MGSDEDKALPLPPPVLPPNLLPEVESIKKNTLLPMARRGTGSKGQRIPLLTNHFKVNFNNANGQFFHYSVAITYEDGRPVEAKGIGRKILDKVQQTYKTDLGSKYFAYDGEKTLFTVGPLPSNKLDFSVVLEDAPSSRNNTGNGSPNESNDADRKRSKRPNQSKKFMVEISYAAKIPMHAIAAALQGKETDSLQDAIRVLDVILRQSAARQGCLLVRQSFFHNDAQNFVPIGAGVVGVRGFHSSFRTTQGGLSLNIDTSTTMVVQPGPVVDFLLANQNVKDPYSVDWNKARRVLKNLRVKVAPSNREYKISGLSENRCKEQMFSRNSKNDMGEVVEHQTTVFEYFTEFRNIQLQYSGDFPCINVGKPKRPTYIPIEHCELVSLQRYTKSLTNLQRASLVEKSRQKPLERMTSLTTGLKNSNYNADLVLQESGVSIGSSFTHVEGRILQAPKLRVGNGEDFQPRNGRWNFNNKKLVEPTTVTRWAVVNFSARCDTNRLIPDLIRCGNMKGINVEPPYEVVFQENAQFRSAPPHIRVEKMFEQIQSKLPGKPKFLLCILAERKNSNVYGPWKKKNLAELGIVTQCIAPTARINDQYLTNVLLKINAKLGGLNSLLTMERSQAMPSVTQVPTIIVGMDVSHGSPGQSDVPSVAAVVSSRQWPLISKYRACVRTQSRKVEMIDNLFKLVPGKEEKMVDEGIFRELLVDFYSSSQKRKPDHIIIFRDGVSESQFNQVLNIELDQMMQACKFLDEKLNPKFTVIIAQKNHHTKFFQDKGPDNVPPGTIIDSKICHPRNNDFYLCAHAGMIGTTRPTHYHVLYDEINFTTDDLQELVHSLSYVYQRSTTAISVVAPICYAHLAAAQMGTVMKFEDLSLSETSSSHGGITTPGAVPVPPMPKLNPEVASSMFFC

SEQ ID NO: 368 - protein, 930 aa, Brassica rapa
MDSHEAKRLPPPPPVVPPNLVPEREPIKKTTLLPMARRGIGSEGVRTPLLTNHFRVNFNNANGHFYHYSVTITYEDGSPMEAIGVFRKILEKVQETYRTDLGSKYFAYDGHKNLFTIGALPSNKMDFLVVLENTPSSRNNTGNASPNDADRKRSRLPHRSKKFMVEISYAARIPMQAIASAIRGKETDNIQDATRVLDVILHQNAARQGCLLVRQSFFHNDARNYINIGGGVFGARGFHTSFRTTQRGLSLNIDTSTTMVVQPGPVIDFLLANQNVNDPKYLDWNNARRALKNLRVKVVPSNRECKITGLSEERCKYQMFTMNSKNEKGDVQITVYNYFTEIRGLKLRYSGDFPCINVGKANRPNYIPIEHCELVSLQRYTKSLSSFQKASLVENSRQSPPERMASLTNSMKKSNYNADLVLQESGVSIGSSFIQVEGRVLPAPRLRIGNGEEFQPRNGRWNFNKKKLVEPVTVTRWVVVNFSAECDTDRIISDLIRCGQMKGMNVEPPYKVVFQEDPNYRGAPANIRVEKMFEQIQSELRKEGKPKFILCILAEKKNSLVYGPWKKKNLIEHGIVTQCIAPPKNVKDQYITNVLLKINAKLGGLNSLLAMERSRAMMHLVTQVPTFIVGMDVSHGSPNQADIPSIAAVVGSREWPLISKYRACVRTQSRKMEMIDNLFKLVPNEKGKLVDEGIFWFDYSRVVFIACGSGFCHINEKLYALFRELLFDFYTSSGKRRPEHIIIFRDGVSDSQFNQVLNIELDQIMQACKFVEENWEPKFTVIIAQKNHHTKFFQDRGTENVLPGTIVDSRICHPHNNDFYLCAHAGLIGTTRPTHYHVLYDEIRFSTDDLQELVHSLSYVYQRSTTAISVVAPICYAHLAAAQMGTVMKFEDMSLSERSSIHDGITRSGEPPVPPMPMLNSDVASSMFFC

SEQ ID NO: 369 - protein, 1701 aa, Brassica rapa
MDPNKSTHLQMARSGNGSRGQKIDLLTNHFGVNFTTSKSQHFFQYSVAITYEDGNPVEAKGIGRKILAKVQETYQTDLGSKHFAYDGDKILFTVGPLPNNKLDFSVVLEDMSCTRSNTSTSDANTKRLRPHNQSKRFNVAISFAAKISMQAIQGALQGKETNDLQDAVRVLDVILRQNAATKGCLLVRQSFFHNDAKYFSNNHGGFHLCRGFHSSFRATQGGLSLNIDVSSTLIVSPGPVIDFLVLNQEVRDPSSIDWKKAERTLKNLRVKVDPSNREYKITGLTRLPCRDQTFLWKKKQGNGETKEVEVTVYDYFTKHLEIELRHSGGLPCISVGKPKRPTYFPIEQCHLVSLQRYTKAPTIFQRSKLVKESVQKPQEKMNVLNNAIKDSGYNNDPMLQDCGVRIDSDFTQVEGRVLPTPRLKVGNGEEFQPRDGRWNFNNKKLVEPATVTRWAVVNFSARCDTKRLISDLIRCGRMKGINVDPPYKVVFQEDPNYRGAPANIRVEKMFEQMQSELRKEGIEGKPKFILCILAEKKNSLVYGPWKRRNLVEEGIVTQCIAPTPKINDQYLTNVLLKINAKMMPLVTQVPTFIVGMDVSHGSPGQSDIPSIAAVVGSREWPLISKYRACVRTQSRKVEMIDNLFKPVTNEKGKQVDEGIFWELLFDFYISSGKKRPEHIIIFRDGVSESQFNQVLSIELDQMMQACKFVEENWEPKFTVIIAQKNHHTKFFRAEGPGNVPPGTIIDSRICHPRNNDFYLCAHAGLIGTTRPTHYHVLYDEIGFSTDDLQELVHSLSYVYQRSTTAISVGAPVMYAHLADAQMSTAVKFEDSSETSSRHGGITTSEAELVPPMPKLNANVASSIEGCCGGGDGKTEMILTEEALRKVLGISKAASSGTRIAAGSAWEDIRGPDPLPLFFRDVIESWRLWLGAGPDRRPMSSHIVGYPRIGPKRELKFALESFWDGKTGAEDLQNVAADLRRSIWKHMAGVGNKYIPSNTFSYYDQMLDTTAMLGAVPSRYGWESGEVGFDVYFSMARGNDSVPAMEMTKWFDTNYHYIVPELGPHVKFSYASHKAVEEFKEAKALGIDTVPVLIGPMTYLLLSKPAKDVDKSFCLLSLIDKILPVYKEVLTDLKSAGARWIQFDEPILVMDLDTNQLQAFSDAYSHMESSLAGLNVLIATYFADVPAEAYKALTSLKCVTGFGFDLVRGLETLDLIKVDFPRGKLLFAGVVDGRNIWANDLSASLKTLQTLEDIVGKEKVVVSTSCSLLHTAVDLVNEIKLDKELKSWLAFAAQKVVEVNALARSFSGVKDEALFASNSMRQASRRSSPRVTNATIQHNVAAVIKSDHRRSTKVSARLQAQQKKLNLPPLPTTTIGSFPQTPDLRRIRKEFKARKISEIDYVQAIKVEFEKVVKLQEELGIDVLVHGEAERNDMVEFFGEQLSGFAFTSNGWVQSYGSRCVKPPIIYGDVSRPKAMTVFWSSMAQKMTKRPMKGMLTGPVTILNWSFVRNDQPRYETCFQIALAIKDEVKDLEKAGITVIQIDEAALREGLPLRRSEQELYLDWAVHAFRITNCDVRDTTQIHTHMCYSNFNDIINSIINMDADVITIENSRSDEKLLSVFHEGVKYGAGIGPGVYDIHSPRIPSAEEIAERINKMLAVLDSKVLWVNPDCGLKTRKYSEVKSALSNMVAAAKLIRSQLNKS

SEQ ID NO: 370 - protein, 911 aa, Brassica rapa
MGCDKGKGLPPPPPVVPSNLVPELEPIKKNTLLPMARRGSGTKGVKTHLLTNHFRVNFNNSNGHFFHYSVAITYEDGRPVEAKGIGRKILEKVQETYRTDLGSKYFAYDGEKTLFTVGALPSNKLDFSVVLEDTSSSRNNTGNASPNESNDADRKRSRRPNRSKKFMVEISYAARIPMQAIASALQGKETDYLQDAIRVLDVILRQSAARQGCLLVRQSFFHNDVQNFVHIGGGVTGVRGFHSSFRTTQGGLSLNIDTSTTMVVQPGHVVDFLLVNQNVKDPKYLDWNKARRALKNLRVQVAPSNREYKITGLSEERCQDQMFTRNSKNEKGEVEEVQTTVYKYFTEFRGIPLRYSGDFPCINVGKPKRPTFIPIEHCELVSLQRYTKSLNSLQRASLVEKSRQRPPERMASLTNGLKKSNYNADLVLQESGVSIGSSFTQVEGRVLPAPRLKVGNGEEFQPRDGRWNFNYKKLVEPVTVTKWAVVNFSARCDTNRLISDLIRCGRMKGINVEAPYKVVFQEDPNYRGAPANIRVEKMFEQMQSELRKGKEGRPKFILCILAEKKNSLVYGPWKRRNLVEEGIVTQCIAPTPKINDQYLTNVLLKINAKLGGLNSLLAMERSRAMMPLVTQVPTFIVGMDVSHGSPGQSDIPSFAAVVGSIEWPLISKYRACVRTQSRKVEMIDNLFKPATNEKGEPVDDGIFSELLWDFYLSSKKRKPEHIIIFRDGVSESQFNQVLNIELDQMMQACKFVEENWEPKFTVIIAQKNHHTKFFQAEGPGNVPPGTIIDSKICHPRNNDFYLCAHNGMIGTTRPTHYHVLYDEIGFSTDDLQELVHSLSYVYQRSTTAISVVAPVCYAHLAAAQMGTVMKFEDMSLSETSLTHGGITIPGAVPVPPMPKLNVNVASSMFFC

SEQ ID NO: 371 - protein, 867 aa, Brassica rapa
MPVTPEEPSRRDYAVTARLGVGSTGRRIQLCTNHFNVSVGQPDVVFYQYTVSITTEDGENVQGKGIGRKLIDQLYKTYSSDLDGKRLAFDGEKTLYTVGPLPQNDFDFQVILEASFSKRDCGVSDGGSPSGSSKRSKRSFLPRSYRVQIHFSAKIPLRSVLATQRGVDTSDNSTQDAVRVLDIVLRQQAAERGCLLVRQAFFLNDVNSVDVGGGVIGIRGFHSSFRPTDGGLSLNIDVSTTMILKPGPVIEFLKANQNVELPRQIDWIKASKVLKNLRVKASHRNMEFKIIGLSAKPCNQQLFTMKIKDGECEGQTKEITVYEYFKQTYTEPTYSAYLPCLDVGKPDRPNYLPLEFCNLVSLQRYTKALSVRQRALLVEKSRQKPLERIKALNDAMHTYCYDKDPFLAGSGISIEKQMTLAEGRVLNPPTLKFGKNEDFLPSNGRWNFNKKMLIEPRAIKNWAVVNFSFPCDSSHISRELISCGMRKGIEIDRPFALVEEEPQSKNLSAVKRVEKMIAKMKSKFPIDPPHFILCVLPERKNSDIYGPWKKVCLTEAGINTQCICPTKINDQYLTNVLLKINSKLGGINSLLGMECSSNIPLINKIPTLILGMDVSHGSPGRADVPSIAAVVGSKNWPLISRYRAAVRTQSPKMEMIDSLFQPVEDPVNGDNGIMNELFVEFFKTSNARKPKQIIIFRDGVSESQFNQVLNIEVDQIIKAYQRLGETDVPKFTVIVAQKRHHTKLFQAKGHENVPAGTVVDTKIVHPTNYDFYMCAHAGIIGTSRPAHYHVLLDEIGFSPDELQNLIHSLSYVNQRSTTATSIVAPVRYAHLAAAQFAQFTKFEDISEEKVPELPRLHERVESNMFFC

SEQ ID NO: 372 - protein, 741 aa, Brassica rapa
MSYLLPHLHSGWSIDQAILAEEERLVVIRFGHDWDETCIQIDEVFCSLPCTNINSLLTLPHLPLPILLPNLPLPHIDMDRDYSYNESSDNESSTCESAKGNRLLYSLPPRPGFGTNVRIIPLVSNHFQVTLANLPEYFYRYRVVNFVHNGGRSPIDQKGIGIELIDLVHRVYDSDFVGIEFIYDGDHMVFTLGSLPDRHNDFPAVLGMNSSTMTNPLKSVEVSFNAARNLEIPLQSLVNAMHGQESPNSLEAIRVFDIILHQHAARQGSLRVRRSFFHNESREPIGPNILGYRGFHSSFRTTQGGMSLNMDVKTTTVIKPGPLIDFLIADQGARDVFDVDWNINYLLTLPHLPLPILLPHLPLPHIDMDMDYSYNEASDNESSTCESAKGNRLLYSLPPHPGFGTNGRIIPLVSIHFQVTLANLPEYFYRYRVNFVHNVGCSPIDQKGLGGELIDLVHRVYDSDFVGIEFIYDGDHMVFTLGSLPDRHNDFPAVLGMNFSTMTNPLKSVEVSFNAARNLEIPLQSLVNAMRGQESPNSLEAIRVLDIILHQHAARQGSLRVRRSFFHNESREPIDPNILGCRGFHSSFRTTQGGMSLNMDAKTTTVIKPGPLSDFLIADQGARDVFDVDWSKIRARNGLKWLLRDDVVPSTHLHSGWAVDQAILTEEERLVVIRFGPDWDETCMQEQRHYDRSRDGYNNKINWAMKDKHEFIDIIETVFRGARKGRRLVIAPKDYSTKYRY

SEQ ID NO: 373 - protein, 805 aa, Brassica rapa
MAPKRKVPSTEVEISGPTSTRPKISPKAPVEVAAEPIRSRPKFKVELVVDSKKDPSWVLDEPIADSEARTTWPERYQVIQKKEVVPLPKKKKKKYVEEEEIFLARRHFRRAILDDSITYNLYDDAHVQSEEDEKPFICKIAEIFEGCDGKMYFTAQWFYRACDTVIQKHEEMIDDKRVFISDIKDVNSMGVLLNKLKILMIPLTENTEVTESCDYYCNMKYHLPFSTLEALQSSQCITPNQRTDATMLDLYCGCGAMSTGLCMGAQLSGLNLVTKWAVDTCEYAVQSIKYNHPETEVRNESAEDFLYLLKEWEKLCIHFSLIESADSEKYENLYGMSAVEEVKDGSDESDVKDGGEVFEVEKIVGIKKEEGGRLHLKVRWENYGPSHDTWEPIENLSNCRKKIKEFVVHGFKTSILPLPGGVDVVCGGPPCQGISGYNRFRNEKEPLKDKKNEQLLEYMKIVEFLKPKYVLMENVVDMLRFVDGFLARYAVGRLVQMNYQTRMGMMAAGSYGLAQFRRRFFLWGAMSSETLPQFPLPTHDAVNRGHVPVNFHSNVVAYEETDNVKLADKILLSDVLTDLPVVANNERRAEMPYDKDPKTPFQKFIRLTQEGMLASPKDPKSNSKNEVLYDHHPLNLNKDDYQRVCRIPKKKQANFRDLPGVTVNANNKVEWDPKIPRIYLESNHPLIPEYAMKFVEGKSKKPFGRLWWDETVPTVIGRAEPHNHVIIHPNQDRVLTVRENARLQGFPDYYRLFGPTKKKYTQVGNAVAVPVARALGYALGQAFQGLTNGSDPLFTLPEGFPKPTF

SEQ ID NO: 374 - protein, 1447 aa, Brassica rapa
MEGDEPRGGGSDSLSVKRKFYEIDEDSSPMNGSSELYEVAQTRNTIALLETGVDKFGHCCEIRAHLNLKVEDYYGAKGVDKWTSHRWEEELFKNEANALRGGFLKVEMVRLLVIDECHRTTGNHPYAMIMKIFNPQGQKGVDKFVTKVKEGPVFYDPAPLCRLELKDKLRTSHLKFDASLLSLLQELEKGNCQDVEENKFKAYQKRLSADYHDILHCLDSLGLICAHLAAEICLEKISETETYNECSMVCKEFLSDVLSTLGLFLQKEEKNSVDLPQDNPSAVISGLVSPKLQELFHLLDSLRGEMQKPCLIIVERIITAEVIERYVKKQASLGYLYVLSLIGNNASTQALAQKMQDSFHVGKVNLVFITDVVEEGFHMPDCSCMVCFDLPKTVCSYSQSQELAKQSNSKSIMFLERGNPSQRDHLYDLMRRQVPKETPNQANCQDLKENGATVHDEPAPKEQSANKRLRQLQVLDKNLLQCSAKEKAPSSKSKSSASAAGSKKRKELHGTTRANALSGIWGENLDGAIFQAYKLDFWSNISGDAYSSFSLLIESTLADDVGNVEMSLYLVRKYIKASVSHCGQIRLSHEEIVKAKCFQQFFFNGMFGKLFVGSKSLGTKREFLLQTDTSSLWHPSFMFLMLPVETGDLVSSATVDWSAINSCACVVDFLKKNPLLELQVGEENHCNTSSGQEGTQKKETETNLIHFANALSDKNSIEEIVVIAIHTGRIYSIVEAVKDSSAMSPFEDEASLEYATYAEYFNKKYGIVLAHPNQPLLKLKQSHHAHNLLVNFSDEVIEKKEPNVSNVRKTKPNIHAHLPPELLVRIDVPRSVTKSIYLLPSVMHRLESLMLASQLREEIDCSIDNFSISSTSVLEALTTLTSAEAFSMERLELLGDSVLKYVVSCSLYLKYPNKDEGQLSRERQSIISNSNLHRLATDRKLQGYIRNGAFEPRRWTAPGQCSLFPVPCKCGIDSREVPLEPRFFTENMTIKIGKSCDMGHRWTVSKSVSDCAEALIGAYYVSGGLTAALHMMKWLGFDVEFDRELVNEAINRVSLRCYIPKDDELTELETKIRREFSSKFLLKEAITHSSVHESYSYERLEFLGDSVLDFLITRHLFNTYEKTGPGEMTDLRSACVNNENFAQVAVKNNLHTHLQRCATVLETQIKEYLMSFSEPDETGRTIPSMQGPKALGDVVESIAGALLIDTRLDLEEVWRVFEPLLSPLVTPDKLQLPPYRELNELCDSLGYFFRVKCANDGVKAQATIQLQLDDVLLTGDGSEQTNKLALGKAASHLLKQLEMRNISRKTGNGDDQSSMDIKLACNLSDRETPSSDSVEMQGTVVPVIGPINMKKGGPRGTLHEFCKKHLWPMPTFDTLEDKSRTPFEFTDGNEKRTSFSSFISTITLRIPNREAVMYSGEARPDKKSSFDSAVVELLYELERRMILTIKK

SEQ ID NO: 375 - protein, 445 aa, Brassica rapa
MEENLHRVSRSPDVGTHNQNDSVAEDNRRRRHYNHHTHGVQAKDSADWNAVDDLDFEILNFHSSPSNADDDMDFEIVNFHSSPSSPSPVVTNDEPLRLPIPMLGLGVPNEQLFVTQRSLPELARGPPYFYYENVVLAPWETISRHLYDVAPEFVDSSFICAAARERGYVHNLPISNRYLIQPPPKHTIQEVLPLTKNWWPTWDTRTKLNCIFTVNASSQLTNRIRSALEASRGEPPEEIKRYVIEQCKKWNLIWVGQNKAVPLEVNEIETLMGFPIYHTRGGGGISRAERLKSLSNSFQVDTLAYHLSVLKPLFPDGINVLSLFTGIGGGEMALHRLQIPMKTVVSVEFSQANKYILRDFWERTNQKGVLIEFEDVQDLTKDIIVELMKQFGGFDIVIGGSPCNNLAGGNRVTPNGLEGEQSLMFYEYCRVLNVVRQTAKEMRRS

SEQ ID NO: 376 - protein, 333 aa, Brassica rapa
MFATLVDMGFSDDVIDRAIQENVCPCLSVFSHLLYDYVVKMNCEPSSSKSKTIDHFLAMGFDEEKIIKAIHKHGEENMEEIANALLSSEADTLPIMKEEDNMDWSDSDDEMKYADLLSSDNEKDQDSFDSCNPLSSLVKMGFSELEASLAIERCGDSVSIADLADFICAAHIAREFDEFYIDPEEQKVDTVAYHLSVLTPLFPDGINVLSLFTGIGGGEVALHRLKIPMKTVISLEISEVNRNILRDFWEQTNQRGVLIEFEDVQDLARDKIIELMKRFGGFDLVIGGSPCNNLAGGNRVSRSGLEGEQSSLFFEFCRILEVVRETTMEMRRS

SEQ ID NO: 377 - protein, 601 aa, Brassica rapa
MAQDSADWNSDDDLDLQIDNYQSSPPSSPPAAVPSSDELFATLVDMGFSPENIARAIDEYGPNADTVVIIDAISKYTVTCEASSSKSKTIDHFLAMGFEEEKVIKAIHEHGEDNIEEIANALISSAAEVSPKIKEEEDIEWSESDDEKYANFLSSDDEKVSDSSSENGNQLRSLMNMGFSELEASLAIERCGTGEDVSIADLADFICAAQIAREFDEFHADPEEQKPNVKKRRIEPRREPRSSAADDEPLRLPNPMIGFGVPNEPGLITQRSLPAMARMPPFFYYENVALAPKGVWDTISSHLYDVPPEFVDSKYICAAARKRGYVHNLPISGRYQVQPPPKYTISEAFPLTKKWWPEWDKRTKLNCILTVNASAQLTNRIRLALEPYGGEPPESKKKYVIEQCKKWNLVWVGKNKAAPLEPDEMETLLGFPKNHTRGGGMSRTERLKSLGNSFQVDTVAYHLSVLKPLFPYGINVLSLFTGIGGGEVALHRLQIPMKTVVSVEISAVNRNILKDFWEQTNQKGTLIEFADVQDLSNEKIVELMKQFGGFDLVIGGSPCNNLAGGNRVSRSGLEGDQSCLFYEYCRILDVVRETTKTMRRS

SEQ ID NO: 378 - protein, 639 aa, Brassica rapa
MVMKSNNMTDYENNLYKKLKSGKLEVRVSYRTFLCPYCPKQKVGLYIDILQHASGVGNSSSKKRSLTEKACHRALAKYLRKDLADYATATVSRRSKALASLTGDIPLAYDDQFEKLVWPWKGILVNIPTKMGHDGLCCTGESGPQLKDELIRRGFNPIRVRTVSVWDCFGHSGTRIVEFNRHWNGLNDALLFKKAYQEDGHGKKDWLSSGGGAADSSLYAWLANADDYYRANYVGEYLRKMGDLKSVSRFAEEEARKDHKLVQRLNLISENIQSQLRMLEEKFSKTSIALKCETEEKDKILHGYNQDLTGRQQRSTDHFNRIFADHEKQKAQLESQMKELQIRESVLAKRDAENETQRKNVAKELEQSAAKYSYVQLVAVEQQKTREKVKKMAVDHKMQKEKLRERITALERELGQKQDLELVVEHLKRQLSVMRHMELDGGTEIVNKVETYLRDLSEKEGELAHVNKFNQDLVVRERKTNDELQEARRALISNLRDMRSHIGVRRMGELDTKPFMEAMRRKYCQEDLEDWAVEIIQLWEEYLKDPDWHPFKRIKLDAAETIVEVIDEEDEKLRTLKIELGDDAYQAVANALQEINEYNPSGRYVSSELWNFREERKATLEEGVTCLLEQWNQAKRHKP

SEQ ID NO: 379 - protein, 541 aa, Brassica rapa
MEKQEFSVGDSSGETKKSECTEEKFVWPWVGLVANIQTEVDKTGRRVGRSGSTFRDELIEKGFDPTRVQPIWNFKGHSGFALVEFTRDIKGFENAMNFERSYKSDGHGKKDWEKGVHLRDDKPYGWVAREEDYNRGGIVGKNVKKKRDLKTLSQLQEEEERKMVQLVESMSQSIEMKIISKQELEHKVDETSRVLESVELHNYQLNETYKQEVEKMHTNLQGLYQQILAGHDKSMSDLETEREKLENRARQIYINEAEMEKSRLEIEMNQKAMMEQNEANMEAMKLAEKHQAKKEKLHEKIMEMEAKLNETQELELEIEKLKGSTNVMKHMAGSDGDGELMEKMVKTQMELEARETALHDKIMAVTQKERMANDEYQEARKEMIQFWKENEDLVSGEEIRVKTMGHLDTKPFVVAVKKKLRCSEARAGLKAMELCSFWEGQIGNVHWHPFKVDESDGIAKLVVDKNDLKLVRLKSDYGEELYNEVVRAKVEIVEYNPSGGYVVSEMWNLEKNRKATMEEGTDVMLKMRKKLVAMKNKRKRR

SEQ ID NO: 380 - protein, 643 aa, Brassica rapa
MGSTVVLSSDEEDSDMSESEMEAHADKIYPTLKSGKLKVKLSPQAFKCPYCPNKKKPSFQYKDLLQHASGVGNSNSEKRTSKDKASHLALVKYLQQDLSDSAAAEPSSKRQKTGDPIQDCDQDEKLVCPWKGVVVNIPTRKTQDGRSAGESGSKLRDEYIQRGFNPTRVRPLWNHWGFSGTAIVDFNRDWNGLHNALLFDKAYQVDGHGKKDWLKKHGPPKTGLYAWIARADDYNGSTLIGEDLRKKGDLKTIAEVTEEEARKQQKLVQNLTQLVEEKKKGVKEFEELCSVKSKELKERLEEKEKSLQKHNRELNAIQERTMGHVNKIFADHERLKMKLELEKKKLELKGIELAKREAHNETERKNLSEDLQQNASKNSSLELASMEQQKADEEVKKLAEYQRRQKEELHEKIIRLERQRDQKQAIELEIEQLKGELNVKKHMGSDGDAEIVKEVEEIYKGLTEKEEELADLDKFNQTLILRERRTNDELQEARKELVNIMKEWKLSIGVKRMGELVTKPFMDALQQKYCQQDVEDRAIDVLQLWEDYLKDPDWHPFKRIKLENQEREVEVIDERDEKLKELKDDLGDGPYNAVTRALLEINEYNPSGRYITTELWNLKEDRKATLEEGVTCLLDQWDKSKRR

SEQ ID NO: 381 - protein, 645 aa, Brassica rapa
MGSTVILSSDEEDSDISDSEMEEYGDKIYLSLKSGKLKVKLSPHSFTCPYCPNKKKPSFQYKDLLQHASGVGNSNSDKRTAKEKASHLALAKYLQQDLADDSQAEPSSKRRKTGDPIQDCDQDEKLVCPWKGVVVNIPTTKTENGRTAGESGSKLRDEYIQRGFNPTRVRTLWNHWGFSGTAIVEFNKDWNGLHNALLFDKAYLVDGHGKKDWLRKDGPPKSGLYAWIARADDYNGNNIIGEDLRKKGDLKTIAEVTEEEARKQQKLVQNLTQLVEEKKKGVKEIEELHSAKSKELKEKLEEKEKSLQKHNSELNAIQERTMGHVNKIFADHERLKMQLELEKKKLEIKGVELAKREAHNETERKNLAEDLQENASKNSSLELASMEQQKADEEVKKLAENQRRQKEELHEKIIRLERQRDQKQMIELEIERLKGELNVKKHMGSDGDAEIVKEVENIYKGLTEKEEELADLDKFNQTLILRERRTNDELQEARKELIMKEWKQNIGVKRMGELVTKPFMDALQQKYCQQDVEDRAIDVLQLWEDYLKDPDWHPFKRIKLENQEREVEVIDDRDEKLRELKEDLGDGPYNAVTRALLEINEYNPSGRYITTELWNLKEDRKATLEEGVTCLLDEWEKAKRKRGMA

SEQ ID NO: 382 - protein, 727 aa, Brassica rapa
MYSRRELDDLEYRYYSEMKDGTRKVKISDSLFRCPFCYLDRKRDYNFDDLLRHAYNISGSSRTKDGREIARHLALERYMKKYLRPLERPSSDVSSLHTEVLTGSWITAGSSSSAAGEVNSSVVKSSSPCIAEAEPMSVSGGDDPVPSGEERQMFSPKHNSSLSNQDNTHPSKRACLTAGGKEGEEPVQQSGLSHGAPRYPQRRDPLAARNDGLMFVHPWKGILANISRTFSEKTRKFTGESGSKIREEFVSKGFNPHKVEPLWNGRVGFTGFAIVYFGKDWEAYRNATMFEKHFEVNQCGKRDYDSARDRGEELYGWIAKREDYYSRTVVGDHLRKQGDLVTVSGKEAEQQRRAFTLVSNLENTLETKSTNLEEIESKYKETSTELQRSMKEKDEMINAHNEKMSSMQQKARDYLASVKNEHEKAAQHLEAQRKEFEERERYLDKCQTLNKTERRKLQWQKQKNLMATEEQNKTDEEMTRVAKQQQREKDELRERVKKLEKKLDDELALELEIERMRGGLQVMGHMEDPDMKEEIEKTKEKLKEKEEESEFQESLYQALVVKHGYTNDELQDARKAFIRSMQELTLRGQISVKRMGALDEKPFQKLTKERYPAEEADVEAAKLCSLWDNHLRDSAWHPIKVVLIDGNHKEVLNEEDEKLQELKKELGDEVFEAVTQALMERNEYNGSGRYIVPGLWNFKEGRKATLKEGVVYLMKLWTHLKPKPKRK

SEQ ID NO: 383 - protein, 1032 aa, Brassica rapa
MDDGNSWMIEYDSSMVSISIHTDVAWYRLGKPSTQYPPWREPTLKTARVAKSIISLLVKQARMARLSFRDVIKKVSEFQKNDNKAYISSDPSAVERYLVLHGQVILQIFAKHPIKELKKCAFITGLASKMEEIHHTKWAIKKRRKILPTKPKNKILPKKPKSKLRIGKGYVASKRSAMQATKTHLVDRIWGQYYSEYGAIGAENGKEKVQEERKNEEEDDVEEPSVLETRWEGDILGRTSAGEPLYQQALVGGEVVAVGGAVLLEVNETSVIYFVEYMFESSDHCKMLHGRHLERGSETVLGNTANERELFLTNACMTVQLKDIKGTVSFEIRSRPWGHQYRKENNAADKLDRARAEERKAQHLPAEYFCKCLYSPVRGGFFSLQPNNISSGTGSCSPCKIREEEKERSKPKLNATMTGFFFNGVDYCMEDYAYVNPKFIYKPKKDKKFERNVDLKSFVVCQLLEVVLPKVSSLNGLFEVIVRRFYRPEDTPLEKAYSSNIQEVYYSEDVHILPPGAFEGKCEVRKKHDMPLRNDYLTLDNIFFCEMPVHIKPKFSTIKDDTLLRKQKGKGIEGETDYDELPKEMRLATLDIFSGCGGLSKGLEQSGVSETKWAIEYEEPAGQAFKQNHPESTVFVNNCNVILRAIMEKCGDKDECLSTTEANELAAKLDEEQKLALPLPGQVDFISGGPPCQGFSGMNRFQEGSWSKVQREMILAFLSFAEYFRPRYFLLENVRNFVSFNGGQTFKLTLASLLEMGYQVRFGVLEAGAYGVAQSRKRAFIWAAAPGEVLPEWPEPMHVFGTPELKIKLSKRSHYAAVRSTQYGAPFRSITVRDTINDLPPIKNGESETNREYGADPVSWFQKKIRGDMLVLTDHICKEMDETNLIRCENIPKTPGADWRDLKNLKKKKIKLSSGKMVDMIPAWLRNKAKTHNGWKGLFGRLDMEGSFATSITDPRPMGMVGMCFHPEQDRIISVRECARSQGFPDSYKFVGGILDKHRQIGNAVPPPLAFALGRKLKEAVLLKKPPLQQKP

SEQ ID NO: 384 - protein, 1528 aa, Brassica rapa
MVRNGTKAGEQKKRPLPEIKSDSDGEDLSTRHTRPKRAAACTNFKEKSVRISEKSTTVETKQHQTVEDEVVALHFTASPQGGGDEPRQTRRLTDFILHDEYGVPQPVAMVEIGDIFVTGVILPSGECDDKEKGKGVKCDGFGRVENWSISGYDDGYPVVWFSTELADYDCGKPATSYKKMYDYFYQKAFASVEVYKRVAKSAGGDSGVSLDELLVAVSRSMSLESKCFSTDFLVIRNFLIRQGEFIYNQLAGLDETAKKDEASFAEIPVLVALRDENSRLDNGAVIQMEGRPSNGVLRIDGVSEAAKCEALTSDQEMVDEDQRYARIMQDEEDRKTMQRPKRKNGAALASNKGYVKTTEDEIAGDYPLPAYYKNFKDEADELIVADDYEVNYEDLPRRMLHNWALYNSDSRFISLELLPMKPCADIDVTIFGSGLMAEDGGFWFGLDDPDTSTSGQPKKDLEGMPVFLSQIKEWMIEWGCSTISISIRTDVAWYRLGKPSKQYAPWFEPVLKTARVTIGIFGLLEEQTRMSKLSFEDVTKRVSEFQKNDKAFISSDRLAVNRFLVGHGQIILQMFSEFPKKDIQRCSFVSDLARKRAERHNTRWTIKKKKILFKVNCNPRAGMAPVVSKRKAMQATTTRLINRIWGEFYSNYSPEEPVQAVGAENEEEEVEEEGEIEEDDAEETVPEPVEEVEKSHTPLKKIRGVSGKTESSWSGESLGKTSAGEPLYRQALVGEEIVAVGGAVVLEDDGNEVIYFVEYMFEKSNNCKMLHGRLLQRGCDTVLGNAANERELFLTNECKTVSLKEIKGTVSFEIRSRPWGHQFRKENTTADKLDRARAEERKTKDLPTEYFCKSLYSPERGGFFSLPLNDMGCASGTCSSCRIREDEEKKTEIKLNSSKTGFSCNGVDYSVDDYVYVKPEDIDGSKEANGRFKSGRNIGLRPFVVCQILEIIVLKESRKASFEVKVRRLYRPEDVSDEKAYASDIQELYYSEDTDVLQPEALEGRCEVRKKIDMPSRREYPISDNIFFCEQIYDPSKGSLKQLPVNIKPKYTTVKDEALLRKRKGKGLVTETDSVTDKPEEVSKETRLATLDIFAGCGGLSQGLEQAGVSATKWAIEYEEPAGKAFRKNHPETTVFVDNCNVILRAIMEKCGDQDECISTKEANELAEKLDEDQKRTLPLPGQVDFINGGPPCQGFSGMNRFNQSSWSKVQCEMILAFLSFADYFRPRYFLLENVRTFVSFNKGQTFQLTLASLLEMGYQVRFGILEAGAYGVSQSRKRAFIWAAAPDEVLPEWPEPMHVFGVPELKISLSKGVHYAAVRSTQYGAPFRPITVRDTIGDLPSVVNGESNTKREYKAQPISWFQKEIRGDNIALTDHICKEMNELNLIRCKKIPKRPGADWRDLPEEKVTLSKGQVVDLIPWCLPNTAKRHNQWKGLFGRLDWEGNFPTSITDPQPMGKVGMCFHPDQDRIITVRECARSQGFPDSYVFQGNIIHKHRQIGNAVPPPLAFALGRKLKEAVQLKKVTKTN

SEQ ID NO: 385 - protein, 1520 aa, Brassica rapa
MVRNGSKAAKQKKRSLPESKETDHDDDLSTRKTRPKRAAACTNFKEKSIRISEKSATVAAKHHQTVDDEIVALHLTASSPQSGGGHEPHQTRRLTDFVLHDTDGVSQAVEMVEHVDMFITGVILPTGECSDKERAKGVRCEGFGRVDNWSISGYEDGSPVVWVTTSLADYECVKPATTYKKVYDYFFQKAYASVEVYKKVANSDLMSLDELLVAVARAMSLETKCFSSDYLAIKNFVISQGEFIYNQLAGLDDTAKKDDARFVEIPVLVALRDASSSSILEYDAGQPSNGVLRIDGAAERKAMSSDQHMVDEDEKFARLVQDEEYMKSMQRPRKSSSSASVSKNGYIMTTEDEIANDYPLPAHYKNSQVETDELLLYHDDDYEVDIDDLPRKMLQNWALYDIDSRLISLELLPMKTCADIDVTIFGSGVMADDQGIWIDLDDPATSMPSEEHGGIPIFLSQIKEWMIEYGVSTVSVSIRTDAAWYRLGKPSKQYAPWFEPILKTARVAVGVFALLEEQTRMAKLSFEDVVRRVCEFESNHKAYISSDRAAVDRYVVGHGQIILQMFSEFPNKEIRRCAFITGLANKRAEKHNTRWTIKKKKILLKVNLNRRAGVAPVSKRKAMQATTTRLINRIWGEFYSIYSPEEPLQAVGAEEEAEEDEEEDEEENEDDDAEETEPEAAEVEEAHTLPKKIVGKCGKMETRWDGESVGRTSAGEPLYRQALLEGERVAVGGAVIAEVSGSQAIYFVEYMFESSDHCKMLHGRLLQRGSETVLENAANERELFLTNKCMTVQFKDVKGTVCFEIRTRPWGHQFRKEDAVADKLDRARAEERKAKDLPTEYFCKSLYSPERGGFFSLPLSDMGCASGSCTSCRLREDEVQRKKIKLNASKTGFSSYGIDYCADDFVYVYPDCIDGSKKANGKFKPGRNIGLRAFVVCQLVEIIVPKKSRKGSFEVNVRRFYRPEDVSERKAYASDIREVYYSEDTFVVQPEALKGKCEVRKKKDMPSCSEFPISENIFFCEQIYDPSKGSVKQLPLNIKPKYSTVKDDALLRKKKGKGVESETDSGIVVKPNELPKEMRLATLDIFAGCGGLSQGLEQAGVSATKWAIEYEGPAGEAFRKNHPETTVIVDNCNVTLRAIMEKCGDQDECISTTEANELAAKLDENQKRTLPLPGQVDFINGGPPCQGFSGMNRFSQSPWSKIQCQMVLAFLSFVDYFRPRYFLLENVRNFVSYSKGQMFKLTLASLLEMGYQVRFGVLEAGAYGVSQSRKRAFIWAAAPEDVLPEWPEPMHVFNVSQLNISLSKGLRYAAVRSTQHGAPFRPITVRDTIGDLPPVENGESNIDKEYETDPVSWFQKEIRGNKNVPTDHLSQTMNEHNLIRCKRIPKRSGADWRDLPDEKVTLSTGLVVDLIPGCLAAKPGKKKQWKGLFGRLDWEGNFPTCVTKPGPMGMVGKCFHPDQDRIVTVRECARSQGFPDSYEFEGDIAHKHRQIGNAVPPPLAFALGRKLKEAVQLNNFAKSN

SEQ ID NO: 386 - protein, 478 aa, Brassica rapa
MPMSSWVCHFHISKKVLKQKQLDVESVVSSLNKQYANRKKELKLDVIDLEIQSTNHCSWDDKSMEDDRFCITVTVLEASTHGSLELDAIRLVLIPFLLDSPVKGYGEIKKVEILWADRPKAPKRNKKHMAGELFVKVTMHGVRGKKNIWSALLETCLPIMDMIDWTRSHPDNIRQCCSVYGIDAGRSIFLADLESAVADTGKGMLREHLLLVADCLSVTGEFVALNPKGWSKQRQAESTPAPFTQACFSSPSQCFLKAAKEGVTDELQGSIDALAWGKVPSFGTGDQFEIIISPKDHGFSSTPVKVYDFLSSTATLPKRKASSLPKSDNFTVQPFPLLDTALSKAVKTLDGKGLTRSQLRTIFTWDDIEKLSRSLKRILYNYEIDATLNERDERLLMMALLFHPNRDEKLGPGFQGIKVANSKHGNARCFEVVRTDGTTEDFSYHKCVLGATEIIAPKRVNFYKAKYLRNGTVQAGAI

SEQ ID NO: 387 - protein, 1443 aa, Brassica rapa
MEEKCEELEVPMGTLKSISFSISNNKDRKNMSVMEVEAANQVTDSRLGLPNRDDICKSCGSKDRKVCEGHFGVINLRYPVINPHLLKEVATLLNKFCPGCKYTKKKQSQSQSNTDYPLMKFRVTTKEAFRRSGIVCEVSEDNVLKLSKRGLSALPPDYWDFMPKDPNIDESCLKPSRRILTHAQVYALLSGIDERVIRKEIPMFDSLPLASFPVTPNGHRVSEMVTQFTGPRLVFDERTRIYKKLVGFEGNGLELSSRVMECMQYSRLFSENVSPSQESANPYQKKSDTPELRGLRFMKDVLLGKRSDHTFRTVVVGDPSLKLNEIGIPRSIAERLQVSENLNDWNRDRLVTSCFHKLLEKGETHVRRGGRLVGIRAIDDLQTGDSFLRTLKDGDTVLMNRPPSIHQHSLIAMSVKVLPTTSVVSLNPICCLPFRGDFDGDCLHGYVPQSIQAKAELEELVALDKQLVNRQNGRNLLSLGQDSLTAAYLVNVETNCFLNRAEMQQLQMYCPFELPRPAIIRGSSTSSEPQWTGKQLFGMLFPPGFEYAYPLNNVVVTNGELLSSSDGSGWLRDGEGNFIQGLMKHDKEKVLDIIFSAQEMLSQWLLNRGLSVSLSDLYFASDKHSRRNLTEEISYGLQEAEQVCNKQQLMVESRRDFLAVNGEEDTVVADDLELFCYERQRSATLSKLAVSAFKDAYRDVQALAYRYGDQSNAFLVMSKAGSKGNMGKLAQHSMCIGLQNSSVALSFGFPRKLTCASWNDPNSPLRGARGEDRTAHESFVPFGVVESSFLTGLNPLESFVHSVTSRDSSFSGNADLPGTLSRKLMFFMRDIYAAYDGTVRNSFGNHLVQFRYESSDDAEEDMTGEAVGSLSACAITEAAYSALDQPISLLETSPLLNLKNVLECGSKKGLKEQTMSLYLSETLSKKKHGFEYGALDIKRHLEKLCFSEIVSTFSPRTNTRMPMSSWVCHFHISKKVLKQNQLDLESVVSSLNKQYANRKKELKLDVIDLDIQSKNHCSWDDKAMEDDRVCITVTVLEASRHDSLELDAIRLVLIPFLLDSPVKGYREIKKVDILWVDRPKAPQRNKKGLAGELFLKVTMHGVRGKRSFWSALLETCLPIMDMIDWTRSHPDNIRQCCSVYGIDAGRSIFLADLESAVSDTGKAMLREHLLLVADSLSVTGEFVALNPKGWSRQRQAESTPAPFAQACFSSPSQCFLKAAKEGVTDELEGSIDALAWGKVPSFGTGDQFEIIISPKNHGFSTPVVDVYGFLSRTATLPKRKAVRATSSSLPKSDEFTVQPFPVLDTALSKAVKTLDGKGLTRSQLRMIFTWNDMEKLSRSLKRILYNYEIDATLNELDGRLLMMALLFHPNRDEKIGPGFKGIKVANSKHGNARCFEVVRTDGTTEDFSYHKCVLGATEIIAPKRVNFYKAKYLRNGTVQPGAI

SEQ ID NO: 388 - protein, 2059 aa, Brassica rapa
MEEASSSDILEAEIVGISFALATHRQIRLASISDAGINHASQLSNAFLGLPLEFGKCEACGATEPDKCEGHFGYIHLPVPIYHPAHVSELKQMLSLLCLKCLKIKKIKSTSSGLAERLLGVCCEEASNITIKDKSSDGASYLQLKLPSRTRLQEGFWNFLERYGYRYGSDHTRPLLAREVKEILRRIPEETRKKLTAKGHIPQEGYILEYLPVPPNCLSVPEVSDGSNSMSVDPSRIELKDVLRKVVAINNSRSGETNFESHRAEANEMFRVVDTYLQVRGTAKPTRNIDMRFGVSKISDSSSSKAWTEKMRTLFIRKGSGFSSRSVITGDAFRNVNEVGIPMEIAHRITFEERVSVHNIGYLQELVDNKMCLSYTQGSTTYSLRDGSKGHTVLKPGQIVHRRVMDGDVVFINRPPTTHKHSLQALRVYVHEDNTVKINPLMCSPLSADFDGDCVHLFYPQSLTAKAEVLELFSVDKQLRSSHTGQLILQLGLDSLLSLRVMMEQVFLDKASAQQLAMYGSRSLPPPAVVKSSKSGPAWTFFQILQLAFPERLSCRGDGFIVGGSDLLSFDFGVDALASIINGIVTAIMVEKGPKEALAFFDSLQPLLMEHLDPQGFSLSLEDLSMSREDMGVIHNLIVREISPMVSRLRLSYEDELQLENSIQKVKEVAANFMLKSYSMRNLIDIKSNSAINKLVQQIGFLGLQLSDKKKLYTKTLVEDMAQFYKKKYVSTSSSGDFGIVKGCFFHGLDPYEEMAHSVAAREVIVRSSRGLAEPGTLFKNLMAVLRDIVITNDGTVRNTCSNSIVQFKYELSSDNENQGLFEAGDPVGVLAATAMSNPAYKAVLDSSPNSNSSWELMKEVLLCKVNFQNTTNDRRVILYLNECRCGKKYCQENSAYTVRNKLKKVSLKDTAVEFLVEYRKQQAISEIFGMDICLHGHIHLNKTLLEGWNISMQDILQRCEDAINSLVQKKKKKAEDFKKMNLSVSECCSFRGPGSSKDSDMPCLMFSSYNATDPDLERTLDVLCNTIYPVLLETVIKGDPRIASANIIWNSPETTTWIRSRHASRRGEWVLDVTVEKSDVKQSGDAWRVVIDSCLSVLHLIDTKRSIPYSIKQVQELLGLSCAFEQAVQRLSASVRKVSKGVLKEHIILVANNMTCSGDMLGFNSGGYKALTRSLNIKAPFTEATLIAPRKCFEKAAEKCHKDSLSTVVGSCSWGKRVDVGTGSQFELLWNKKETGLENDDETDVFSFLQMVRSTKTADAYVSSPGFDVTEEEMAEWAESPERDSALGEPKFDDSAEFQNLLDEGKASESKWDNGSLWENGCSSGSEWGVSKNAGGEENTQSGWGKAANIEKEDASSGWNSKKDAQEATNTDSWGAWGSKTKDDAENATPNWGTKPAQNDSVVIENGEPSSDVWGPKAVSDKPWGKKNSETEPAPAAWGKTNSESESAAAAWGSTNKKNTGTESDAAGWGSTNKKNPETESDAGAWGSGAKNKETEPAPAAWGSWGKKSSEAVSGGADWGNRGKRVSETESGAGGWASRNPSLETQSGGATWGSRDKSKFETESGGAAWGSQAKNNFESESGSGAAAWGKKKPETESGGAAWGSQAKNKSEIESGSGAAAWGTWDKKKSETESGGGAWGSQAKKNSETESGAGASTWGAWDKKKPETESGGDGAAWGSQAKNNSETESGSGAAAWGKKKPETESGGGAAWGSQAKKNSESQLGAANWGSKDTNNSENGSDSAAWGKKKNSEAEPTSVAWGSWGQPSPPASDKDAQEDDGNPWVSLKATNSGEKEGNETSQWGVPNKRYPSAGSQSQGGGGGADWKRNRPPRTPGSESIMGPMFTATRQRVDMFTSEEQELLSDVDPVMRRLRKIMHQSGYTDGEPISDEDKTYVLEQILNYHPEKDAKLGPGLDFITVDKHTTFTESRCFFVVSTDGTKQDFSYRKCINNYLVEKFPNLAEEFIAKYFRKRDNENRDKNSQEATPPGEKESQTQPIDNGSQDSQPQSIGNEDGDTQPQSQAEDTQPQSQIEDTQLQSQVEESQPIGNGGEDYQTEPQG

SEQ ID NO: 389 - protein, 1169 aa, Brassica rapa
MTDIDIEEIEAAGEVDLRDLGDPFLQSFCKKAATSFFDEYGLVSHQLNSYNFFIEHGLQSVFESSGEMLVEPSFDPTKNKDHEWRYATVKFGEVSVDKPTLYSDDKELVFLPWHARLQNMTYSARMKVNVDVEVFVKKVVKRDKFKTGQDEYVEKQILSKKTQDIPIGRIPVMVKSVLCNTTEKGKHVESYRKGECAFDQGGYFVIKGAEKVFIAQEQMCTKRLWISNSPWTVSYRSETKRNRFIVRLSENQKAEDFKRKEKVLTVYFLSTEIPVWVLFFALGVASDKEAVDLIAFDGGDASITNSVVASIQEADSVCEDFRHGRNALAYVEQQIKGTKFPPGESVDECLSLYLFPGLKSLKQKARFLGYMVKCLFSAYAGKRKCENRDNFRNKRIELAGELLERELRVHLAHARRTMTKAMQRHLTGDGDLKPIEHYLDASIITNGLSRAFSTGAWCHPFRKMERVSGVVANLGRANPLQSLIDLRRTRQQVLYTGKVGDARYPHPSHWGRVCFLSTPDGENCGLVKNLSLLGLVSTQIMEPVVEKLFDSGMEELVDDTSTPLSGKHKVLLNGDWVGVCSDSDYFVAELKSRRRQSELPRQMEIKLDKDDKEVRIFTDAGRLLRPLMVVENLHKLKQSKPSKYTFEHLLDQGILELIGIEEEEDCTTAWGTKQLLKQQKSYTHCELDLSFLLGVSCAIVPFANHDHGRRVLYQSQKHCQQAIGFSSTNPNIRCDTLSQQLFYPQKPLFKTMASECLQKDVLFNGQNAIVAVNVHLGFNQEDSIVMNKASLERGMFRSEQIRSYKADVDSKDSEKRKKMDEVVQFGKTHSKIGRVDSLDDDGFPFVGANMHSGDIVIGRCTESGTDHSVKLKHTERGIVQKVVLSSNDDGKNYATVSLRQVRSPCLGDKFSSMHGQKGVLGYIEEQENFAFTNQGIVPDIVINPHAFPSRQTPGQLLEAALSKGIACPMQKKKGKSDAYSKVTRHATPFSTPSVDDITDQLHRAGFSRSGNERVYNGRTGEMMRSLIFMGPNFYQRLIHMSEDKVKFRNTGPVHPLTRQPVADRKRFGGIKFGEMERDCLIAHGASANLHERLFTLSDSSQMHICRNCKSAANVIERVASSGRRIRGPYCRLCESPDYVVMVNVPYGAKLLYQELFSMGICLNFETNLC

SEQ ID NO: 390 - protein, 1122 aa, Brassica rapa
MVSEITRSTVKLTNVPQTIVADELLRFLELHLGADSVFALEIPTSRDNWKPRDFALVQFTSLEAKSRAQHLSSQTKLLFKSRNLRVSEAYDDIVPRPVDPRRRLDGVVLTAGFPESEEGRFCALQKWEGVRCWVIEEKRRVEFWVWECGDCYKCEVRFEDVVETVPSCVDGVDEINAFLLRLKYGPKIYKQVSGPHIATKFKSGRYSFCKDDFDFMWIRSTDFSGLKSIGTSTCFCLEVDNASAMSDIFSSLPYYREDTLSLTLVNGNTFASANQIVPLLNAANLGIEIPYEILFQLNSLVHAQKISLFAASNMGLISILCGLSLETALVVLKKLHQQRSICYDPISFVKAQSQYVVKKTAHSPASAYKRLTEQNIMSCQRAYVTPSKIYLLGPELETANYVVKNFAEHASDFMRITFVEEDWSKIPANALSVNSKEGYFVKPFRTNIYHRVLSILGEGITVGPKKFEFLAFSASQLRGNSVWMFASNEKVKAEDIREWMGCFRKIRSISKCAARMGQLFSASRQTLNVRAQDVEQIPDIEVTTDGADYCFSDGIGKISLAFAKQVAQKCGLSHIPSAFQIRYGGYKGVIAVDRSSFRKLSLRDSMLKFDSNNRMLNVTRWTESMPCFLNREIICLLSTLGIEDAVFEAMQAGHLSILGNMLEDRHAALNVLQKLSGESSKNLLVKMLLQGYAPSSEPYLSMMLRVHHESQLSELKSRCRILVPKGRILIGCMDEMGILEYGQVYVRVTLTKAELESREQSYFRKIDEETSVVVGKVVVTKNPCLHPGDIRVLDAIYEVNFEQKGFLDCIVFPQKGERPHPNECSGGDLDGDQFFVSWDEKLIPSQMDPPMDYAGSRPRIMDHDVTLEEIHKFFVDYMISDTLGVISTAHLVHADRDPERARSQRCIELANLHSRAVDFAKTGAPAEMPYALKPREFPDFLERFEKPMYISGSVFGKLYRAVKSTLAQRKPEDAESEDKKKMAAYDSTLEEAGFDNFIETAKAHRDMYAEKLSSLMNYYGAANEEEILTGILRTKEMYLQRDNRRYGDMKDRITLSVKDLQREAMGWFEKSCEDEQQRKKLASAWYYVTYNPSYCDEKPRFLSFPWIVGDVLLGIKAESAER

SEQ ID NO: 391 - protein, 1198 aa, Brassica rapa
MGSEGNMKNSVVTQVSIGGFGESTTAKELTDYLEEEVGLVWRCRLKTSWTPPGSYPDFEITDTSNIPTFDGYKRVEPHAFVHFAVPESAGRAMDAAGQSKLILDGQPLKVSLGPKNPYTLNQRRRTTTPYKLTGVSIEIGTLIARDEFLVSWRAEGVDFLVDPFDNTCRFCFTKSTAFSLKDTMMYAVINCDYKLELLVRDIRTVRQYRTLDGYVLLLQLASSPRVWYRTADDDIYETVPVDLLDDDDPWIRTTDFTQAGAIGRCLSYRVLISPRYEKKMNTALDYLRARRVQEERVRWPPRIRDEPCFGEPITDHFFCIHHREGISFEIMFLVNAVLHRGVFNQFHLTERFFDLLRNQPKDVNIASLKHLCTYKRPVFDAYKRLKLVQEWIQKNPKLLGSHVQLDDISEIRRLAITPTRAYCLPPEVELSNRVLRKYKALSDRFLRVTFMDESMQTMNSNVLSYFVAPIVKDLTSSSFSQKTHVFKRVKTILTDGFKLCGRRYSFLAFSANQLRDRSAWFFAEDGKTRVSDIKTWMGKFKDKNVAKCAARMGLCFSSTYATVDVMPHEVDTELPEIERNGYTFSDGIGTITPDLALEIMEKLKLDSHCSPCAYQIRYAGFKGVVARWPSKDDGIRLALRHSMDKFHSKHTILEICSWTRFQPGFLNRQIITLLSVLGVPDEIFWDMQETMLCKLNRILDDTDVAFEVLTASCAEQGNTAAIMLSAGFKPKTEPHLRGMLSSVRIAQLWGLREKSRIFVTSGRWLMGCLDEAGVLEQGQCFIQVSKPSIENCFSKHGSRFKETKTDLQVVKGYVAIAKNPCLHPGDIRILEAVDVPELHHMYDCLLFPQKGERPHTNEASGSDLDGDLYFVAWDQRLIPPSRTSFPAMQYTAAEESSKGRPVNHQDIIEFFVKNMANENLGTICHAHVVHADRSEYGARDEECLLLAELAATAVDFPKTGKLVTMPFHLKPKLYPDFMGKEEYQTYRSEKILGRLYRRVKEVYDEDAEASSEENSDPSDIPYDTDLEVPGFEDFVPEAWGHKCSYDGQLIGLLGQYKVQKEEEIVTGHIWSMPKYTSSKQGELKERLKHSYNSLKKELRKVFEETKPEHESLSEEEKNVMYEKKASAWYHVTYHPEWVKKSTELQEPGESSGHAVMLSFAWIAADYLARIKVRSGEMGMKMDSAKPVDALAKYLSQRL

SEQ ID NO: 392 - protein, 606 aa, Brassica rapa
MGSRGDKGKNVSSGGSNAEVEQLAKGFSETKLGPSQDGGGEWEVISKRNKNKPGNAAGKSWATAPNQNPPRAWGGQQQQQGRGNNGYGRGRGTQVSTGRGAGRGQAMNRGYGGASAPVARPPLEGGWNWQSRPGAAQQTVTEEVPEVDDDDVSEGEEEDDCDALDDSDEDLASDDYDSDVSQQSHGTRKQNKWFKKFFDSLDSLSIEQINEPQRQWHCPACQNGPGAIDWYNLQPLLAHARTKGARRVKLHRELAEVLDRDLQMRGASVIPCGEIYGQWKGLGEEEKDHEIVWPPMVVIMNTKLDKDENDKWLGMGNPELLEYFNEYPAIRARHSYGPQGHRGMSVLIFESTATGYFEADRLHRDLAQKGLDRDAWERRRSWFSGGVRQLYGFLAIKRDLDLFNQHCQGKARLKYEMKSYQEYVVKELRQIAEDNQQLNWFKNKLTKQNKHAKVLEESLGILSEKLRKTAEDNRIVRQRTKMQHEQNREEMDSQDKFFKESIKQIHEKRDAKEENFEMLQQQERAKVVDLRKRAEEVSSFIECQEKEMKEFVEEREKLIEEQEKKMAELKKKYFEEMLDLERGFDKALEQLMSKHGLHDADDTDDY

SEQ ID NO: 393 - protein, 613 aa, Brassica rapa
MRNHNYNSLNNVNAPGNDAWSDSDRGSSSFRTRSPGAVLPLSASFGRMTTLVPFPDLNLMPDSPPPETSSNTRITAVRSLAPTLGVERNSLAIFPVPGHENHHARVVQTLHQDNQELARYVFKRTRMIYDSLLLQLTVEYGPNPKPAVNVRASKLMEERGLWLNKGQHLVGPVPGVEIGDIFFYRKELCMYGLHRHSQAGIEYTKARLSSFGVPIATSIIASGGYEDNEDRGDVLVYSGQGGRDKSGQQRQHQKLVRGNLAMVQSMQLGVPVRVIRGFHYKNEVSSNVFIYDGLYRIVKSSRVRKSGFDIFKFTLVRIQGQPEMGSARLMRALTLRNTPLAWMPAGYISFNLYGKNEGVPVYLYNDIDYDRSPLNYGYISQSDISSVILAQGGNNGGCDCNLSCTDDCICVRKNGGELPYSPYGSLLRGKHVIFECGVTCKCTSGCTNRVAQRGLMKKMEVFRTREAGWGVRSLDLIHAGEFICEYAGTVVTKELGEIMSMNGDGLVYPGRFAANWKLWGDLSDVYPGNVPPSYPTIPPVDYAIDVSRVRSVAAFIRHSREPNVMAQFVFHDHNNLKFPRVMLFALENISPLTELSLDYVVVDEVDERLAIRG

SEQ ID NO: 394 - protein, 631 aa, Brassica rapa
MTSHIPMVIPKPEPVTDSSPQTPIPPSSFFNFNTTTTQSPLEPNLYTEFTNVAETFRSAFAQRLKRHEDVTVLDSLTGAIVPVPEEQDPDPDPVSYPSQSLKPRKPQERSSELVRITDVGPEGERQFREVVRKTRMIYDSLRIFLILEETREVLGRRRGRPDSKAASMMKERFLWLNRDKRIVGSIPGVQVGDIFFFRLELCVMGLHGQTQAGIDYLIGSRSSNGEPIATSVIVSGGYEDDDDQGDVIIYTGHGGQDKLGRQAEHQKLEGGNLAMERSMYYGIEVRVVRGFKYENAVSSKVYVYDGLFRIVDSWFDVGKSGFGVFKFRLERIGGQVEMGTSVLKFAKTLKTNPLSVRPSGYISFDISNRKENAPVYLFNDVDDDQEPLYYEYLATTSFPRGILGGSNGDNASGCECVSGCSSGCICERKNGGEFAYDYNGNLIRMRPLVHECGPGCKCPPTCRNRVTQKGLRSRLEVFRSVETGWGVRCLDILHAGAFICEYVGVALTREQANILTMNGDTLVYPARFCSDRWKDWGDLSQVFPDYERPSYRQIPPVDYAMDVSKLRNVACYISHSNDSNVIVQMVLHDHNNLMFPRVMLFAAENIPPMTELSLDYGVSDDEWSPKLAICN

SEQ ID NO: 395 - protein, 637 aa, Brassica rapa
MNTLFAFPELNRTPSAAAMMSLPPRLRVKAEPIDDPTPPPTPTPTPTPTLTPSDIYAEYYSLCERVASALANRNNDLLAIVPVPEEKPPLLHSPPPIPTPPGSGDNRALSSRLPPRFQRPHELARVADLGREDHIHRREILKRTRAIYDSLRLHIIAEAMRLPGRRRKPRADYNASTLMRERGLWLNQDKHVVGSIPGVEIGDMFLYRLELCVIGLHGQPQAGIDFLTANRSSNGEPIATSIIVSGGYEDDEDTGEVLVYSGHGGQDKVHRQCQHQRLESGNLAMERSMHYGIEVRVIRGFKYDNVVSSKVYVYDGLYRIVQYWFDVGRSGFGVFKFKLVRIEGQGEMGSRRMKFAQALRTKPLAVRPNGYITFNLSGGKENVPVYLYNDIDFDREPEGYDYIVRSAIPCVISARGGANRGCDCNYSCGSDCFCARRNGGELPYDDDGTLLKGKPVVFECGVLCGCGPSCKNRVTQKGLSKTLEVFRSRETGWGVRTLDFIQAGAFICEYAGVVLTREQAKIVSMSGDPLLYPGRFTEKWSSLGDLSQVYPEYVQPSYPSLPPVDFGMDVSKFRNVASYISHSKESNVMAQFVLHDHSNLMYPRVMLFALENISPLTELSLDYGLDDKLEERLAICN

SEQ ID NO: 396 - protein, 1110 aa, Brassica rapa
MGKTIQVFGFPNGVSAEEVKNFLERLTGPGTVYAIKVRQPKKGGPRVYAIVQFTSERLARHIVTLASQRLDYGRSYLKAFEVEQDIVPKPRASLHNMPNLKMYFGCQVSPMKLSVFWSAQNVAVSYGTGMRKFHFSLSWCEKEYRLELPYENIWHIDLHFPQGRRDSKFLVIQVIGAPKIFEKEDQPVNLLFGLLDFYRDGSDEQWIRTTDFTSSSCISQSSAFCLELPVHLNVSDFRENFANYAEHEDSTFALESGRSFSSNANKLVPVVDPPPGCYLPFEILFKVNTLVQNACIPGPALDPAFYQLLNPQRFDRALIDHCLEKLFHLPECCYAPARWLREEYSTWVTKGKLPQSPMISLDDGLVYMYRVQVTPTRVYFSGPEVNVSNRVLRHYSDYINNFLRISFVDEDLEKVRSMDLSPRSSTVKRTKLYERINSVLRDGIVIGDKRFEFLAFSSSQLRENSAWMFAPVNGITAANIRAWMGDFDNIRNVAKYAARLGQSFSSSRETLTVRRDEIEVIPDVEIRYSDVHYVFSDGIGKISAEFARRVAKKCGLTEFFPSAYQIRYGGYKGVVAVDPNSSKKLSLRKSMSKFESENTKLDVLAWSKYQPCYMNRQLITLLSTLGVEDNVFEKKQREVVNQLDAILTDPLEAFEALGMMAPGENTKILKELILCGYKPDAEPFLSMMLQNFRASKLLELRTKTRVFIPRGRSMMGCLDETRTLEYGQVVVQYTDPTRPGSKYIVTGLVVVAKNPCLHPGDVRVLQAVNVPALSHMVDCVVFPQKGPRPHPNECSGSDLDGDIYFVCWDPELIPQGTSNPMDYTPEPAQILDHDVTIEEIEEYFTNYIVNDSLGIIANAHTAFADKEPLKAFSDPCIELARKFSIAVDFPKTGVAAEIPQHLYVKEYPDFMEKPDKPTYESKNVIGKLFREVKERAPPLISIKSFTLDVASKSYDKDMEVNGFEEYVDQAFFHKGNYDYKLGNLMDYYGIKTEAEILSGGIMRMSKSFTKRRDAESIGRAVRSLRKEALSWFNASEDEEEVVNESAKASAWYHVTYHRSYWGVYNEGLNRDHFLSFAWCVYDKLVRIKKANVGRRQRQETLERLGLMRLS

SEQ ID NO: 397 - protein, 1641 aa, Brassica rapa
MPDREIGDDASDTNLSSSFSSFASSSSSFSSSYSAAGAWTDDHSAKMEKDPRKIARRYQLELCEKAVEENVIVYLGTGCGKTHIAVMVIYELGPLILSPRKSVCIFLAPTVALVEQQALVIAKSINFKVATHCGGNRTVTTHSDWEREVSENEVLVMTPQILLHNLQHCFIRMEWISLLILDECHHAQEQSNHPYAQILKVFYKTEGVKGPRIFGMTASPVVGKGSFQSENLSKSINSLENLLNAKVYSVESNVQLDGFVSSPIVKVYYYQTAGTEASQSTNIYENMLEDIKQRCLTSLKQQIDNHQTQVLLNMKKLLKRTHDNLIYSLVNLGLWGAIQAARIQLNTDRNVHQEPLEENNKSKICITYLSLAAEVLSSKVAKDENASELISLPALKEPFFSRKLLQLIKILSAFRIEPHMKCIIFVNRIVTARTLSCILNSLKLLESWKSDFLVGLSSGVKSMSRKSMKTILERFQSKELNLLVATKVGEEGLDIQTCCLVIRFDLPETVTSFIQSRGRARMPKSEYAFLVDRGSEKEMDLIENFKVNEDRMNLEITSRTSEETCPRLDDEVYRVHETGACISGGSSISLLYKYCSRLPHDEFFQPKPEFQFKPVDEFGGTICRITLPANAPISEIVSSLLPSIEAAKKNACLKAVYKLHSLGVLNNFLLPDSNEETEDELSDEEFDFDKVEGEACSRGELYEMIVPDLFKQKWDPSKSCVNLQSYYIRFVPHPADRIYKKFGLFMKSPLPIEAETMDFDLHLAHQRSVSVKIFPKGDANFDNDEIRLAERFQEVALKIIFERRELITEFVPLGLQDSFRTSKSTFYLLLPINLDASESVLFVDWATIRSCLSSPIFKAPSGLVEDMDPPVGSHLKLANGCWSIDDVKNSVVFATHKKQFYFVSDICHGRNGFSAIRKSITETHLESIYNSYGVKLKHPLQPLLRLKPLCYVRNLLHNRKRENLEPNELEEYFIEIPPELSQLKIKGLSKDIGSSLSLLPSVMHRMENLLVAIELKHMLSASIPEIAEVSGHRVLEALTTEKCQERFSLERHAVLGDAFLKFAVSRHLFLHHDRLDEGELTRRRSNAVNNSNLFRLATRRNLQVYIRDQAFDPTQFFALGHPCRVTCDEVAMKEVHSLDKVPGLLESSTGEIRCSKGHHWLHKKTIADVVEALVGAFLVDSGFKGAIEFLKWIGINVDFESLQVRDACVASKRYMPLTTCFDLAALESLLGYKFLHKGLLLQAFIHPSYNRHGGGCYQRLEFLGDAVLDYLMTSYFFSVFPKLKPGQLTDLRSLSVNNKALANVAVSFSLQRFLFCDSTYLHDAIKDYTNFVTASPLASGPSEGPKCPKVLGDLIESFLGALFLDCGFDLNHVWRIMLSFLDPVKNLSNLQLSPVKELLEYCQSYKWDQEISATKKDGAFSVELKVTKKSSCLTASATGRNKKESTKKAAQLMLTNLKAHGHIKTSNPLEDVLKNSIRNEAKLIGYDEEPIDVVDRDGLDVENLNIQDSFEEDPVTESKTSETSSSYIIRRVLTNAPPSEKEESLPQKTIKDAGGSIIKTAKSLLRETCVANCWKTPEFVCCEEGPAHLKTFSYKVILEVVDAPNMTLECYGEAKPTKKSASEQAAQAALWCLEHTGFLRR

SEQ ID NO: 398 - protein, 966 aa, Brassica rapa
MSSRGGRGGGGGRRSDQSPGPVAWPALQSSGARGGRGRGNAAPVASSSSSPPSDAVSGAIGAVDVASSSSVREKPKASASSDSDSSLGQELAEKVQITTAPPSSSKAVTFPVRPGFGQAGKKVTIRANHFLVQVADRDLYHYDVSISPEVISKKVNRDVMTTLVKTYGESHMAKKIPAYDGRKSLYTAGPLPFESKEFVVDLNDKKPAASSKRDRKFRVAIKLASRPDLHQLQEFLRRKQRDAPYETIQVLDVVLRDLPSQKFVSVGRSFFDPSLGRRGELGDGVEYWSGYFQSLRLTQMGLSLNIDVSARSFYEPILVTEFIGKYLNLRDFSRPLRDSDRVKASYLMFIQPVKKALKSLKVELAQFDFARSVKVSGISSCPISELRFTLEDNTQKTVVQYFAEKYNYRVKYPALPAIQSGSDSRPAYFPMELCRIAEGQRYTKKLNERQVTALLRATCQRPDIRENSIKGMVKNNKYNEIDLVRKEFGMSVTDQLATVEARVLPPPLLKYHESGREKMVNPRLGQWNMIDKKMINGARVASWTSVCFSTRIDRNLPQEFCKQLIDMCVSKGMQFNPQPAIPFISCQPQRIEEALCDIHKRAPGLQMLIVILPDVTGSYGKIKRICETELGIVSQCCQPNQVRKLNKQYMENVALKINVKTGGRNTVLDDAIRRRIPLISDRPTIIFGADVTHPQPGEDSSPSIAAVVASMDWPEITKYRGLVSAQTHREEIIEDLYKLVQDPQRGPVHTGMIREHLIAFRRATGQKPLRIIFYRDGVSEGQFSQVLLHEMTAIRKACASLEERYLPPVTFVVVQKRHHTRLFPAQHGNRETTDKSGNIQPGTVVDTKICHPTEFDFYLNSHAGIQGTSRPAHYHVLVDENGFTADALQMLTNNLCYTFARCTRSVSIVPPAYYAHLAAFRARYYMESENSDGGSSRSRNTTASTSAVVSLLPATKDNVKDVMFYC

SEQ ID NO: 399 - DNA, 3384 bp, Gossypium raimondii
ctaaaagtgagagagtggacggtggagatgtggtagagtatggtaatcgtgtaagaccgcgaagcagaggagacggtaaccactaatagagggacagaagaagcgttggtcacttgtgtattttagtctctctcagccttttagtatttagagggagagggagtgagctaaaaaagaagagaaagagggtcgtagaattttgctgtctctttgagttccttagggtttcttgtttcaatttttttttgttttttctctccggatttcagggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgtttctctttcatatgaagatggtcgccctgtggatggtaagggtgttggaaggaaagtgattgacagagtgcatgagacctacaaaaatgatttggatggaaagaattttgcctatgatggtgaaaaaagtttatttactataggtccgctaccaaacaacaagcttgagtttactgttgtacttgaggatgttgcacctaccagaaacaatggaaatgcaagccctgatggccaggacagcccaaatgggcgtgaaagaaagagattaagaagaccgtatcattcaaagacctttaaagtggagattagctatgctgcgaagatacccatgcaagcaattcaaaatgctctgcgtgggcaggaatctgaaaactctcaagaagcactgagggtgctggatatcattttaaggcagcatgctgcgaaacagggatgcctacttgttcgccaatctttctttcaagataatcagaacaacttcacagacattggaggaggtgtccttggctgtagaggtttccattcaagtttcagagccactcaaggaggcctttcactaaatatcgatgtatcaactaccatgataattcaacctggtccggtagttgattttttacttgcaaatcagaatgctagagatccttactctcttgactggaacaaggcaaaacgggtgctgaagaatctgaggattaaagttagtccgtctaatcaagagtacaagattactggcttgagtgaacaactgtgcaaggatcagttgttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgagctttgctctttggtgtctttgcaacgctacactaaggcactatccactttccaaagagcttccctggttgaaaaatcgaggcagaagcctcaagaaaggatgaatgttttgtctaatgttttacgtaccagtaattatggtgctgaaccaatgctgaaatcttgtggtgttaatataaactctaatttcacccaagtggatggacgtattctgccagcaccaaggttaagagtcggcaacggtgaagatttctttccaaggaatgggcgttggaattttaacaacaagaaattggtggagccatctaggattgaaagatgggctgttgtgaacttctcggctcctcgttgtgatccaaacaacattgcaagggatttgattcgttgtggagaaatgaaaggaattcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcagatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagggaccacaaggccgacccactatcatgttctcttagaccaggttgggttttcagctgatgatctgcaggagcttgttcattctctatcctacgtgtatcaaaggagcaccacagccatatctgttgtggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatgctttcaaagtagtatact

SEQ ID NO: 400 - DNA, 3477 bp, Gossypium raimondii
gtctctctcagccttttagtatttagagggagagggagtgagctaaaaaagaagagaaagagggtcgtagaattttgctgtctctttgagttccttagggtttcttgtttcaatttttttttgttttttctctccggatttcaggtatttcctctgaaacctttttattttggattttttttctttgctttttttttcatggttctttgaggttttttttagagtttttttttggagatttttgggctttgttcttcgcaatgctgctacagtgcgtgtgatttttaaagggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgtttctctttcatatgaagatggtcgccctgtggatggtaagggtgttggaaggaaagtgattgacagagtgcatgagacctacaaaaatgatttggatggaaagaattttgcctatgatggtgaaaaaagtttatttactataggtccgctaccaaacaacaagcttgagtttactgttgtacttgaggatgttgcacctaccagaaacaatggaaatgcaagccctgatggccaggacagcccaaatgggcgtgaaagaaagagattaagaagaccgtatcattcaaagacctttaaagtggagattagctatgctgcgaagatacccatgcaagcaattcaaaatgctctgcgtgggcaggaatctgaaaactctcaagaagcactgagggtgctggatatcattttaaggcagcatgctgcgaaacagggatgcctacttgttcgccaatctttctttcaagataatcagaacaacttcacagacattggaggaggtgtccttggctgtagaggtttccattcaagtttcagagccactcaaggaggcctttcactaaatatcgatgtatcaactaccatgataattcaacctggtccggtagttgattttttacttgcaaatcagaatgctagagatccttactctcttgactggaacaaggcaaaacgggtgctgaagaatctgaggattaaagttagtccgtctaatcaagagtacaagattactggcttgagtgaacaactgtgcaaggatcagttgttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgagctttgctctttggtgtctttgcaacgctacactaaggcactatccactttccaaagagcttccctggttgaaaaatcgaggcagaagcctcaagaaaggatgaatgttttgtctaatgttttacgtaccagtaattatggtgctgaaccaatgctgaaatcttgtggtgttaatataaactctaatttcacccaagtggatggacgtattctgccagcaccaaggttaagagtcggcaacggtgaagatttctttccaaggaatgggcgttggaattttaacaacaagaaattggtggagccatctaggattgaaagatgggctgttgtgaacttctcggctcctcgttgtgatccaaacaacattgcaagggatttgattcgttgtggagaaatgaaaggaattcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcagatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagggaccacaaggccgacccactatcatgttctcttagaccaggttgggttttcagctgatgatctgcaggagcttgttcattctctatcctacgtgtatcaaaggagcaccacagccatatctgttgtggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatgctttcaaagtagtatacttgcaaaattaaaacaaggaggatcaactttgcttgaaaatttgaatctgagctgactttgttgagcagagaa

SEQ ID NO: 401 - DNA, 3148 bp, Gossypium raimondii
gcaatgctgctacagtgcgtgtgatttttaaaggtttttcttcctttttaaggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgtttctctttcatatgaagatggtcgccctgtggatggtaagggtgttggaaggaaagtgattgacagagtgcatgagacctacaaaaatgatttggatggaaagaattttgcctatgatggtgaaaaaagtttatttactataggtccgctaccaaacaacaagcttgagtttactgttgtacttgaggatgttgcacctaccagaaacaatggaaatgcaagccctgatggccaggacagcccaaatgggcgtgaaagaaagagattaagaagaccgtatcattcaaagacctttaaagtggagattagctatgctgcgaagatacccatgcaagcaattcaaaatgctctgcgtgggcaggaatctgaaaactctcaagaagcactgagggtgctggatatcattttaaggcagcatgctgcgaaacagggatgcctacttgttcgccaatctttctttcaagataatcagaacaacttcacagacattggaggaggtgtccttggctgtagaggtttccattcaagtttcagagccactcaaggaggcctttcactaaatatcgatgtatcaactaccatgataattcaacctggtccggtagttgattttttacttgcaaatcagaatgctagagatccttactctcttgactggaacaaggcaaaacgggtgctgaagaatctgaggattaaagttagtccgtctaatcaagagtacaagattactggcttgagtgaacaactgtgcaaggatcagttgttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgagctttgctctttggtgtctttgcaacgctacactaaggcactatccactttccaaagagcttccctggttgaaaaatcgaggcagaagcctcaagaaaggatgaatgttttgtctaatgttttacgtaccagtaattatggtgctgaaccaatgctgaaatcttgtggtgttaatataaactctaatttcacccaagtggatggacgtattctgccagcaccaaggttaagagtcggcaacggtgaagatttctttccaaggaatgggcgttggaattttaacaacaagaaattggtggagccatctaggattgaaagatgggctgttgtgaacttctcggctcctcgttgtgatccaaacaacattgcaagggatttgattcgttgtggagaaatgaaaggaattcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcagatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagggaccacaaggccgacccactatcatgttctcttagaccaggttgggttttcagctgatgatctgcaggagcttgttcattctctatcctacgtgtatcaaaggagcaccacagccatatctgttgtggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatg

SEQ ID NO: 402 - DNA, 3219 bp, Gossypium raimondii
gtgtattttagtctctctcagccttttagtatttagagggagagggagtgagctaaaaaagaagagaaagagggtcgtagaattttgctgtctctttgagttccttagggtttcttgtttcaatttttttttgttttttctctccggatttcagggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgtttctctttcatatgaagatggtcgccctgtggatggtaagggtgttggaaggaaagtgattgacagagtgcatgagacctacaaaaatgatttggatggaaagaattttgcctatgatggtgaaaaaagtttatttactataggtccgctaccaaacaacaagcttgagtttactgttgtacttgaggatgttgcacctaccagaaacaatggaaatgcaagccctgatggccaggacagcccaaatgggcgtgaaagaaagagattaagaagaccgtatcattcaaagacctttaaagtggagattagctatgctgcgaagatacccatgcaagcaattcaaaatgctctgcgtgggcaggaatctgaaaactctcaagaagcactgagggtgctggatatcattttaaggcagcatgctgcgaaacagggatgcctacttgttcgccaatctttctttcaagataatcagaacaacttcacagacattggaggaggtgtccttggctgtagaggtttccattcaagtttcagagccactcaaggaggcctttcactaaatatcgatgtatcaactaccatgataattcaacctggtccggtagttgattttttacttgcaaatcagaatgctagagatccttactctcttgactggaacaaggcaaaacgggtgctgaagaatctgaggattaaagttagtccgtctaatcaagagtacaagattactggcttgagtgaacaactgtgcaaggatcagttgttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgagctttgctctttggtgtctttgcaacgctacactaaggcactatccactttccaaagagcttccctggttgaaaaatcgaggcagaagcctcaagaaaggatgaatgttttgtctaatgttttacgtaccagtaattatggtgctgaaccaatgctgaaatcttgtggtgttaatataaactctaatttcacccaagtggatggacgtattctgccagcaccaaggttaagagtcggcaacggtgaagatttctttccaaggaatgggcgttggaattttaacaacaagaaattggtggagccatctaggattgaaagatgggctgttgtgaacttctcggctcctcgttgtgatccaaacaacattgcaagggatttgattcgttgtggagaaatgaaaggaattcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcagatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagggaccacaaggccgacccactatcatgttctcttagaccaggttgggttttcagctgatgatctgcaggagcttgttcattctctatcctacgttggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatg

SEQ ID NO: 403 - DNA, 3347 bp, Gossypium raimondii
gtgtattttagtctctctcagccttttagtatttagagggagagggagtgagctaaaaaagaagagaaagagggtcgtagaattttgctgtctctttgagttccttagggtttcttgtttcaatttttttttgttttttctctccggatttcagggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgtttctctttcatatgaagatggtcgccctgtggatggtaagggtgttggaaggaaagtgattgacagagtgcatgagacctacaaaaatgatttggatggaaagaattttgcctatgatggtgaaaaaagtttatttactataggtccgctaccaaacaacaagcttgagtttactgttgtacttgaggatgttgcacctaccagaaacaatggaaatgcaagccctgatggccaggacagcccaaatgggcgtgaaagaaagagattaagaagaccgtatcattcaaagacctttaaagtggagattagctatgctgcgaagatacccatgcaagcaattcaaaatgctctgcgtgggcaggaatctgaaaactctcaagaagcactgagggtgctggatatcattttaaggcagcatgctgcgaaacagggatgcctacttgttcgccaatctttctttcaagataatcagaacaacttcacagacattggaggaggtgtccttggctgtagaggtttccattcaagtttcagagccactcaaggaggcctttcactaaatatcgatgtatcaactaccatgataattcaacctggtccggtagttgattttttacttgcaaatcagaatgctagagatccttactctcttgactggaacaaggcaaaacgggtgctgaagaatctgaggattaaagttagtccgtctaatcaagagtacaagattactggcttgagtgaacaactgtgcaaggatcagttgttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgagctttgctctttggtgtctttgcaacgctacactaaggcactatccactttccaaagagcttccctggttgaaaaatcgaggcagaagcctcaagaaaggatgaatgttttgtctaatgttttacgtaccagtaattatggtgctgaaccaatgctgaaatcttgtggtgttaatataaactctaatttcacccaagtggatggacgtattctgccagcaccaaggttaagagtcggcaacggtgaagatttctttccaaggaatgggcgttggaattttaacaacaagaaattggtggagccatctaggattgaaagatgggctgttgtgaacttctcggctcctcgttgtgatccaaacaacattgcaagggatttgattcgttgtggagaaatgaaaggaattcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcagatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagggaccacaaggccgacccactatcatgttctcttagaccaggttgggttttcagctgatgatctgcaggagcttgttcattctctatcctacgtgtaagtacagaaacaagcgtacagaaacaacttatttttttacaaatagtttaagctgttttcactgtcacaatctttgtattctgtctgttgcaggtatcaaaggagcaccacagccatatctgttgtggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatg

SEQ ID NO: 404 - DNA, 3577 bp, Gossypium raimondii
gtgtattttagtctctctcagccttttagtatttagagggagagggagtgagctaaaaaagaagagaaagagggtcgtagaattttgctgtctctttgagttccttagggtttcttgtttcaatttttttttgttttttctctccggatttcagggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgtttctctttcatatgaagatggtcgccctgtggatggtaagggtgttggaaggaaagtgattgacagagtgcatgagacctacaaaaatgatttggatggaaagaattttgcctatgatggtgaaaaaagtttatttactataggtccgctaccaaacaacaagcttgagtttactgttgtacttgaggatgttgcacctaccagaaacaatggaaatgcaagccctgatggccaggacagcccaaatgggcgtgaaagaaagagattaagaagaccgtatcattcaaagacctttaaagtggagattagctatgctgcgaagatacccatgcaagcaattcaaaatgctctgcgtgggcaggaatctgaaaactctcaagaagcactgagggtgctggatatcattttaaggcagcatgctgcgaaacagggatgcctacttgttcgccaatctttctttcaagataatcagaacaacttcacagacattggaggaggtgtccttggctgtagaggtttccattcaagtttcagagccactcaaggaggcctttcactaaatatcgatgtatcaactaccatgataattcaacctggtccggtagttgattttttacttgcaaatcagaatgctagagatccttactctcttgactggaacaaggcaaaacgggtgctgaagaatctgaggattaaagttagtccgtctaatcaagagtacaagattactggcttgagtgaacaactgtgcaaggatcagttgttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgagctttgctctttggtgtctttgcaacgctacactaaggcactatccactttccaaagagcttccctggttgaaaaatcgaggcagaagcctcaagaaaggatgaatgttttgtctaatgttttacgtaccagtaattatggtgctgaaccaatgctgaaatcttgtggtgttaatataaactctaatttcacccaagtggatggacgtattctgccagcaccaaggttaagagtcggcaacggtgaagatttctttccaaggaatgggcgttggaattttaacaacaagaaattggtggagccatctaggattgaaagatgggctgttgtgaacttctcggctcctcgttgtgatccaaacaacattgcaagggatttgattcgttgtggagaaatgaaaggaattcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcagatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagtaagttcacttatttttgtttctgttaattgatgattgataatacagctgtctcaattttgcagtcattgataacacattatatgatttgtgtttgccgttcaggggaccacaaggccgacccactatcatgttctcttagaccaggttgggttttcagctgatgatctgcaggagcttgttcattctctatcctacgtgtaagtacagaaacaagcgtacagaaacaacttatttttttacaaatagtttaagctgttttcactgtcacaatctttgtattctgtctgttgcaggtatcaaaggagcaccacagccatatctgttggtaagtataagtattgtttctgatctttgctttgggttttccgtttttgatgcataattttgtagtttcatttcttaagtgcattgtttctgatctttgctttgggttttccttttttgatgcagtggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatg

SEQ ID NO: 405 - DNA, 2805 bp, Gossypium raimondii
tctcagccttttagtatttagagggagagggagtgagctaaaaaagaagagaaagagggtcgtagaattttgctgtctctttgagttccttagggtttcttgtttcaatttttttttgttttttctctccggatttcagggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgggatgcctacttgttcgccaatctttctttcaagataatcagaacaacttcacagacattggaggaggtgtccttggctgtagaggtttccattcaagtttcagagccactcaaggaggcctttcactaaatatcgatgtatcaactaccatgataattcaacctggtccggtagttgattttttacttgcaaatcagaatgctagagatccttactctcttgactggaacaaggcaaaacgggtgctgaagaatctgaggattaaagttagtccgtctaatcaagagtacaagattactggcttgagtgaacaactgtgcaaggatcagttgttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgagctttgctctttggtgtctttgcaacgctacactaaggcactatccactttccaaagagcttccctggttgaaaaatcgaggcagaagcctcaagaaaggatgaatgttttgtctaatgttttacgtaccagtaattatggtgctgaaccaatgctgaaatcttgtggtgttaatataaactctaatttcacccaagtggatggacgtattctgccagcaccaaggttaagagtcggcaacggtgaagatttctttccaaggaatgggcgttggaattttaacaacaagaaattggtggagccatctaggattgaaagatgggctgttgtgaacttctcggctcctcgttgtgatccaaacaacattgcaagggatttgattcgttgtggagaaatgaaaggaattcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatgggccatggaagcggaagaatctttctgagtatggcatcgtgactcagtgtatggcaccagctagggtgaatgatcaataccttacaaatcttcttctgaagatcaatgctaagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtggttagctccaggcaatggccattgatttcccgctatagggcatcagtccgtacacagtctccgaagcttgaaatggtagattctcttttcaaaccagtttctgacaaagtggatgagggtatcatgagggaagctctcttagacttctatacaagttcagggaagaggaagcctgatcagatcattattttcagggatggggttagcgagtctcagttcaatcaagttttgaacaaagaacttgatcaagttattgaggcttgcaagttccttgacgagaattggaaccctaagtttgtggttattgttgcacaaaaaaaccatcataccaagtttttccagcagggatctcctgacaatgtgctacctggtactgtcattgacaacaaagtatgccatccgaagaacaatgatttttacctttgtgctcatgctggaatgatagggaccacaaggccgacccactatcatgttctcttagaccaggttgggttttcagctgatgatctgcaggagcttgttcattctctatcctacgtgtatcaaaggagcaccacagccatatctgttgtggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatg

SEQ ID NO: 406 - DNA, 3372 bp, Gossypium raimondii
aaaggtgtaaggcgcgatgtagaggagaaaaacattgtacttaacggagagaccaaaaagagtggcccttaaagtttttatattatttcactgtctttaatttttagtttttcgagtgagaggtaagtaaaaagagggagacacagacgggagccttgaacttcacatttctctttcatgttttagggtttctatccttgttttctctgtaaatttcagctgtcttcaagaatacgcttattttgctgcagatcgtctaatttctaggacatggactcgtttgagcaggatggaaatggggcggcacctgactctctgcctccacccccacctgtgcctcctgatgtggtgcctatcaaagcagaacctgaacctgcaaagaagaaggttgtgcgagtcccaatggccaggcgtggtcttggatctaaagggcagaagataactcttctcaccaatcacttcaaagtgaatgttggaagctctgatggacacttcttccattactgtgtttctctttattatgaagatggccgtccagttgatggcaagggtgttggaagaaaagtgatagagagggtgcaagagacctatggcaatgaattggctggaaaggactttgcttatgatggggagaaaagtttatttactgttggtgctcttccaaataacaagcatgagtttacagttgtacttgaggatgttacatctaacagaaacaacgggaatgcaagccctgatgtccacgatgactcaaatgggcaagacaggaagagaattaaacggccttatcagtcaaagacctttaaagtggagatcagctttgctgcaaagattcccatgcaagcgattcaaaatgctctgcgtggacaggaatcagaaaactcacaagaggccctaagggtgttggatatcattttacggcagcatgctgcaaaacagggatgtctactcgttcgccaatcattctttcaaaataatcctgataattttacagacattggaggtggtgtcctgggctgcaggggtttccattctagcttcagagcctctcaagggggcctttccctgaatattgatgtctcaactaccatgataattcgtcctggtcctgttgtggactttttgcttgccaatcagaatgctagagatccgtactccctggactggaccaaggctaaacgaagccttaagaacctgaggataaaggtcagtccatccaatcaggagtacaagatcactggattgagcgagcagttgtgcaaagatcagttgttttcattgaagcagaaaagcatgaagaatgataatggtgaagctgagaatctagagattactgtttatgattattttgtcaaccatcgcaacatacagttgcgctattctgcagacctgccatgcattaatgtcggaaagccaaaacggccgacatatattcctttggagctctgttccctggtgtctttgcaacgttacaccaaagcgctaaccactttccagagagcttctttggttgaaaaatcaagacagaagcctcaggaaagaatgacagtcttatccagtgctttacagaggagcaactatggtgctgagccaatgctgcgttcttgtggtatttctatcagcactaatttcacccaagtcgaaggtcgtgttctgccagcgccaaggttaaaagtggggaatggtgaagatttctttcctcggaacgggagatggaattttaataacaagaaattagtggagccaactaagattgaaagatgggctgttgtcaacttctctgcacgatgtgatacgaatagccttgtccgggatctgattagatgtggagacatgaaaggaattcggatagaccctccatttgatgtgttccaagagtccaatcagaacagacgttgctctcctttggttagagtcgagaaaatgtttgaggatatccaatctaaacttcctggagctccacagtttcttctttgtcttttacctgataggaaaaattctgatctttatggtccatggaagaagaagaatctttctgagtttggcatagtcactcagtgcatggctccaactagggtcaatgatcagtaccttacaaacctgcttctaaaaatcaatgcaaagcttggaggactgaattccatgctagcaattgagcaaacaccttcaattccagttgtttcaaaggttccaaccatcatccttggaatggatgtgtctcatggctctcctgggcagtccgatattccatcaattgctgcggtggtcagctccaggcagtggcctttgatttcccgctatagagcatctgttcgtacacaatctcctaagcttgaaatgatagattctctattcaaaaaagtgtctgacaaggaggatgaaggtatcatgagggaggttctcttggacttttatacaagttcaggaaagaggaagcctgatcaaattatcatattcagggatggagttagcgagtcacagttcaatcaagtattgaacattgaactggatcaagtaattgaggcttgcaaatttcttgatgagagttggaaccccaagtttgtggtcattgtggcacagaaaaaccatcatactaagtttttccagcagggatctcctgacaatgtcccgcctggaaccgttatagacaacaaaatctgtcatcctaagaacaatgacttctatctttgtgcccatgctggaatgattggaaccacgaggcctactcattatcatgttctcttagatcagattgggttttcggctgatgatctgcaggaactagtccactctctgtcgtatgtgtatcaaaggagcaccactgccatatctgtagttgctcctatttgctatgcacatttggcagccgcacaggtgggtacattcatgaagtttgaagatgcctcagagacaaactcgagtcatggtggagttaccgcacctggagccatttctgtccctcagctgccgaggttgaaggagaacgtctgcaattccatgttcttctgctgatcccccatgttttgtataggcttttggttgttaccaaaatgactgaaacgtttttaagttatatgaaagttaaaaaaagtagggttatcattgatgtggtggtggttgaaacatcaccccttttgggtgtttggccctgctgtttgtaggatctatgaaggtatgtttgactagcacttgttaaatggctttcgcctctgtaatacccgtaatcctgtttggtgataatcaatgcatagcctcagctatcgttaacttaaaacctgctttgtatgctgtggaacgtgggatatccatcatataagatgggatttgccctgagttgtatgaaaacagttataaatcaatgaaagcagagcc

SEQ ID NO: 407 - DNA, 3169 bp, Gossypium raimondii
cttggctttcaaaatttttcttcttgaaggaaaaaaaagaaaaagaaaataaaaactgtcttatttggctctcgaatccctcccattttccgccatggaagcaccttgagaaaccctaactggatccctttcacgttcttcgctaagctcaagcaaacggcaaatgggttctcttgtgcctttccaagacctcaatctctgcccggaaccaccgctaccagccaccgtgaacatctccacctccgccacacctagcgccaccatcaacaggacaaccaccttcaatttcttaacaccgaagattgaacctaagcaagagcctttcgacgaaccaacaccaacacagactattcaccaacaagaaaactttctcttctctgtttccaattctacccctgatttcatccctaatcccgaaactacccctccggctaacgcttcctcttcagccgatgaccaaaacgctctctactccgaatatttccgaatctccgagcttttccgctctgcttttgctaaaaggatacaaaaatacggcgatgtcgaagtacttgacccggattctcgggccatcgtacccgtacccgaacagtctcaactaacccccgaaactagcccaaccgacggttccaacctggaacgagctttatccgtcgtcgtttcgcgtaagaaggcgggaagatccaatgagctggttcgggttacgaatttgggaatcgatgaccagaggcattttcgtgaccttgttcgaagaacccgaatgatgtacgattccctccgcgttttagtcatttcggaggaagaaaagagaaccggaccgggaaacggtcgacgggctcgcggagatttgagggcagctgccgtcatgagggatcgagaactgtggttgaatcgcgataaaaggatagtgggtgcaatcccaggtattgaaattggtgatgtattcttctttagaatggagctttgtgtggtggggttacatggacaaattcaagctgggattgatacattgcctgctagccaaagctcgagcggagagccaattgcaactagcattattatttccggtgggtacgaggatgatgaagattccggtgactcgataatatataccggccaaggtgggcaagataaatttggaaagcaatgtatgcatcagaagcttgaaggagggaatttggcactagaaaggagtatgcattatgggattgaggtaagagtgattagagggtttaaatatgagaatcgagtttcgggcaaagtgtatgtttatgacggtttatataagattcttgattgttggtttgatgtgggaaagtcagggtttggggtttacaagtttaggttgtcgagaattgaagggcaacctgagatgggtagttcgataatgaagtttgctgagagtcttaggactaagcctttgtctactaggccaatggggtatttgactcttgatatttccatgaaaaaggagagagttccgatctttctttataatgatattgataatgatcatgatcctatgtattatgattaccttgtgaacactgtgttccctcttaatgtatttggtcaagggagtaatagtactggatgtgattgtgtttcggggtgcacggaagggtgtttctgtgctatgaagaatgggggtgattttgcttatgattatggtggaattctcttgagagggaaaccggtgatatttgaatgtggaaacttctgtcaatgcccaccatcttgtcggaaccgtgttgcacaacatgggcttagaaacagattggaaatatttaggtcaagggaaacgggttggggagtgaggtccttggacttgatacaagcaggtgcttttatatgtgaatatgcaggggttgttctcacaagggaccaagcggaagttttcaagatgaacggtgatactttgatttaccccaatcgtttttctgaacgatgggccgaatggggggatttgtctaggatatttccagagtacgtgtgtccatcatatccctcaatcccacctttggattttgcaatggatgtatcaaggatgaggaatgctgcttgttatattagccatagttccagtccgaatgtgctggtgcagtgtgtgttgtatgatcacaacaacttgatgttccctcaccttatgctttttgcaatggagaatatccctcctatgagagagcttagcatagattatggtgtagccgacgaatggactgggaagctttctatctgtaactaaatatcttaagaggaatattttggattttgatgtggtgcagccgggcagtgagacatgataaactgagtctagttgcctgccatgcctgtttgtaggagctaggaatgttattcctttgtgcaacttcatggtgtatacctcaagtagtcagccatatgcaggaggatggaacatttggcacttatagttctaaatgaatgcagttgcttatctcctaagtgcatgttttgttctccagagcaatgtactttctttttttttttgtaatatatatgttgttgtattagcccacatcttgtttcgccttccctgtccaactctactgtttatgtctgcctcaattctatgaatttattcttttcaattgttcctgctcgtaaattttaagtgccgtgatcaacaaagttgttatttggttagttcattattggattcttccttgactagccaaacaggtcattcggttttacaagagtttgtgacaaattgatttgtcatctgtaagggaggactttagctgaaggtagcctcataaagtttaaacaaaatttgagtgtttaaagcttcagtactgcttaagaaacatagggttttatgcaacagccttttccaccctgaataatgccattggcaatgtgctattgttactttgttttgattccttgtcctagaattttttgaatctctacaaagttattcatagattagaacaaatcttcatcagttgccttatgagtaaaatgccataggcttgtatctcatgtttatcataaactatctgtttaaaagccataggaacgtgcttatattcagatcttttcctgtttactaagttgatgctataattaaccacatatagtattagagattccacatgttctgttaatttggaaagtgagctgtcgtaaaacgtctgataccggg

SEQ ID NO: 408 - DNA, 2217 bp, Gossypium raimondii
atggtcattttttgtgaagaactgaatagactgaattcgatcgatcctttactcggaattactaatatggccaacgaattagcatttgatctgatctatggagttggtgacgagaaggatattttcgagctttcatatgctacatttgctgaagagttgcagctccaggagatcctgaaggagtccatgatgggttctgaaaaggagctggaagatgcagctagtgaagccaaccagaaacttgagtgtcttgtcagccatggattatccaacacggaatgtgctatctcccatgtctcagagattcatgagcctcagtcgttcaataaacaggggtcagcaagatggcgtccccagcagaggtttggttacattgagcaacagaggataaactgggatgacaaaggaagagaccgtttcaggtggaggaaacctacagggtggcacaacattaggggaagaagggtgggagatgttcctcaaaccagttccagcaaggaatttcatgcaaaaaccagttcctggggtgaaggcagtcctcttgttggcactggtaatattgaagatcctaagggtaaaggcaaagccatagatgatggctggttgctggtctccaaatggaaatccgaaagcaggggtggaaacagtgttgacaaacagcaggttgatctcgggcatcctaatcatttaaagggttcaaaagatgacgacacaagtgctgttcacgaagatgattgcgagtccttggatgatgaggatgactttgattccgatgatagtcaaaagagctacgagagtcgcaagaagagtaaatggtttaaggaattttttgagagaatggacgccttgaatgcagaggagattgatcaaaccctgtggcactgtccagcatgccaaggtggtccaggtgccatcaaatggtacagaagcattagtgacctgatagcacattccaaaaagattggatcgagaagggtgaagttacatcaagagctcgcgatgcttctagaaggggagttgtgcattaggggaacatcagtttctcctcctgctgacccaattgttggtacttggaaaggtttaaaagaggaggcaagagatcatcaagtagtttggcctcccatggttgtcattatgaacacaatgacaagcaattcaaaggatggaaagtttgttggcatgggaagtcatgagcttcttgagcacttcagctcgtttcctgctttaaaggctcaacattcctatggtcctcaaggtcaccgtggtttgagcgtcttgatctttgagagctcggcggtaggttatttagaagccgaacgactgcatcagaattttttggaccaaggattggataaatttgcttggaattcttgtacaaacgaagtcctgccaggaggagagcgccaactttatggtttcatggcagtgaaagaggacctggattgcttcaaccagcattgccaaggtaaatcaaagctcaaatatgagctcaaatcatatcaagaagcggttctgaatgaaatcaagaaaatgagggaggatagccagcaacttatccggctcaaggataagcttgaagaagaaataaaacgagcaaaaactcttgaaagatcagtcgatgatctaagtaggaacctgcaacagagaatgaaggacatctgcatatttgaacgaagggtcaaatcactgcatgaagataacaaagaagaggtggaatcccaggagatcttttataaggatcaaattaaaattctggaagcaagagtgaaagagcttgatcacaagttgaaggaatctggcgcaagtcctttacatacaggggaacctgaacctgccatgtccggcctattggaggaggagcacactccatatcagtacaacagcaacctcggcattgatgaagattcaagtttggagaatggaaagcttccaagcaaatccaatgaaaatggagattgaaaacattcaaaccaccagcttttaagactttactgcaactcataaagtaatatcagtgtaggattatatatccctgtggatgcgttgtagggttgggtgctatttgtttataagaaccaactattatttcataatttcttcatgataattacatgggtactttatgtttattaaaaaaaagtttttttgatacaatattgagggtaaggatgagaatcacatgatttaaattcgcatgttgtatcaaatggatatcca

SEQ ID NO: 409 - DNA, 2251 bp, Gossypium raimondii
aacatattattacaagtttaccctttttaatatatataattaaaaagaaacctcatttctagtttcccttgtctacatgcatctctcatgaatcacgcgagtattgattgtgtcagcgccgtgtccgattcgtgtttgatttctttcgttccgtttcccggcgtttcagacaccggtacgagggtttccagcattagtgctttaaagattggagaatgagttcgagaaaaggaggatcaaaagggaaagaggtatctggagtctctcgtcccaaggttgaccagctaagccatggtgtagcggaaatgaacatggattcttcacaagatgatggtgagtgggaagttattcaaagaaaacccaagaatacaggtggaagcagtggtgcaaagccatggggttctcaaaattccaaccctaaaccttggaatggaggcatgcggggtaatgctggacctggaagaggcaccggcggcaatgcttgggctaatcatggtgctgattctaggatagcaagtggccgagggaattcaaggccccaaatagtcaacaagagcttggacaaccaccaagtgccttccaatcctgtcattcgcccgcctcttgagcatggttggaattggcagtcaagaactggttccaatccatccaagggttttcaagatggatatgagaaagacaatgtcaacgctgaggctgaaaaagacaacgatgttgatgatattgaggatgattcggatgatgttgctgctgatgattctgacaatgagcttctaaccgatgaatttgattcagattcaagtcaaaagagccacgagacaagaaagaaaaatagatggtttaagaagttttttgatagtttagataagttgcgcgtggaagagatcaatgacccagcaaggcaatggcattgcccggcttgccaaggcggtcctggtgccattgactggtatcgaggccttcagccattagggacacatgcgaaaactaaaggatcaaaaagggtgaaactccatcgtgaacttgctgagctcttggatgaggaattgcgtagaaggggtacttcagttatccctgcaggtgaagcttttgggaaatggaggggtttaaaagatgacgaaaaagatcatgaaatagtctggccacctatggtaatcataatgaatacaaggcttcaacaagatgataatgataagtggattggtattgggaaccaagagctgcttgactatttcagctcatatgctgccgtgaaggctcgccattcatatggcccacaggggcatcgtgggatgagccttctgatttttgagagcacagcaagaggttatttagaagctgagcgtctgcataagcattttgctgagcaaggaacggatagagaggcttgggaacaccgtcaggtcttattttatccaggtgggacgcgccaactctatggttacatggcaaacaaggaagatctggacatcttcaaccaacattctcaaggaaaatctaagctcaaatttgagatgagatcttatcaagagatggttgttaatcaaatcaggcaaatgagcgaggccaaccaggagcttattttttacaagaacaagtttgctatacagcaaaggctcaaaactgcccttgaagagtcttttggtgttgtgagcgaaaagctccggaagacaatggaggagaacaggattgtgagacagagaaccaaaatgcagcacgaacagaacaaggaagagatggatttccaagaacaattcttcaaggaacaaatcaaatttattcatgaagcaagggatgaggaggaggagaagtttgagaagctacagcagcaacagcgtgagaagtttgtcaagcaatctactcctaatacttcaaatacagaggaatacaggcgtagggcggatgaaattgcaaaattcataaagctccaggacgaagagatggaagcttttgtgtctgagagggacaagctgattaccgtacacaaagagaagatggctgcaatgagacagaggcattggcaggaagaagttgagctcgaaaaggagtttgatacggaattgagccgtctcatggagaagtatactcctactatgcctggaatggacaaatatatatattaaaattgttttctacatagattaaatttgattaaaatatgggcgagacttctgagttcgattcaatagcatataaaacttaatattataataatataatactaaaatataaacattaaaaatatccgttg

SEQ ID NO: 410 - DNA, 1606 bp, Gossypium raimondii
aacatattattacaagtttaccctttttaatatatataattaaaaagaaacctcatttctagtttcccttgtctacatgcatctctcatgaatcacgcgagtattgattgtgtcagcgccgtgtccgattcgtgtttgatttctttcgttccgtttcccggcgtttcagacaccggtacgagggtttccagcattagtgctttaaagattggagaatgagttcgagaaaaggaggatcaaaagggaaagaggtatctggagtctctcgtcccaaggttgaccagctaagccatggtgtagcggaaatgaacatggattcttcacaagatgatggtgagtgggaagttattcaaagaaaacccaagaatacaggtggaagcagtggtgcaaagccatggggttctcaaaattccaaccctaaaccttggaatggaggcatgcggggtaatgctggacctggaagaggcaccggcggcaatgcttgggctaatcatggtgctgattctaggatagcaagtggccgagggaattcaaggccccaaatagtcaacaagagcttggacaaccaccaagtgccttccaatcctgtcattcgcccgcctcttgagcatggttggaattggcagtcaagaactggttccaatccatccaagggttttcaagatggatatgagaaagacaatgtcaacgctgaggctgaaaaagacaacgatgttgatgatattgaggatgattcggatgatgttgctgctgatgattctgacaatgagcttctaaccgatgaatttgattcagattcaagtcaaaagagccacgagacaagaaagaaaaatagatggtttaagaagttttttgatagtttagataagttgcgcgtggaagagatcaatgacccagcaaggcaatggcattgcccggcttgccaaggcggtcctggtgccattgactggtatcgaggccttcagccattagggacacatgcgaaaactaaaggatcaaaaagggtgaaactccatcgtgaacttgctgagctcttggatgaggaattgcgtagaaggggtacttcagttatccctgcaggtgaagcttttgggaaatggaggggtttaaaagatgacgaaaaagatcatgaaatagtctggccacctatggtaatcataatgaatacaaggcttcaacaagatgataatgataagtggattggtattgggaaccaagagctgcttgactatttcagctcatatgctgccgtgaaggctcgccattcatatggcccacaggggcatcgtgggatgagccttctgatttttgagagcacagcaagaggttatttagaagctgagcgtctgcataagcattttgctgagcaaggaacggatagagaggcttgggaacaccgtcaggtcttattttatccaggtgggacgcgccaactctatggttacatggcaaacaaggaagatctggacatcttcaaccaacattctcaaggaaaatctaagctcaaatttgagatgagatcttatcaagagatggttgttaatcaaatcaggcaaatgagcgagttcgattcaatagcatataaaacttaatattataataatat

SEQ ID NO: 411 - DNA, 2149 bp, Gossypium raimondii
aacatattattacaagtttaccctttttaatatatataattaaaaagaaacctcatttctagtttcccttgtctacatgcatctctcatgaatcacgcgagtattgattgtgtcagcgccgtgtccgattcgtgtttgatttctttcgttccgtttcccggcgtttcagacaccggtacgagggtttccagcattagtgctttaaagattggagaatgagttcgagaaaaggaggatcaaaagggaaagaggtatctggagtctctcgtcccaaggttgaccagctaagccatggtgtagcggaaatgaacatggattcttcacaagatgatggtgagtgggaagttattcaaagaaaacccaagaatacaggtggaagcagtggtgcaaagccatggggttctcaaaattccaaccctaaaccttggaatggaggcatgcggggtaatgctggacctggaagaggcaccggcggcaatgcttgggctaatcatggtgctgattctaggatagcaagtggccgagggaattcaaggccccaaatagtcaacaagagcttggacaaccaccaagtgccttccaatcctgtcattcgcccgcctcttgagcatggttggaattggcagtcaagaactggttccaatccatccaagggttttcaagatggatatgagaaagacaatgtcaacgctgaggctgaaaaagacaacgatgttgatgatattgaggatgattcggatgatgttgctgctgatgattctgacaatgagcttctaaccgatgaatttgattcagattcaagtcaaaagagccacgagacaagaaagaaaaatagatggtttaagaagttttttgatagtttagataagttgcgcgtggaagagatcaatgacccagcaaggcaatggcattgcccggcttgccaaggcggtcctggtgccattgactggtatcgaggccttcagccattagggacacatgcgaaaactaaaggatcaaaaagggtgaaactccatcgtgaacttgctgagctcttggatgaggaattgcgtagaaggggtacttcagttatccctgcaggtgaagcttttgggaaatggaggggtttaaaagatgacgaaaaagatcatgaaatagtctggccacctatggtaatcataatgaatacaaggcttcaacaagatgataatgataagtggattggtattgggaaccaagagctgcttgactatttcagctcatatgctgccgtgaaggctcgccattcatatggcccacaggggcatcgtgggatgagccttctgatttttgagagcacagcaagaggttatttagaagctgagcgtctgcataagcattttgctgagcaaggaacggatagagaggcttgggaacaccgtcaggtcttattttatccaggtgggacgcgccaactctatggttacatggcaaacaaggaagatctggacatcttcaaccaacattctcaaggttctctcctactgaagacaatggttatttgcatgcagggataaactgcgagataactttattgcacgaaaagtttctttattattttctgccgattcttatgcatttaattcacttgtgtgtaaatgttatgttgattaggaaaatctaagctcaaatttgagatgagatcttatcaagagatggttgttaatcaaatcaggcaaatgagcgaggccaaccaggagcttattttttacaagaacaagtttgctatacagcaaaggctcaaaactgcccttgaagagtcttttggtgttgtgagcgaaaagctccggaagacaatggaggagaacaggattgtgagacagagaaccaaaatgcagcacgaacagaacaaggaagaggtaattgttttagtttctgataatttacatctaaatgcagatgcaagctagtggctttcttcacagatttgttgctagatgtaatggttgtggcgtactaattactaatttataccatagaacataacttcattttagtaagttactggttgatcatatctttgcaaccatatttatcttaactagccagggatgaatatgaaaactttgctagtatctttatatgtttgctatgcttatacatctgtgatcttatttttggatataaaaat

SEQ ID NO: 412 - DNA, 2539 bp, Gossypium raimondii
tctcaacaatgcgcgtgcaacacaaatctccttcttgcactcagctatttttatggtcctcactctccattcacttctacaccactgccttttctctgcaggtatctccttctctctcgtggctcttacgattatcagtgatctaggactagaaagcgtttgaaagatcttaatggcagatgctactgattcatttcctgacttgcggagtgtgtataaaagttctggtcaccaagttaatcgcctaagtcagaatgtggcaaacatgaagctagcttctgcgcaagatggtgaaaaggagaactcattgggatccaataacaaaggtgctgaaaatgttgggtttcctcaagattctacccctaatgtatggggacatccgaatgtgattcagaaacttaggatgcaaggtaatcttggttcagaaaaggttactcacaaagcctggccaactcaaaatgctgtttctaggacgcaacaaggtgatagaacatggggaaatagtagtataaaatctccatcctcagagtatggaaggaatgaccctgatcaagctggttttactttctctaataattcttgggatggtcaaattaaaaccgaccatgaagtgggtgataagttggatgatgaaattggagataatgaaaatgttgatgatgaatatggtaatggtgtctctaatattgagtacgatagtgatgatatcgatgattatgtttccggttcagatgaagatgagaagagccatgaagcacgcaaggagagcaagtggttctattttttttttgaaagtttagagaaactgacagttgaggagattctttctccggttcggcggtggcactgtccagcatgtcaaggtgggccaggagccatcaactggtaccgaggtgtgcaacccttattgactcattccatgactaaaacaacacggagagctaagctgcatcgtgtatttgctggacttttggttgaggagatgcgcaggagaggagctttcattaaaccagtcaatgatgcatttggcaggtgggaagggctgactgatagagttgcagatcacgagatagtttggcctccaatggttatcattatgaatacaagatatgaacaggatgaaaacggcaagtggattggaatgggaaatcaagaacttctcaattacttcagctcgtatgctgcagtaaaagcaagacactcatatggtccacaagggcatcgggggatgagtcttctgatctttgagagctcagcagcgggatatttagagactgcacgcctgcataagcattttaaggagcaagggagggatagggatgcttgggattgttcacgggttccattctgtccaggtggcaagcgccaactctatggctacattgccatgaaagaagatctggatttatttaaccagcactctcaaggaaagtccaagctgaaatttgagacgaggtcatatcaagagatggttgagagtcagataaagaagataaatgatgatagtcagcagcttaacctacttaaaaagaaggttgctcaagagcagcagcactcacaagtccttgcagagtctctaggacgattgagtgagaagctgcgccagacgacagaggaatatggtatcatgaggcagcaaactagattgcagcatgagcagaacaaagaagagttgggcgccaaagaacagtattttaaggagaaaattaatgttatttaccaagccataaagttgaaggaagataattttgagaagctgcagagggcagcgagggagagagttgagcggtcaaatgcaactctgataaataatgaagatcagcacagtgctactgagttggaggaaaactcaaggtccataacaatccaggagaagaagatggaggaattcgaggcagagagggagaagctaatgaaaagtcatcaagatggaagattggcaatcacacagcggtactgggaagagctgattgagcttgaggaagggtttgaaaaagaattgaccctgcttatgggaaagtacaaccccgatcgcctcgaggaagagactactgacagccttgaaggacgagacaagagaggagcaagagatattgaaacagaatagacaacaatgatcctatttgtcgagggtaagaagcagcatattatgttttgggtaaaaggtatacaccagttttattaccaaagatacttcagttttggatatagagggctaaaagtgaagcctttctggatcggtacaaacattggaataatgaaacttcaagtgctttattattattattgaacatacatagctgaggattcttttgtgtttaagctgtcttgcaatgacaatttttgcagtggcatatatgtttgatgattcgatgtctgaatttccatgcaaaaagaaaacatttttgtttgctaagaaatcgacaaaaaaattggggtttctgcagatttgctctctctctctctctaatattttttcaacaagttaactaaatatagaaattgggttttgtccatgcagaaaacctgctaatattgt

SEQ ID NO: 413 - DNA, 2542 bp, Gossypium raimondii
tctgcaggtatctccttctctctcgtggctcttacgattatcagtgatctaggactagaaagcgtttgaaagatcttaatggcagatgctactgattcatttcctgacttgcggagtgtgtataaaagttctggtcaccaagttaatcgcctaagtcagaatgtggcaaacatgaagctagcttctgcgcaagatggtgaaaaggagaactcattgggatccaataacaaaggtgctgaaaatgttgggtttcctcaagattctacccctaatgtatggggacatccgaatgtgattcagaaacttaggatgcaaggtaatcttggttcagaaaaggttactcacaaagcctggccaactcaaaatgctgtttctaggacgcaacaaggtgatagaacatggggaaatagtagtataaaatctccatcctcagagtatggaaggaatgaccctgatcaagctggttttactttctctaataattcttgggatggtcaaattaaaaccgaccatgaagtgggtgataagttggatgatgaaattggagataatgaaaatgttgatgatgaatatggtaatggtgtctctaatattgagtacgatagtgatgatatcgatgattatgtttccggttcagatgaagatgagaagagccatgaagcacgcaaggagagcaagtggttctattttttttttgaaagtttagagaaactgacagttgaggagattctttctccggttcggcggtggcactgtccagcatgtcaaggtgggccaggagccatcaactggtaccgaggtgtgcaacccttattgactcattccatgactaaaacaacacggagagctaagctgcatcgtgtatttgctggacttttggttgaggagatgcgcaggagaggagctttcattaaaccagtcaatgatgcatttggcaggtgggaagggctgactgatagagttgcagatcacgagatagtttggcctccaatggttatcattatgaatacaagatatgaacaggatgaaaacggcaagtggattggaatgggaaatcaagaacttctcaattacttcagctcgtatgctgcagtaaaagcaagacactcatatggtccacaagggcatcgggggatgagtcttctgatctttgagagctcagcagcgggatatttagagactgcacgcctgcataagcattttaaggagcaagggagggatagggatgcttgggattgttcacgggttccattctgtccaggtggcaagcgccaactctatggctacattgccatgaaagaagatctggatttatttaaccagcactctcaaggaaagtccaagctgaaatttgagacgaggtcatatcaagagatggttgagagtcagataaagaagataaatgatgatagtcagcagcttaacctacttaaaaagaaggttgctcaagagcagcagcactcacaagtccttgcagagtctctaggacgattgagtgagaagctgcgccagacgacagaggaatatggtatcatgaggcagcaaactagattgcagcatgagcagaacaaagaagaggtagcatttttaaaactttgtattcctttacttttattgccaatcatggttgccaagttaggacaagaagggtgccctgggaccaccttctccatgtttcactatttggtaaaatggtgatcatactcagtggatgctattactgttgtcatgttgtttcttaataacttgtagggaggctgaacttaagttgggcgccaaagaacagtattttaaggagaaaattaatgttatttaccaagccataaagttgaaggaagataattttgagaagctgcagagggcagcgagggagagagttgagcggtcaaatgcaactctgataaataatgaagatcagcacagtgctactgagttggaggaaaactcaaggtccataacaatccaggagaagaagatggaggaattcgaggcagagagggagaagctaatgaaaagtcatcaagatggaagattggcaatcacacagcggtactgggaagagctgattgagcttgaggaagggtttgaaaaagaattgaccctgcttatgggaaagtacaaccccgatcgcctcgaggaagagactactgacagccttgaaggacgagacaagagaggagcaagagatattgaaacagaatagacaacaatgatcctatttgtcgagggtaagaagcagcatattatgttttgggtaaaaggtatacaccagttttattaccaaagatacttcagttttggatatagagggctaaaagtgaagcctttctggatcggtacaaacattggaataatgaaacttcaagtgctttattattattattgaacatacatagctgaggattcttttgtgtttaagctgtcttgcaatgacaatttttgcagtggcatatatgtttgatgattcgatgtctgaatttccatgcaaaaagaaaacatttttgtttgctaagaaatcgacaaaaaaattggggtttctgca

SEQ ID NO: 414 - DNA, 2333 bp, Gossypium raimondii
gttcttccttggaaaagaagagtaacgtttggtctagtacttttaatgttgggacgttttactgtggaaattaaaaccacatggatagcttttatgcatcattaatccctcaacaactgagcatatatgtgatatttcttgtatatgtactgatataactaagcttcttgttgtaagaaaatcaccaatcttttcattcaatacagtgatctaggagtagatttcatggcagatgctactgacccatttcctgacttgggaagcgtgtataaagtttccggtcgttgtcaagtaaaccgggatgtagctgacatcaagcttgcttcttcagtggatggaagggagtctaaaaaccgagttgctgcaaattccgggttacataaagattctacatctaatgtatggggacatccaaatttgattcagaaacttaagatgcaaactacttccaatgtcaggccaactgtggatggttcttgtttgagttcgagaagacatggtagtgcatcgacccaacaaggtgctggaacttgccctgttcaagctggtttcactttgcctaacagttcagaaaatagagttgatgaatatgataacaatgaccctgatgttgtgtatgataacgatgatttggatgactatgacttcgattttgatgaagacgagaagagtcatgaagcacgcaagaagagcaaatggttcaatgcattctttgaacgtttagagaaattgactgttgaggagatcatttcaccagctcagcaatggcactgccctgcatgtcaaggtggaccgggagccattgattggtatcgaggtgtacagcctctaatgactcattccatgactaaaatgacacggagagctaagatgcatcgtgtattcgcggaacttttggtcgaggagatgcgtaggagaggaactttcattaaaccggccaacgatgctgttggcaaatgggaagggcttaatgttagagttgcagatcatgaaatagtttggccaccaatggttatcattatgaatacaaaatatgaacaggacgaaaccggcaagtggagtgggatgggaaatcaagagcttctcaattacttcagctcatatgctgcgataaaagcgagacattcgtatggtccacaaggtcaccgcgggatgagtgtgttgatctttgagagttcagcagcagggtatttagaggctgttcgtttgcataaacattttaaagaacaaggaagggatagggatgcttgggatcattcacaggtcccattctgtcctggtggaaaacgccaactttacggctacattgccatcaaagaagacttggatgtatttaaccgacactctcaagggaattccaagctgaaattcgagctgagatcataccaagagatggttgagagccaaataaagaagataaacgacaatagtcagcaacttacccgacttaaaaagaaggttgctcaagaacagcaacattcacaagtccttgcagagtctctaggccgattgagtgagaagctccaccagacaatagagccgaaaaatcatatcgtgaggcaacgagctatattgcagcatgaacagaacaaagaagagttgatagctaaagaacaatatttcaaggagaaaatcaatactatttaccaatccatagactgtaaggaagataatttcgagaagctgcaaagggctgcaagtgagagagttaagcaatcaaatatgaatccgatacatgataaagatgaatgcagtgccattgagcttcatgagaaaaacataggagagttcaatgcagagagggagaagctgatgaaaagtcgtcaagatagaaggttaacaatcacactacggtattgggaagatcttgtcaagctcgaggaagggtttgaaaaagaatttaccttgcttatggaaaagtacacccacagaatattgcattgaggaacaatagaccactaaatagacaagacatgaacaagagataaggaaatagaagacacaataccaccatgaccattaccattggcacagtgaacagaagcaagacaaacacttgtttgataggtaaatataaaccagttttgttacttgatacacgtttaagttttggaaagagaaaaatggtttatgagggagggaagtttgggtttcatggtgaacactgaaatagtgaaacttcaagtaatgttttttatgcatttttgtttcagatttttggcatttgcccatggtattgtcaacttcaccataaattttttattgtgattttatttatacaataaaatctatactactatatatgtatacatcaaaaaatagttggaaaaagt

SEQ ID NO: 415 - DNA, 2088 bp, Gossypium raimondii
cgctcttcaaactctatcctgtgatctaggagtagatttcatggcagatgctactgacccatttcctgacttgggaagcgtgtataaagtttccggtcgttgtcaagtaaaccgggatgtagctgacatcaagcttgcttcttcagtggatggaagggagtctaaaaaccgagttgctgcaaattccgggttacataaagattctacatctaatgtatggggacatccaaatttgattcagaaacttaagatgcaaactacttccaatgtcaggccaactgtggatggttcttgtttgagttcgagaagacatggtagtgcatcgacccaacaaggtgctggaacttgccctgttcaagctggtttcactttgcctaacagttcagaaaatagagttgatgaatatgataacaatgaccctgatgttgtgtatgataacgatgatttggatgactatgacttcgattttgatgaagacgagaagagtcatgaagcacgcaagaagagcaaatggttcaatgcattctttgaacgtttagagaaattgactgttgaggagatcatttcaccagctcagcaatggcactgccctgcatgtcaaggtggaccgggagccattgattggtatcgaggtgtacagcctctaatgactcattccatgactaaaatgacacggagagctaagatgcatcgtgtattcgcggaacttttggtcgaggagatgcgtaggagaggaactttcattaaaccggccaacgatgctgttggcaaatgggaagggcttaatgttagagttgcagatcatgaaatagtttggccaccaatggttatcattatgaatacaaaatatgaacaggacgaaaccggcaagtggagtgggatgggaaatcaagagcttctcaattacttcagctcatatgctgcgataaaagcgagacattcgtatggtccacaaggtcaccgcgggatgagtgtgttgatctttgagagttcagcagcagggtatttagaggctgttcgtttgcataaacattttaaagaacaaggaagggatagggatgcttgggatcattcacaggtcccattctgtcctggtggaaaacgccaactttacggctacattgccatcaaagaagacttggatgtatttaaccgacactctcaagggaattccaagctgaaattcgagctgagatcataccaagagatggttgagagccaaataaagaagataaacgacaatagtcagcaacttacccgacttaaaaagaaggttgctcaagaacagcaacattcacaagtccttgcagagtctctaggccgattgagtgagaagctccaccagacaatagagccgaaaaatcatatcgtgaggcaacgagctatattgcagcatgaacagaacaaagaagagttgatagctaaagaacaatatttcaaggagaaaatcaatactatttaccaatccatagactgtaaggaagataatttcgagaagctgcaaagggctgcaagtgagagagttaagcaatcaaatatgaatccgatacatgataaagatgaatgcagtgccattgagcttcatgagaaaaacataggagagttcaatgcagagagggagaagctgatgaaaagtcgtcaagatagaaggttaacaatcacactacggtattgggaagatcttgtcaagctcgaggaagggtttgaaaaagaatttaccttgcttatggaaaagtacacccacagaatattgcattgaggaacaatagaccactaaatagacaagacatgaacaagagataaggaaatagaagacacaataccaccatgaccattaccattggcacagtgaacagaagcaagacaaacacttgtttgataggtaaatataaaccagttttgttacttgatacacgtttaagttttggaaagagaaaaatggtttatgagggagggaagtttgggtttcatggtgaacactgaaatagtgaaacttcaagtaatgttttttatgcatttttgtttcagatttttggcatttgcccatggtattgtcaacttcaccataaattttttattgtgatttta

SEQ ID NO: 416 - DNA, 2268 bp, Gossypium raimondii
tgtactactaaatgtcgattttatgacatcttactataggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcctaaaatagtatgttaaaagattggaatatatgggtaaaaaaaagttaaatctaaagttgcatctatggtttattatgcttgtgttgtttgcttagacatggttcaaataagaacttggaatgaatctacgatttctttcctaatatgttgcaa

SEQ ID NO: 417 - DNA, 2778 bp, Gossypium raimondii
atgctttccagatactagctaacccaaaaactttcctgctcatttcattttccaagccgacactcactctccactctcatactgtcgctactctgctctactccacaaccctgtctcgccttaccggccccgcacctccacacgctctatgcttacactgcgccccctgcgtctaccctattattagaggtaaatttattggcttttcactgtttttgtgaggtaaccctagttttttttttcttagatgtggggtaaattattttctgagtttcttaattatattgcttggttttttatttaacggtttctctgtctcattatggcattgttgttgttattgttgccgctgcagttcgtgctatcatttttgctgttgctctcatttttttttacaggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggctcggtacgagggctgaaaatttttgggg

SEQ ID NO: 418 - DNA, 2727 bp, Gossypium raimondii
caaatttatatttattatcaattcaacacccgtcgatgttattggtgatacaaatgaaatgacgcttaaaatgctttccagatactagctaacccaaaaactttcctgctcatttcattttccaagccgacactcactctccactctcatactgtcgctactctgctctactccacaaccctgtctcgccttaccggccccgcacctccacacgctctatgcttacactgcgccccctgcgtctaccctattattagagttcgtgctatcatttttgctgttgctctcatttttttttacaggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggctcggtacgagggctgaaaatttttgggggtgtagctaactgtcagagtttcgaaaaatattgttttttgcacg

SEQ ID NO: 419 - DNA, 3056 bp, Gossypium raimondii
gatgttattggtgatacaaatgaaatgacgcttaaaatgctttccagatactagctaacccaaaaactttcctgctcatttcattttccaagccgacactcactctccactctcatactgtcgctactctgctctactccacaaccctgtctcgccttaccggccccgcacctccacacgctctatgcttacactgcgccccctgcgtctaccctattattagaggttagccatgtttttcgtgttaatcttgtcatgccctgccatacccatacctaagagttctaacttcaaacagactggcgttgtcaatgatgtattgtggcgtgtagtttgtcttgtttctgtctaaaatttgacatgtttaaaatttcgtgccatgttcatgttttagacttttagttatttcaatcatgtttgagttgagatataacacggatacaccgattgctagctctattttgaggccaacccagtgcattgtgtaaatgttttgatctttgcaagtaaaggttgactgaaatatccttcgtaaggcaacagctttgacgattagggtatagtgatcgtacaaccaatttatagcttgagacacttgctgacaacaccatctacaggcattttcatagttagttgttgtcgatcttgtttatttttaagactatgtactactaaatgtcgattttatgacatcttactataggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggct

SEQ ID NO: 420 - DNA, 2650 bp, Gossypium raimondii
gatgttattggtgatacaaatgaaatgacgcttaaaatgctttccagatactagctaacccaaaaactttcctgctcatttcattttccaagccgacactcactctccactctcatactgtcgctactctgctctactccacaaccctgtctcgccttaccggccccgcacctccacacgctctatgcttacactgcgccccctgcgtctaccctattattagaggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggctcggtacgagggctgaaaatttttgggggtgtagctaactgtcagagtttcgaaaaatattgttttttgcacg

SEQ ID NO: 421 - DNA, 3023 bp, Gossypium raimondii
attatattgcttggttttttatttaacggtttctctgtctcattatggcattgttgttgttattgttgccgctgcagttcgtgctatcatttttgctgttgctctcatttttttttacaggttagccatgtttttcgtgttaatcttgtcatgccctgccatacccatacctaagagttctaacttcaaacagactggcgttgtcaatgatgtattgtggcgtgtagtttgtcttgtttctgtctaaaatttgacatgtttaaaatttcgtgccatgttcatgttttagacttttagttatttcaatcatgtttgagttgagatataacacggatacaccgattgctagctctattttgaggccaacccagtgcattgtgtaaatgttttgatctttgcaagtaaaggttgactgaaatatccttcgtaaggcaacagctttgacgattagggtatagtgatcgtacaaccaatttatagcttgagacacttgctgacaacaccatctacaggcattttcatagttagttgttgtcgatcttgtttatttttaagactatgtactactaaatgtcgattttatgacatcttactataggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggctcggtacgagggctgaaaatttttgggggtgtagctaactgtcagagtttcgaaaaatattgttttttgcacg

SEQ ID NO: 422 - DNA, 4385 bp, Gossypium raimondii
aaagcgggaaatggaaacaacttctccagcaagtagtaagaaaaaaaaaaaaaaaagggggggagggggaagacctgaactggagactaaagttctttgtctttctcctaaacaacttcttcgtgaagtgcttaagaatcaagacacgataaaagcacacttgtttatatactgggtccatccctctaactctaagctcactccctaaaactcacaaatactttgctttctctttctctcactcctactctgcaaacgcgttcaaagttgcttctcttcttgtgtcaaaccaatacgctttcagttttgtttcaggaacttattggctttcaacccgaactggttaattttctgaaatatatggagttagaagggagtgtaaaggagactgtggtgacacaagttagtgttggtggatttgaccgacatgtcaaagccagagatctgatgaagtacttggagaatgcagttggcgttgtctggaggtgtagactgaagacctcatggacaccaccagaatcgtatcctaatttcgaaattactgacacttctgttatccaaagaaaagataactataagaaggtggagccccatgcctttgttcattttgcttcaccggaagcagtgacttgggctgtggatgctgcaggtcgtactgagcttgctttcaacaatcagctgttgaaggttagtttggggcctgagaatccttattacttgaatcgacggaggagggacacagcaccctttatgctacctgatgtctccctggagattggagcactggctagttgcgatgaattctttgttggctggagaggacctccttctggtgttgagtttcttgtggatccatttgattgtacctgcaaattttgtttctccagagatacagccttctcgttcaaaggcacaaatgagcgtgctgtcataaagtgtgactttaaggttgaatttctggttagggagatcaatgaagttaagcagtattcagaacagacgggttttgtagtgctcttgcagctggcttcgtcaccttgggtctggtatagaactgctgatgacgactttgaaaaatcagttccatttgatctgttggatgatgatgatcagtggatccggaccactgattttactgcaagtggagctatcggtcgttgtaatacatacagagtcctagtccgtcctcgtcatggtttaaagctgaagaaggccatgtattatctcagagaacgaagagtaccagtgaaagatctcagatcacaacttaggatctgtgatgaaccttattttgggaggtccatgtctgatcacttctattatacttacaaggaagggattccttttgaaataatgtttttggttaatgctgtactgcataaaggcatatttaatcagcatcagctatcaatggacttctttaagctactgagaaatcaatcaatggaggtcaatgtggctgcactaaggcacatctattcctctaggcatccagtgtatgatgcctataagaggctgaaagatgttcatgattggctgttgaagaatcccaaactctttaggagccctccgcagttggatgatattgttgaaatcagaagattggtcattaccccaaccaaagcttattgtcttcttccggaagttgagctttctaatagggttctcaggaaatataaagatgttgctgatcggtttttaagggtcacatttatggatgaaggcatgcagacaatgaatgcaaatgtgctcacttactataatgccgcaattgtaagggatgtgacgtctacctctttttctcagaaaacgggagtattcaaaagggtaaagtctattctaacagatggattttacttgtgtggtcgcaaatactctttccttgctttctcagccaatcaattgagagaccgctctgcatggtttttcgctgaagatgggaagataaatgtgcttcaaattataggttggatggggaagtttgcaaaccggaatattgctaaatgtgctgccaggatgggtcagtgcttctcgtcaacgtacgcaacagtggaagttccttcaggacaggttaacatgcaccttccagatatacagaggaatggatatgatttctctgatgggattggcaagatcactcccgatcttgcaatggaagttgctcagaaattgaagctggacttgaatcctccttgcgcttatcaaattagatatgctggttgtaaaggggtcgtggcttgttggccggaagaaggtgatgggatccgtctttctttacggtccagtatgattaagttcttttctcaccacacaacactggaaatctgttcttggacaagatttcagcctggcttcctgaataggcaaattattacattgctttcaacactaggtgtgcctgacaaagtattttggggaatgcaaaagtccatggtttctaagttggacaaagtccttgtggacactgatgcagcatttgaagtcgttatttcatcatgtggtgagcaagggcatactccagcaataatgttgagtgcaggtttcaagcctcaaacagaacctcatttacgaggaatgttgacttgtgtgagagcatctcaactttggggccttagggaaaaatctaggatttttattcattcaggcagatggttaatgggcgttttggatgaactaggtgtacttgaacaaggtcagtgctttatccaagtgtcaaatccatctctacaaaactgcttccttaaacatggttctaggtttgctgaaacaaagaaaaattttgaagtaattaaggggctggttgtcatagctaagaatccttgtcttcaccctggagatgtaagaattctagaagcagttgatgcccctggtttacaccatttgtatgactgtctggtcttccctcaaaagggtgagagaccccatacgaatgaagcttctggaagtgatcttgatggggacctttattttgtcacatgggaagaggctcttatcccccctagcaagaaaagctcacaacccatgcagtataaccctgatgagcctcgggagttgcatcgcccagtcactcataaggacataattgagtttttttcaaaaaacatggtgaatgagcacctgggaagtatctgcaatgcacatgtggttcattctgaccttagtgaccatggtgcttcagatgagaaatgtatacatctcgcagagttagcggctatagctgttgattttcctaaaaccgggaagattgtgtcgatgcctgctcacttaaaaccacaactttacccagattttatgggtaaagaggagttccagtcatacaagtcaaacaaaattctgggaagactatatcgtgatatcaaagatgcgtatgacgaagatgtctctgaatcttctgggctcaatttttgtgctagtgacatcaattatgatgcagatcttgaaattacaggatccgctgactacatagctgatgcatgggctaaaaagtgctcctatgacgggcagctgattggactacttaaacagtacaaagttaagagggaagaggaggtcgtaactggccaaatctggtccatgcccaaatatgccagtaagaaactaggggatttgaaggagaagcttggtcattcttatggttccctcaggaaagaattcagacaactttttgagaacatggattccgactttgagcagctcaatgaggatgagaagaacaagttgtatgaaagaaaggcttcagcatggtaccaggtcacttaccatcctgaatgggttcagaagacgttagagttccagaagcctgatggtgatgaaggtgttgtgatgttaagctttgcttggattgctgctgattacctagctcgaataaaagttaggcaccagggcactgaaaatcttgactttgctaagcctgtcaactctctagtaaggtacctagccgatcgaatataaccagtatttgactgttttggcagcaaattcatttgctggatccggcttcttggtcgcaaagccactctgccattttgaaagataagttgtaatgttggtttgtaatgcagtacatctctcttgttaccctattgttgctatgacctattgtgattgttcaaagatgattttccatgctttgtatgaaagtaatatttttcaattttcttgctttgcttgaatataatcatggtcttgtctcagtaaatggattagcaagtggttttggtccctccagtataaccgttgctcattgtaagttctgcttattgtgatccttcaaaggctatggatcaagaggctgccctgcctgtctcaatcattattgaccctttcttttggtcttaagtttcatttttacatgctttgttctatttaggttctttattatcgat

SEQ ID NO: 423 - DNA, 3785 bp, Gossypium raimondii
gctaaaggcaactctaattccaaaggataaaaaaccttggcccaagttaaataatcataaaacttcagtgaaagcagaaaaggtgaaaggaaaaaaagggtgtaaaccaccgcgccactagccggcagtagtagactgaaaccgaggcaaaagcaaacactggaaggcaaagcaaaaccttgtgagagaagagaggtgatggatggtacggagatagagagacccacattacggctcaccaacataccccaaaccgccgttgccaaagatctcttagacttcttcgagtccaagctcggccctgattcggtcttcgccattgagatctctaccgaccgcaacaactggaagtctcgtggttttggcagagtgcagttcgctgctccccaagctaagtccgatgcccttcgtctctcccgccacgatcacctccttttcaagtcccattctcttaaactctctcgaacttatgatgacatcatccccagacccatcagggccgatcataggcttgatggtggagtccttcatgcgggttttatgtctagtgatgattgcttgcgtgtcttggagcgctgggagggtgtgagaggttggataatgcccgagagaaggagattggaattttgggtatggaccgatggagagtgttacaagcttgattttctgtttgatgatatttttgagactgttggctgctgcttcgatggctctgcatgcaatgctcttctcttgagggttaggtatgctccaaggatatatcagaaagtatctgggccgaatgtggcttcaaaattcagtacggatcggtatcatatatgcaaggagaagtttgacttcctttgggttcgaacaacagatttttcaaggataaaatcgattgggcaatcgacttcgttttattgggaatttaatgcaggattttcaatctcggatatgtctacatatctcccgtgttatagagaagacatccaatctccatctttagaggccagaagagaattctcatctccatcagaaattgttccgcttgtaaagttcccatcagattccaagttagcatatgagatcctttttcagctcaatgcccttgttcatactcaaaaaattagcattgctgcagtggacactgatctgattggtatcctcagtggtttgcctgtcgaaactgctgtaatgattctgcagaagcttcgcctgctgcagtccccttgctataatcccgtttcatttgtgaaagcaaaattacctacaggaaaaaactaccgaattcctttatctgtttctgaaaggttaaaaaatcacaatgtcatgagctgtcgtagagccctaattacgcctacaaagatttattgcttgggtcccgagcttgaaacagctaattatgtggtaaagaactttgcagaatatgcttcatattttatgagagtcacttttgttgaagaagattggagtaagctttctgcaaatgccatttctactggtgtgcatctgggtgttttttctagacctttcaaaacaaaaatatatgacaggatattgtatgttcttcagaatggaattgttatcggagataagcgattcgagtttctggcattttctgctagtcagcttcgatcgaattctgtctggatgtttgcgtctaatgatgaggttaaagcagaagatattagagaatggatgggatgcttcaagaagatacgtagcatatctaagtgtgcttcaagaatgggtcaattgtttagttcctcgatgccgactcttgttgtccctgtgcaggatgtggagattattgatgatattgaagttaaaactgatggcattaattattgcttctctgatggtatagggaaaatttctctgccttttgctagacaagttgctgagaagtgtggattgaatcacattccatcagcatttcaaataagatatggtggttacaaaggtgtcgttgctgttgaccgtaactccttttggaagatgtctctgcgtgatagcatgctaaagtttgaatctaaagtcaggatgcttaatgtcaccaaatggagtgaatccatgccttgctttttgaatcgagaaattgttactctcttctccaccttgggcatcaaggatgaagtttttgagagaatgcaagaggaacaactgtgtctgcttggcaaaatgctaacaaatagagaagcagctttggataccttacaaagtttaggtggagttaattccaagaacattctggttgaaatgcttcagttttatgagccaaatgtccaaccttacctctcaatgatgcttcaagcacattatgagaatctactgtctgatctaaaaagcaggtgccgtatatttgttccaaagggacggatcttaattggttgtttggacgaaactggtacactgaattatgatcaagtttatctctgcataaaaatgaaaaaagcagaactagaatgtgcagaccaaagttacttccgtaaggtggatgaggaaacagctatagttataggaaaggtggttgtcacaaaaaatccttgccttcaccccggggatgtcagagtccttgaggctgtttatgaaccccaactagaagagaagggtttggtggattgccttgttttcccccagaaaggtgaaaggccgcatccaaatgaatgctcgggtggtgatcttgatggggaccagtttttcattagctgggacaaagatctcatcccatgtcaaactgagccgccaatggactacactggacgaagacctcggataatggatcatgaggtgaccttggaggaaattcagaagttttttgttgactacatgatcaacgatactttgggtgccatttctactgcacatctagtgcatgctgatcgtgaaccagacaaagcgtgcagtgaaaactgtctagcattggctactcttcactctatggctgttgattttgccaagacaggcgcaccggctgagatgcctcgtgctctgaaaccaagggagtttccggacttcatgcaaaggggaaacaaacccatgtatacttcctctggtgtactaggaaaactgtaccgtgctacaatcaactccacagtgcaaacaaggtcaaagtttgtttggacaaaagagatggccgagttagtttatgatcatgacctggaagtaaatggctttgagtcgctgatatcagttgcagagacccataaagagatgtatgaagagagaatgagcttattgatgagttattatgatgtagagtatgaggacgagatcctgacaggtaacatatacaacaaagcacagtttttgctgcgagacaaccggagatatggagaaatgaaggaacgaatcgtgttgtctgtcaaggacctacagagagaagctaaagaatggtttaagagtagctgcagcaaggctgatgagcatcaaaaacttgcctcagcatggtattatgtgacttaccacccgaattacttccaggaaaggatgaattccttgagctttccatggattgttggagacattttactgagggttaaatctcggaataagtttttgaatagccgagaaattcagagaaaccgaccgaaattcgataatgtctacattaagtccccaagaaggcatacttcaggtgatgaatcatccatggaatgaccaaatttaataatattctcctgtgaatgtaaactgctgtctcgctaatttgaaatgatttgaaaggatatgggtagggaaaatcaaggtatttaaaatttaagaactacaattttatttttatttttatttaatatataatt

SEQ ID NO: 424 - DNA, 4100 bp, Gossypium raimondii
ccaaaacaaacccacatgtcaattttcattgctgtttgttcttcgtctgatcgtctccgcccaattttttttttttttaaaaactcccccctaaaactcaagacttcactcctttgagactgaaacactgggaaaacccactgaaatttgatgcacattgctttacagaggctgtaaaacccttagaaatcactgaattttcacatctaagcaccgagaagattagggtttagggggggttttgttcttaatttctccttcctctccacaaactttcaatattttggtgcaatgggggcttcgccagatggaaagggaaacgggggaatgggcagtactagtggtgaaaagtttgcaaatggaactgatttgaatatggatatagatgaagatgatgatgtgtttgatgagctggtcagtgtgcaagagctgggagaagagtttttgaggaatttctgtaggaaagctgccgtgtctttcttcaatcagtatggtctagtaagtcatcaaataaactcttacaatgatttcataaaatacggtctccagaacaccttcgactcctttggggagtttgttattcattctggttatgatccatcgaagaagggagaaggtgactggcgtcatgccagagtgaagtttgggaaagtcaccgttgagaggccaaccttttgggctgtcacaggtggcaatgagctcaacatgcttcctaggcatgcccgccttcagaacatgacttactcatccaggatgaaggttactgttgagcttcaggtatatacagcaaaaagtgtaaagagtgacaagtttaaaactggaagagaagaaattgttgaagaggagatcgtgcatcaagataacagggagattataattggaaggatccctgtgatggttaagtctgagctgtgctggatgaatgaggttgaaaagtctgattgtgattttgatcacggaggttattttctcatcaagggcgcagagaagatattcattgcacaagagcaaatctctctgaagaggctctggatttcaaacatacagggctggactgttgcctacaggtcggaggtgaagagaaataggctaattatcagactagtggagaattccaaagtagaatatatcaaagggggggagaaaatcctgactgttttcttcttgtcgattgagatccccgtttggattttattttttgcccttggtgtacgatcagacaaggaagttgtaagtctgattgattatggaagcagtgattcaagtatatcaaacatactgttcgcgtcgattcgtgatgctgattggaaatgccgcaattttcgtgaagaaagtgctgctctcaaccatttggataggttacgcaaagaaactagatttccccccgaagaaagtgttgaagagtgccttggaaagtatctgtttccctctctcaaaggattcaagcagaaggctcggttcttggggtacatggtcaagagtcttttgcaagcattcaccggtcatcgaaaatgtgacaatagagatgattttaggaacaagaggttggagttggccggtgagctgcttgagcgtgagatgaaagttcatattgcccatgcaaggagacgtatggcaaagactctgcagagggatctttatgcggatcgtactgttcgtccaattgagcattatcttgatgcttccatagttacaaatgggctctctagagcattttctactggagcttggtctcatccttacaaaaagatggaaaggatatcaggtgtagtggcaaatctcggacgagcaaatccattgcagacaatggttgatttgagaaaaacacgacagcaggttcagtacactggaaaggtcggagatgcgagatacccacatccttctcattggggaaaagtttgctttctctctactcctgatggtgaaaattgtgggcttgttaagaatctggctaccactgctcttgtgagtacgaacatagtgaaatccgtagtggaatccatagtcgacacgttgtttgattctggaatggagaaagtggttaatgatacttcaagctcacttgatgggaaagataaggtctttctgaatggggaatgggttggtgtttgtgaagattctcttttctttgccgctgaacttagaagaaaacgacgcaggaaagaattgccgtatcaggtggaaattaaaagagatgagcataaaggagaggtgcggatctttactgatgctgggaggattctacgcccgcttttagttgttgaaaatctgttcaaactaaaagcattcaagggcaaggaaaattatgctttccagccccttttagacaaggggattgttgaactcattggagctgaagaggaagaagattgtcgcacggcatggggtatcaggtacctcttaaccgaagttgaggggaagcaacctgtcaagtacacgcattgtgagctggacatgtcatttcttttgggtttaagctgtggaatcattccatttgccaatcatgatcatgcgcggagggttctttaccaagcccagaagcattctcagcaggcaattgggttctctacaacgaacccaaacatcagggtggacactttgtcgcaccagatgtattatccccaaaggccactcttccatacgatgactgctgattgtcttggtaaatctggatttcctcttggtcagaatagattggaaccgaagccagaactctacaatggccagaatgctattgtggctgtaaatgttcatctcggttacaaccaagaggattccttggtaatgaaccgggcctcgatagagcgtgggatgttccgcaccgaacatgtaagaagttacaaagctgaagtagataacaaggaaatccaggagaagaggcggaaggctgaagatattgtaaactttggaaaaacagaaagtaagattggacgggtggacagccttgatgatgatggttttccttatatcggtgcttccctgcagtctggtgacattgtcattgggaggtttgcggaatctggagctgatcatggtgtaaaactgaagcacaccgaaagaggcatggttcagaaagttgtgttatcttcaaatgatgatgggaaaaattttgctgtggtgtctctgagacaggttcgttctccctgtcttggagacaagttctcaagcatgcatgggcaaaagggggtccttggttttctggagtctcatgagaactttcctttcacaactcaaggaatagttcctgatatcgtgattaacccacatgcatttccttcacgacaaacgccaggtcaactcttggaggctgccttgggaaaggggatcgcctgtggtgggtcgaagaaacatgccacccctttctccactctctccatagatgccattacagaacagcttcacagggctgggttttcaagatggggaaatgagagagtttacaatggtcggactggtgagatggttcggtcactcatatttatgggtccaacattctatcagcgtcttgtccacatggctgaagacaaagtgaaatttcgtaacactggacctgtgcacccacttacaaggcagccagttgcagaccggaaacgttatggcgggatcaaatttggtgagatggagcgggactgccttattgctcatggtgcatcagccaacttgcatgagcgcctcttcacgcttagcgattgctcacagatgcatgtatgtcagaattgcaaaaatgctgcaaatgttattgaacggaccgtagcagctggtcggaagattaggggaccctattgccgggtttgccagtcaggggatgagattgtgaaggttagtgtgccgtatggtgccaagttactgtgccaggaactattcagcatggggattagtctgaaatttgagacacagctttgttgagttagctgctaaactctttatcaactgttataacttctaatcgcaaatacttgggttcttttggttgaatgatgatgtaaatattagcaatcgaagttattgcagaatttaacttgtcaattgccttgcctttaatacttattatgcctctttaacacaatcccttggtctgattttaaaaatcaatttaattt

SEQ ID NO: 425 - DNA, 3545 bp, Gossypium raimondii
actcaagacttcactcctttgagactgaaacactgggaaaacccactgaaatttgatgcacattgctttacagaggctgtaaaacccttagaaatcactgaattttcacatctaagcaccgagaagattagggtttagggggggttttgttcttaatttctccttcctctccacaaactttcaatattttggtgcaatgggggcttcgccagatggaaagggaaacgggggaatgggcagtactagtggtgaaaagtttgcaaatggaactgatttgaatatggatatagatgaagatgatgatgtgtttgatgagctggtcagtgtgcaagagctgggagaagagtttttgaggaatttctgtaggaaagctgccgtgtctttcttcaatcagtatggtctagtaagtcatcaaataaactcttacaatgatttcataaaatacggtctccagaacaccttcgactcctttggggagtttgttattcattctggttatgatccatcgaagaagggagaaggtgactggcgtcatgccagagtgaagtttgggaaagtcaccgttgagaggccaaccttttgggctgtcacaggtggcaatgagctcaacatgcttcctaggcatgcccgccttcagaacatgacttactcatccaggatgaaggttactgttgagcttcaggtatatacagcaaaaagtgtaaagagtgacaagtttaaaactggaagagaagaaattgttgaagaggagatcgtgcatcaagataacagggagattataattggaaggatccctgtgatggttaagtctgagctgtgctggatgaatgaggttgaaaagtctgattgtgattttgatcacggaggttattttctcatcaagggcgcagagaagatattcattgcacaagagcaaatctctctgaagaggctctggatttcaaacatacagggctggactgttgcctacaggtcggaggtgaagagaaataggctaattatcagactagtggagaattccaaagtagaatatatcaaagggggggagaaaatcctgactgttttcttcttgtcgattgagatccccgtttggattttattttttgcccttggtgtacgatcagacaaggaagttgtaagtctgattgattatggaagcagtgattcaagtatatcaaacatactgttcgcgtcgattcgtgatgctgattggaaatgccgcaattttcgtgaagaaagtgctgctctcaaccatttggataggttacgcaaagaaactagatttccccccgaagaaagtgttgaagagtgccttggaaagtatctgtttccctctctcaaaggattcaagcagaaggctcggttcttggggtacatggtcaagagtcttttgcaagcattcaccggtcatcgaaaatgtgacaatagagatgattttaggaacaagaggttggagttggccggtgagctgcttgagcgtgagatgaaagttcatattgcccatgcaaggagacgtatggcaaagactctgcagagggatctttatgcggatcgtactgttcgtccaattgagcattatcttgatgcttccatagttacaaatgggctctctagagcattttctactggagcttggtctcatccttacaaaaagatggaaaggatatcaggtgtagtggcaaatctcggacgagcaaatccattgcagacaatggttgatttgagaaaaacacgacagcaggttcagtacactggaaaggtcggagatgcgagatacccacatccttctcattggggaaaagtttgctttctctctactcctgatggtgaaaattgtgggcttgttaagaatctggctaccactgctcttgtgagtacgaacatagtgaaatccgtagtggaatccatagtcgacacgttgtttgattctggaatggagaaagtggttaatgatacttcaagctcacttgatgggaaagataaggtctttctgaatggggaatgggttggtgtttgtgaagattctcttttctttgccgctgaacttagaagaaaacgacgcaggaaagaattgccgtatcaggtggaaattaaaagagatgagcataaaggagaggtgcggatctttactgatgctgggaggattctacgcccgcttttagttgttgaaaatctgttcaaactaaaagcattcaagggcaaggaaaattatgctttccagccccttttagacaaggggattgttgaactcattggagctgaagaggaagaagattgtcgcacggcatggggtatcaggtacctcttaaccgaagttgaggggaagcaacctgtcaagtacacgcattgtgagctggacatgtcatttcttttgggtttaagctgtggaatcattccatttgccaatcatgatcatgcgcggagggttctttaccaagcccagaagcattctcagcaggcaattgggttctctacaacgaacccaaacatcagggtggacactttgtcgcaccagatgtattatccccaaaggccactcttccatacgatgactgctgattgtcttggtaaatctggatttcctcttggtcagaatagattggaaccgaagccagaactctacaatggccagaatgctattgtggctgtaaatgttcatctcggttacaaccaagaggattccttggtaatgaaccgggcctcgatagagcgtgggatgttccgcaccgaacatgtaagaagttacaaagctgaagtagataacaaggaaatccaggagaagaggcggaaggctgaagatattgtaaactttggaaaaacagaaagtaagattggacgggtggacagccttgatgatgatggttttccttatatcggtgcttccctgcagtctggtgacattgtcattgggaggtttgcggaatctggagctgatcatggtgtaaaactgaagcacaccgaaagaggcatggttcagaaagttgtgttatcttcaaatgatgatgggaaaaattttgctgtggtgtctctgagacaggttcgttctccctgtcttggagacaagttctcaagcatgcatgggcaaaagggggtccttggttttctggagtctcatgagaactttcctttcacaactcaaggaatagttcctgatatcgtgattaacccacatgcatttccttcacgacaaacgccaggtcaactcttggaggctgccttgggaaaggggatcgcctgtggtgggtcgaagaaacatgccacccctttctccactctctccatagatgccattacagaacagcttcacaggtaatgaattgccctggaacaagttgacctgcgtgcttactgtgcattcatcatggattttttcattatagagatcttaggtgggccgtttcagagttgttttggtgtatcaatgcctttaacgaatactattggattttcacgctttgttgctttgttgatctgcatgcttactgtcctggaacgattagcgagcatacatgctggttttcagactttgatcacacataagctat

SEQ ID NO: 426 - DNA, 4969 bp, Gossypium raimondii
atccgacagcaagaggaaaaaaaaaagttataactgctataaatggcagcttgaattctaaatcgaggcttatttcgaaaatagcagttcattaactccgcataagtcaaaagtcaatggcctccatggaaagtgactcatctgaagagcaagaaaattcaactgcctttctgactggcataaaatttcatgtctcgaacgacgctgataatgagaacatgtctatcttggaaattactgcacccagtgaggtgtctgatcctaggttggggtttccgaatttttctaatcattgcaccacttgtgatgccagagatatgaaacaatgcgaaggccattttggggttattaaatttccatacacaatactccatccattttttctttcagaagttgtacatatattaaataagatttgcccaggatgtaaatcgatccggaaagatctatggatgaagggtgctaattctatagccagattacttgaaaccaaggggtgtaaatattgtgttgggaattcaatagagtggtatccacccatgagattcaagataacctcgaaagagcttttcagaaaaagtgcaatcatggtagaggtaagtgaaaactctttaatgaaggtccggaagagaggaaggcaagcattacctgcagattactgggactttattccaaaagatcaacaacaagaagaaggttttgtgaaaccaggtagaagagtcctatcacatgcccaggttcgacatttgttgaaggacgttaatccagagttcattaaaaagtttatttcagaagcagactctattttcctcaatttttttcctgtgacacccaatagtcaccgagtgacagaaatcatgcatacatcttctaatgcgcagcgattgatctttgatgaaagaaccagggtttacaagaaactggttgacttcagagggctagcaaatgaattgagctctcatgtattggaatgcctaaaaatttctaagctgcatgtggagaagccatcaactgaagattctgcactcattgctgctctgaaaaagaataaagattctgcttccaacatgtcaggtttaagatatatgaaagatgttattcttgggaagagaaacgaccattgcttccgcatggttcttactggaaacccaaatcttaaactgtctgaaattggtatcccatgtcatgttgccgagaaattgcaaatcgctgagcaactgaacaggtggaatgaggagagattgaaaacttgttgtaatctgcgtattcttgagaagggtgagattcgcattaggagagaaggtaaattagttagaattcgtcataatgaaaaggtccaagtaggggacactatctataggcccctaaatgatggggatacagtacttataaatagacctccttctatacatcagcactctctcattgcgctatctgttaaagttctacctgtcaattcagttgtttcgataaacccactaatatgttccccttttcgtggagattttgatggtgattgccttcatggttatgttcctcagtccattaacacaagagttgagctcagtgagcttgtttctttggataggcagctaattaatggccaaagtggtcgaaatctgctttcactcagtcatgatagtttaacggctgcttatttggtcaaggaggacggggtactattgaacctgttccagatgcaacagctggaaatgttctgtcctaatcattcgccattgccagccattgtcaaagctcctttgctaagtaatcctgtttggactggaaagcagttatttagcatgctctttcctcccgaatttgattatgtttttgcaccaagtggtgttgtaatccacaatggggatctcatatgttcttctgaagggtcttcttggctacgagatgctgacggcaacctttttcaaagtcttattaagcattaccaaggaaaggtccttgactttttgcatgctgctcaggaagttctttgtgagtggttgtcaatgaggggtttgagtgtttcactcttggacctatatctatctcctgacacagattcacaaaagaacatgatggatgaaatcttctatggtctgcaagaagcagagcagacatgtaacttcaagcagttaatggttgattcttgtcaagatttccttgctggaaacgatgaagaaactaataggttcatggttttggatgttgagcagatgtgctatgagaaacaaagatctgctgcacttagccaagcttctgttgattcatttaagcaagttttccgtgatattcagaatttactctacaagtatgcaaataaagacaattcattattcaccatgttcaaagcagggagcaagggtaacttgctgaagttagtacagcatagtatgtgtcttggattgcaacattcacttgtccctttatcattcagatttcctcatcagctctcatgtgctgcatggaataatcaaaagtctcacatcttaacccaaaaggttgatgatactgatgagtctgctaagaaatatatcccctatgctgtggtcgaaagttcgtttgtgaagggtctgaatccattagaatgttttgttcattcagtgactactcgagacacatctttcagtgacaatgctgaccttcctgggacgctgtcacgaaggttgatgttcttcatgcgtgatctatgcgcagcatatgatggaactgtgaggaatgcatatggagatcaggttgttcagttctgttataatatcgataagggtacatttagtccaactagttgccctgacaaattagtaagtcagggcagtagtcttcctgatggaattggtggacaacctgttggttcattatctgcctgtgccatttctgaggctgcatatagtgcattggatcagccaattagtctacttgaatcttctccattgctgaacttgaagagggtccttgagtgtggttctaaaagaagcaatgctgaccagactatgtcactatttttatctggtaaacttgtaaggagaaggcacggtcaggagtatggagccttagaagtcaagaatcatttggagaggctgatctttaaagatattgtgtctactgtctcaataatcttctctccacagatgtctagtgaaaaccgtttcagtccttgggtttgccattttcatgtgtttaaggatattgtgacaaggaggcggctaacagtgcattctattattgatgctcttcacatgcactgcaccaatgccaaaagactatggaaaatcaatttgcccgacatgcaagttacaagcaaggcctgttctgttattgacatggaaaatgaagatgatacgttttgtatcactgtcacaattgttgaatgtaaaacttctcgtatagaactggatgtgattcaagacatggtgataccttcccttctggaagcagtggtaaaaggattcccggagatcaagaaggtggaaattctatggaatgaggatttcagagtcccaaattctcataaacctgctcctggtgaactttacttgagggtttctgtatctggcgattttggtataacgaaactctggagtgtgcttatgaatgattgcctccaactaatggatataatcgattggacacggagccatccagataacattaatcagttttgcttggcattcggaatagatgctggatggagattctttctcaataatatgaagagtgcaatatcagatactggcaagtctatactaaatgaacatctacaccttgctgccaattgtctgtcagctaccggggagtttgttggtttaaattcaaaaggcttgaaacaacaaagagaacatgcatttgtctcttctcctttcatgcaagcatgcttttcaaaccctagtgcttgctttgtcaaagctgcaaagactggagttgcggataatcttcaagggaccattgacctattggcttggggaagggttcctcgtattgggactggtggacagtttgatatagtctattctatgaaggatgaagagcttgcagaaccggttgatgtgtataagctgctaggagattctattaattccaagaagcaggatatagagtttgaagtacctaaagtttttaaccctacatctgagaaacatagttctccgttcaagggagctcttcgtgactctgtctttgatgagtggaagaagattgaaacgaaaacaaggtcactcttgagaggacgtctaaccttgaatgacgttcagaggcttgagcgtaatttaaagaatattttgcgcaaatatcctattgatcaccgtgtaagtgaagctgactgggataccttgatgatggcgttgtactttcaccctcatagagttgagaagatcggatctggagccaaggaaataaaggtagggcatcatcccgatcatgcagacagtcgttgtttctttttggttagaacagatgagacaactgtagatttctcatatcggaaatgtgttgtcggtgcactcgagatcattgctccttgtagggcacaatcctacaagtcaaaatggttacaacatggtagtttgtaaaccaaactccacaagcgctcacttttgcatgtaaatatagcaagatccataccttcctaaaactgtacatttctacagactactgagcacaagaggagtagtttgaacagtatttcatatccttttgttgactttttttttctttttctttttttaaaatttttaagagtgtatttcccagcctaatagaatagggtcgccgctttcctcagcttctttttgctccttctactggaacttgtttgcctttctttttaacatgagacagaaaagatccagtggaagcagcaacgaaaagcttgtaaagttcgaccccatttcgttttgtattttccataactacacgtgatagtgttattaagtagcctgtttcagctaatctcattattttctttagtttagacgct

SEQ ID NO: 427 - DNA, 5029 bp, Gossypium raimondii
actaaatatagttttaattgtaattcttgtgatccaatgtttaatcatcttatctctgtctttgtaattttatattaaactttatttgagttcttgccggcatgctatattgattgcttgttggtcatcagaagtcaaaagtcaatggcctccatggaaagtgactcatctgaagagcaagaaaattcaactgcctttctgactggcataaaatttcatgtctcgaacgacgctgataatgagaacatgtctatcttggaaattactgcacccagtgaggtgtctgatcctaggttggggtttccgaatttttctaatcattgcaccacttgtgatgccagagatatgaaacaatgcgaaggccattttggggttattaaatttccatacacaatactccatccattttttctttcagaagttgtacatatattaaataagatttgcccaggatgtaaatcgatccggaaagatctatggatgaagggtgctaattctatagccagattacttgaaaccaaggggtgtaaatattgtgttgggaattcaatagagtggtatccacccatgagattcaagataacctcgaaagagcttttcagaaaaagtgcaatcatggtagaggtaagtgaaaactctttaatgaaggtccggaagagaggaaggcaagcattacctgcagattactgggactttattccaaaagatcaacaacaagaagaaggttttgtgaaaccaggtagaagagtcctatcacatgcccaggttcgacatttgttgaaggacgttaatccagagttcattaaaaagtttatttcagaagcagactctattttcctcaatttttttcctgtgacacccaatagtcaccgagtgacagaaatcatgcatacatcttctaatgcgcagcgattgatctttgatgaaagaaccagggtttacaagaaactggttgacttcagagggctagcaaatgaattgagctctcatgtattggaatgcctaaaaatttctaagctgcatgtggagaagccatcaactgaagattctgcactcattgctgctctgaaaaagaataaagattctgcttccaacatgtcaggtttaagatatatgaaagatgttattcttgggaagagaaacgaccattgcttccgcatggttcttactggaaacccaaatcttaaactgtctgaaattggtatcccatgtcatgttgccgagaaattgcaaatcgctgagcaactgaacaggtggaatgaggagagattgaaaacttgttgtaatctgcgtattcttgagaagggtgagattcgcattaggagagaaggtaaattagttagaattcgtcataatgaaaaggtccaagtaggggacactatctataggcccctaaatgatggggatacagtacttataaatagacctccttctatacatcagcactctctcattgcgctatctgttaaagttctacctgtcaattcagttgtttcgataaacccactaatatgttccccttttcgtggagattttgatggtgattgccttcatggttatgttcctcagtccattaacacaagagttgagctcagtgagcttgtttctttggataggcagctaattaatggccaaagtggtcgaaatctgctttcactcagtcatgatagtttaacggctgcttatttggtcaaggaggacggggtactattgaacctgttccagatgcaacagctggaaatgttctgtcctaatcattcgccattgccagccattgtcaaagctcctttgctaagtaatcctgtttggactggaaagcagttatttagcatgctctttcctcccgaatttgattatgtttttgcaccaagtggtgttgtaatccacaatggggatctcatatgttcttctgaagggtcttcttggctacgagatgctgacggcaacctttttcaaagtcttattaagcattaccaaggaaaggtccttgactttttgcatgctgctcaggaagttctttgtgagtggttgtcaatgaggggtttgagtgtttcactcttggacctatatctatctcctgacacagattcacaaaagaacatgatggatgaaatcttctatggtctgcaagaagcagagcagacatgtaacttcaagcagttaatggttgattcttgtcaagatttccttgctggaaacgatgaagaaactaataggttcatggttttggatgttgagcagatgtgctatgagaaacaaagatctgctgcacttagccaagcttctgttgattcatttaagcaagttttccgtgatattcagaatttactctacaagtatgcaaataaagacaattcattattcaccatgttcaaagcagggagcaagggtaacttgctgaagttagtacagcatagtatgtgtcttggattgcaacattcacttgtccctttatcattcagatttcctcatcagctctcatgtgctgcatggaataatcaaaagtctcacatcttaacccaaaaggttgatgatactgatgagtctgctaagaaatatatcccctatgctgtggtcgaaagttcgtttgtgaagggtctgaatccattagaatgttttgttcattcagtgactactcgagacacatctttcagtgacaatgctgaccttcctgggacgctgtcacgaaggttgatgttcttcatgcgtgatctatgcgcagcatatgatggaactgtgaggaatgcatatggagatcaggttgttcagttctgttataatatcgataagggtacatttagtccaactagttgccctgacaaattagtaagtcagggcagtagtcttcctgatggaattggtggacaacctgttggttcattatctgcctgtgccatttctgaggctgcatatagtgcattggatcagccaattagtctacttgaatcttctccattgctgaacttgaagagggtccttgagtgtggttctaaaagaagcaatgctgaccagactatgtcactatttttatctggtaaacttgtaaggagaaggcacggtcaggagtatggagccttagaagtcaagaatcatttggagaggctgatctttaaagatattgtgtctactgtctcaataatcttctctccacagatgtctagtgaaaaccgtttcagtccttgggtttgccattttcatgtgtttaaggatattgtgacaaggaggcggctaacagtgcattctattattgatgctcttcacatgcactgcaccaatgccaaaagactatggaaaatcaatttgcccgacatgcaagttacaagcaaggcctgttctgttattgacatggaaaatgaagatgatacgttttgtatcactgtcacaattgttgaatgtaaaacttctcgtatagaactggatgtgattcaagacatggtgataccttcccttctggaagcagtggtaaaaggattcccggagatcaagaaggtggaaattctatggaatgaggatttcagagtcccaaattctcataaacctgctcctggtgaactttacttgagggtttctgtatctggcgattttggtataacgaaactctggagtgtgcttatgaatgattgcctccaactaatggatataatcgattggacacggagccatccagataacattaatcagttttgcttggcattcggaatagatgctggatggagattctttctcaataatatgaagagtgcaatatcagatactggcaagtctatactaaatgaacatctacaccttgctgccaattgtctgtcagctaccggggagtttgttggtttaaattcaaaaggcttgaaacaacaaagagaacatgcatttgtctcttctcctttcatgcaagcatgcttttcaaaccctagtgcttgctttgtcaaagctgcaaagactggagttgcggataatcttcaagggaccattgacctattggcttggggaagggttcctcgtattgggactggtggacagtttgatatagtctattctatgaaggatgaagagcttgcagaaccggttgatgtgtataagctgctaggagattctattaattccaagaagcaggatatagagtttgaagtacctaaagtttttaaccctacatctgagaaacatagttctccgttcaagggagctcttcgtgactctgtctttgatgagtggaagaagattgaaacgaaaacaaggtcactcttgagaggacgtctaaccttgaatgacgttcagaggcttgagcgtaatttaaagaatattttgcgcaaatatcctattgatcaccgtgtaagtgaagctgactgggataccttgatgatggcgttgtactttcaccctcatagagttgagaagatcggatctggagccaaggaaataaaggtagggcatcatcccgatcatgcagacagtcgttgtttctttttggttagaacagatgagacaactgtagatttctcatatcggaaatgtgttgtcggtgcactcgagatcattgctccttgtagggcacaatcctacaagtcaaaatggttacaacatggtagtttgtaaaccaaactccacaagcgctcacttttgcatgtaaatatagcaagatccataccttcctaaaactgtacatttctacagactactgagcacaagaggagtagtttgaacagtatttcatatccttttgttgactttttttttctttttctttttttaaaatttttaagagtgtatttcccagcctaatagaatagggtcgccgctttcctcagcttctttttgctccttctactggaacttgtttgcctttctttttaacatgagacagaaaagatccagtggaagcagcaacgaaaagcttgtaaagttcgaccccatttcgttttgtattttccataactacacgtgatagtgttattaagtagcctgtttcagctaatctcattattttctttagtttagacgcttgaatcttacattattttcttaaagatttaca

SEQ ID NO: 428 - DNA, 4844 bp, Gossypium raimondii
atggaaagtgactcatctgaagagcaagaaaattcaactgcctttctgactggcataaaatttcatgtctcgaacgacgctgataatgagaacatgtctatcttggaaattactgcacccagtgaggtgtctgatcctaggttggggtttccgaatttttctaatcattgcaccacttgtgatgccagagatatgaaacaatgcgaaggccattttggggttattaaatttccatacacaatactccatccattttttctttcagaagttgtacatatattaaataagatttgcccaggatgtaaatcgatccggaaagatctatggatgaagggtgctaattctatagccagattacttgaaaccaaggggtgtaaatattgtgttgggaattcaatagagtggtatccacccatgagattcaagataacctcgaaagagcttttcagaaaaagtgcaatcatggtagaggtaagtgaaaactctttaatgaaggtccggaagagaggaaggcaagcattacctgcagattactgggactttattccaaaagatcaacaacaagaagaaggttttgtgaaaccaggtagaagagtcctatcacatgcccaggttcgacatttgttgaaggacgttaatccagagttcattaaaaagtttatttcagaagcagactctattttcctcaatttttttcctgtgacacccaatagtcaccgagtgacagaaatcatgcatacatcttctaatgcgcagcgattgatctttgatgaaagaaccagggtttacaagaaactggttgacttcagagggctagcaaatgaattgagctctcatgtattggaatgcctaaaaatttctaagctgcatgtggagaagccatcaactgaagattctgcactcattgctgctctgaaaaagaataaagattctgcttccaacatgtcaggtttaagatatatgaaagatgttattcttgggaagagaaacgaccattgcttccgcatggttcttactggaaacccaaatcttaaactgtctgaaattggtatcccatgtcatgttgccgagaaattgcaaatcgctgagcaactgaacaggtggaatgaggagagattgaaaacttgttgtaatctgcgtattcttgagaagggtgagattcgcattaggagagaaggtaaattagttagaattcgtcataatgaaaaggtccaagtaggggacactatctataggcccctaaatgatggggatacagtacttataaatagacctccttctatacatcagcactctctcattgcgctatctgttaaagttctacctgtcaattcagttgtttcgataaacccactaatatgttccccttttcgtggagattttgatggtgattgccttcatggttatgttcctcagtccattaacacaagagttgagctcagtgagcttgtttctttggataggcagctaattaatggccaaagtggtcgaaatctgctttcactcagtcatgatagtttaacggctgcttatttggtcaaggaggacggggtactattgaacctgttccagatgcaacagctggaaatgttctgtcctaatcattcgccattgccagccattgtcaaagctcctttgctaagtaatcctgtttggactggaaagcagttatttagcatgctctttcctcccgaatttgattatgtttttgcaccaagtggtgttgtaatccacaatggggatctcatatgttcttctgaagggtcttcttggctacgagatgctgacggcaacctttttcaaagtcttattaagcattaccaaggaaaggtccttgactttttgcatgctgctcaggaagttctttgtgagtggttgtcaatgaggggtttgagtgtttcactcttggacctatatctatctcctgacacagattcacaaaagaacatgatggatgaaatcttctatggtctgcaagaagcagagcagacatgtaacttcaagcagttaatggttgattcttgtcaagatttccttgctggaaacgatgaagaaactaataggttcatggttttggatgttgagcagatgtgctatgagaaacaaagatctgctgcacttagccaagcttctgttgattcatttaagcaagttttccgtgatattcagaatttactctacaagtatgcaaataaagacaattcattattcaccatgttcaaagcagggagcaagggtaacttgctgaagttagtacagcatagtatgtgtcttggattgcaacattcacttgtccctttatcattcagatttcctcatcagctctcatgtgctgcatggaataatcaaaagtctcacatcttaacccaaaaggttgatgatactgatgagtctgctaagaaatatatcccctatgctgtggtcgaaagttcgtttgtgaagggtctgaatccattagaatgttttgttcattcagtgactactcgagacacatctttcagtgacaatgctgaccttcctgggacgctgtcacgaaggttgatgttcttcatgcgtgatctatgcgcagcatatgatggaactgtgaggaatgcatatggagatcaggttgttcagttctgttataatatcgataagggtacatttagtccaactagttgccctgacaaattagtaagtcagggcagtagtcttcctgatggaattggtggacaacctgttggttcattatctgcctgtgccatttctgaggctgcatatagtgcattggatcagccaattagtctacttgaatcttctccattgctgaacttgaagagggtccttgagtgtggttctaaaagaagcaatgctgaccagactatgtcactatttttatctggtaaacttgtaaggagaaggcacggtcaggagtatggagccttagaagtcaagaatcatttggagaggctgatctttaaagatattgtgtctactgtctcaataatcttctctccacagatgtctagtgaaaaccgtttcagtccttgggtttgccattttcatgtgtttaaggatattgtgacaaggaggcggctaacagtgcattctattattgatgctcttcacatgcactgcaccaatgccaaaagactatggaaaatcaatttgcccgacatgcaagttacaagcaaggcctgttctgttattgacatggaaaatgaagatgatacgttttgtatcactgtcacaattgttgaatgtaaaacttctcgtatagaactggatgtgattcaagacatggtgataccttcccttctggaagcagtggtaaaaggattcccggagatcaagaaggtggaaattctatggaatgaggatttcagagtcccaaattctcataaacctgctcctggtgaactttacttgagggtttctgtatctggcgattttggtataacgaaactctggagtgtgcttatgaatgattgcctccaactaatggatataatcgattggacacggagccatccagataacattaatcagttttgcttggcattcggaatagatgctggatggagattctttctcaataatatgaagagtgcaatatcagatactggcaagtctatactaaatgaacatctacaccttgctgccaattgtctgtcagctaccggggagtttgttggtttaaattcaaaaggcttgaaacaacaaagagaacatgcatttgtctcttctcctttcatgcaagcatgcttttcaaaccctagtgcttgctttgtcaaagctgcaaagactggagttgcggataatcttcaagggaccattgacctattggcttggggaagggttcctcgtattgggactggtggacagtttgatatagtctattctatgaaggatgaagagcttgcagaaccggttgatgtgtataagctgctaggagattctattaattccaagaagcaggatatagagtttgaagtacctaaagtttttaaccctacatctgagaaacatagttctccgttcaagggagctcttcgtgactctgtctttgatgagtggaagaagattgaaacgaaaacaaggtcactcttgagaggacgtctaaccttgaatgacgttcagaggcttgagcgtaatttaaagaatattttgcgcaaatatcctattgatcaccgtgtaagtgaagctgactgggataccttgatgatggcgttgtactttcaccctcatagagttgagaagatcggatctggagccaaggaaataaaggtacggcatcatcccgatcatgcagacagtcgttgtttctttttggttagaacagatgagacaactgtagatttctcatatcggaaatgtgttgtcggtgcactcgagatcattgctccttgtagggcacaatcctacaagtcaaaatggttacaacatggtagtttgtaaaccaaactccacaagcgctcacttttgcatgtaaatatagcaagatccataccttcctaaaactgtacatttctacagactactgagcacaagaggagtagtttgaacagtatttcatatccttttgttgactttttttttctttttctttttttaaaatttttaagagtgtatttcccagcctaatagaatagggtcgccgctttcctcagcttctttttgctccttctactggaacttgtttgcctttctttttaacatgagacagaaaagatccagtggaagcagcaacgaaaagcttgtaaagttcgaccccatttcgttttgtattttccataactacacgtgatagtgttattaagtagcctgtttcagctaatctcattattttctttagtttagacgct

SEQ ID NO: 429 - DNA, 4194 bp, Gossypium raimondii
atgaagtcaaagccgatgacctccattgaaacggacttgtctgaagagcaagaagtgctagctgccactatgactggcataaagtttaatgtatcgggtgatgaagataatgggaactcaattgactggtatccaccaatgacattcaagatatcctctaaagagctttccaaaaaaagcacaattgtggtagaggtaagtgaagactctttaatgatggtccgaaagagaggaaggcaagccttacctgctgattattgggattttattccaaaagatcaacaagaagaagaagatggtttgatgaaaccacgtcgaagggtcctatcacatgcacaggttcattatttactgaaggatgttgatccagagttcattaaaaagttcattcagaatgtggactctattttcctcaattgctttcctgtgacacccaatagtcatcgagtgacggaaatcactcatagatcttctaattcacagcgcttgatctttgatgagagaactaggctttacaagagactggttgatttccgaggagtagctaatgaactgagttcccatgtattggaatgcctaaaaatttcaaaggcaagttacagtgccttgttttcttttttgtatttgctgttccaggagaagccatcaaatgaagataatgaacttatccttgccctgacaaggaataaagatcctgtttctaacatgtctggtttaagatacatgaaaaacgttcttcttggaaagcgaaatgaccattgcttccgcatggttcttaccggaaatccaagtcttaaactatcggaaattggtataccatgtcctgttgcagagaggttgcaaattgctgagcaactgaacaagtggaacgaggaaagattgaaagcttgctgtaatttgcgtattcttgagaagggtgagatttgtattaggagagaaggtacattagttagaattcatcataatgaaaagatccgactgggggacatcatctataggcccctaaataatggggatatcgtgcttataaacagacctccttctatacatcagcactctttcattgccctatctgtcaaagttctacctgtgagttcctctgtttcgataaacccccttatttgttccccttttcgtggagattttgacggtgattgccttcatggttatgttcctcagtccatcaacacaagggttgagctcagcgagcttgtttctttgaataggcagctaattaatggccaaagtggtcgaaatctactttcactgagtcatgatagtttatcagctgcttatttggtcaatggtgatggggttctcttgaacttgtacgaaatgcaacagcttgaaatgttctgtcccaatcgttcaccgtcgccagcaatcatcaaagctcctttattgagtaatcctgtttggactggaaagcagttattcagcatgctctttcctcccgaattggattatggtttttctccaagtgatcttgttatccgtaatggggagcttataacttcatctgagggatcttcttggttccgagatgctgatggcaacctttttgaaagtctcattaaaaattgtcgaggaaaggtccttgattttttgcatggtgctcaggaagttctttgtgagtggttatcaatgaggggtatgagcgtttcactcttggacctatacctaactcctgattcaaattcacgaaagaacatgatggatgaaatcttctatggtctccaagaaacagagctgacttgcaactttaagcagttaatggttgattccttctgtgatttccttgctggaaataatgaagaaattgatggttttgtgggttttgattttgagcggatgtgttatgagaagcaaagatcagctgcagttaatcaagcttctgttgattcttttaagcaagtttttcgagatatccagaatttatcatacaaatatgcaaataaagacaattcattattgaccatgttcaaagcagggagcaagggtaacttgctgaagctagtgcagcatagcatgtgtcttggactgcaacgttcagttgtacctttatcattcaggtttcctcctaaactctcatgttctgaatggaatgatctaaaatctcagggcttaacccagagcggtgatgacagtgttgaatctgcaaagaatttcatcccatatgctgtgatcgaaagttcttttatgacaggcctgaatccactagaatgttttgtgcattccgttactagtcgagacagttctttcagcgaccatgctgaccttcctgggacactgtcacgaaggcttatgttcttcttgcgtgatctatgcgcatcatatgacggaactgtgaggaatgcatatggaggtcaggttgttcagttcagctatggtagtgataagggtacatctactgcaactagttttgctaatgaaatacaaagtcagggcagtatcctacctgatggaacaggtggccaacctgttggttcattgtctgcctgtgccatttctgaggctgcatatagtgctttggatcaaccgattagtctacttgaaacttcaccattgctaaacctgaagagggtccttgaatgtggttctagaagaaggaattcagaccagactatgacgctatttttatcggataaacttggaaaggggagacattgtttcgagtatgcagctttagaaatcaagaattatttggagaagttgatcttttcggatattgtatctactgtcttaataacctactccccgcagaagtcaactgaaaactgtttcaacccttgggtttgccattttcatgtgtgcaaggagatcatgaaaaggaggcgcctttcagtgcattctattattggttctcttcagatgcactacgccaatgccaaaaaattatggaaaatcaatttgcctgacatccaagttacaagcaagtcttgttctcatactgatatgccaaataaagatgatatgttttgtatcaccgtcacgattgttgagccttccaaaaggtctcatatagaattggatgtgattctagccatagtgttaccttcccttctggaagcagttgtaaaaggattcccggagatcaagaaggtgcaaattttatggaatgatcgattcaaagtctcaaaatctcataaaacttctcctggtgaactttacttgagggtagctgtaacaggtggttttggtaaaacaaaactctggggcatgcttatgaatgattgccttccaataatggatttgatcgactggacacgtagtcatccagatgatattaatcagttttgctcggcatatggcatagattctggatggaaattttttctcaataatttgaagagcgctatatcagataccggcaagactatactaaatgagcatttgcatcttgtcgccgattgtctgtctgttaccggggagtttgttggcttaaactcaaaaggcttgagactacgacaagaacatgcatttgtctcatctccttttatgcaagcatgcttttcaaatcccagtgcttcctttgtcaaagctgcaaagaaaggagtttcggataatcttcaggggaccattgatgcattgtcatggggaagagttccttgcatcgggaccggtgcacagtttgatatactgtactctatgaaggatgaaatgatcaccgaaccggttgatgtgtataatcttcttggaaatattgttggttctcagaaccaagatgtagagtttgaagtaccccaagcttgtaacatcaagtccgagaaatatgtctctgaacttatggatgcacttggtgattctgcctttgaacggctgaaaaatattgaaacaaaaatattgagagaatttctgacgttaaatgacattcagaggctttcgcgaactttaaaggatatattgcacaagtctcctattggccaccggttaagcggagctgactggaattccgcaatgatggcattgtactttcatccgcgaagagatgagaaggtcggatctggagctcaagaaataaaggtagggtatcaccctgaacataaaaattctcgctgctttcttttggcaaggaccgatggggcaatcgtagatttctcgtatcataaatgcgttatcggggctcttgaggtcatcgcccccgataaggtccaattctacaagtcaaaatggtcacaatccggtaatctgtaa

SEQ ID NO: 430 - DNA, 6790 bp, Gossypium raimondii
cctaacctaaatcttaatcaagctattaatatctagatttttcttactcaaccctaccaaccaacccaaacaataaagtaaaaatcatgtatacaccaacatgctcaaaatttccctcacaaaaagaacaccagtttctataagtccctttctctttctctctcactctcactctcactcatttgactgtccaaatcttctgttatttcacttctcctcctctctttccttcagtcagggagaggaagagagaaaaattgtacaaaatcatggaagagaaatttctagttttatttgaaaaaaaaaacatttttttgggctacattttctcttccctccccactaattttatttttttggtttgatcagtcatttctggctcttacatcgagaacccatttggtttccttctttttaaatttttttagggttttagtgtttcaaaattttagtcagaaaattcagaagaaaccaaagatatttcagggttatttcatttaggtagactaaaaagaagaaattttcgagttttgtcttatagtttaaagcgagaaacatggaggaaaattcttcgtcagttattttagatggtgagatagttggtataaagttctgcctggcaacccctaaagaaattcttacagcatcagtcagtggctttcctattaaccatgttagtcaactctcgaattcctaccttggtttgccccttgaatttggtaaatgtagcgcatgtggtacatcagaacctggacaatgtgaaggtcattttggatatattgaattaccaataccaatataccatcctagccatatcagtgaattaaagcgactgttgagtttgctttgcttgaagtgcctaaaattgaagaacaagtttcagatgaaaagtggcagtgtcgctgaaagattgctatcgtcctgttgtgagaatactccacaagtttcaatcaaagaggttaaaacaacagatggtgcttgttatttggagttgaagcagccatctagacaatcaaaaactaactggaattttttagagagatatggttttcgctatggcgaccatcatactcgaactcttctgccttgtgaggtggtggaaatactgaagagaattccttcacagacaagacggaaactttctgggaaagggttcttcccacaagagggatatattttgcagtatttgcctgttcccccaaattgtttatctgttccggacgtttcggacggcgttagcgtcatgtcctcggatctttctacatcaatgctgagaaaggttctgaagcaagttgaaattatcaaaagttcaaggtctggtaccccaaattttgaatcgcatgaagtagaagctaacgatttgcaatcagcagttgagcaatatcttcaagttaggggtactgttaaagcatcccgcagcatagatgcacgatacggggttaacaaagatgctagtgattcgtcaacgaaagcatggctagagaaaatgagaacactgtttattagaaagggttcagggttttcttcacgcagtgtgattactggtgatccatacaaaaaggtgaatgagattggcattccatctgaaattgctcagagaattactttcgaggagagggttaacatgcacaacatgagatatttgcaaaatctggtggataacaagttgtgtttgacctacagagatggtggttctacatattcattgagggaggggtcaaaggggcatacatttttgagacctggtcaggtggtacatcggcgaattatggatggagatattgttttcataaataggccaccgactacacataagcattcattgcaggcactttctgtatatgtacatgatgatcatacagtgaagataaatcccctaatttgtgggccattaagtgctgattttgatggagattgtattcacttgttctatccgcagtctttatcagcaaaagcagaggtttatgagcttttttcagtggagaagcagttgcttagctcccatagtggcaacctaaatttgcagttggccactgattcattgttgtcactcagagttatgcttaagacatttttgtttaaaaaggcagatgctcaacaattgtctatgtttctctcttcagctttgccagaacctgcttttttaaagtgtaatcatgttgctccatgttggacagccttccaaattctgcagaccgcttttcctgcatgcctagattgctccagtgatagatacttaattggaaaaagtgatatattgaaagttgatttcaataaggaccttatgcagtctgtcatcaatgaagttgtggcatctattttctatgagaagggtccaaaagaggttcttaacttctttgattctttacaacctttattgatggagaatatctttgcagagggcttcactgtttgtctagaagatttttctgtctctagggaagttatagaaaatattcagaaggatattcaggttatttctcccttgctttatcagttaaggtcaacttataatgaattagttgagttgcaaatggagaatcacattcgagtagccaaagagccaatagctgatttcatactaaaaacatcctctttgggtaatttaattgactctaggagtgattctgctgtcaataaggttgttcagcagattggattcttgggaatgcaactttctgataaaggaaaattctactcgaagactttggttgaagatgtggctcaccaatttcaaagcatatatccttcagatgcaatcgattatccttctgctgagtttggactgattaaaagttgctttttccgtgggcttgatccgtatgagggcattgttcattcaatatctacaagagaagtaatggttcgctccactagaggattgtctgaacctgggaccttgtttaagaatttgatggccatccttcgtgatgttgttatttgttatgatggcacagttagaaatgtcagtagcaattcaataatacaatttcaatatgggctaagtgctagaactagacctcaattccccgctggtgaacctgtgggtgtcttagctgctactgcaatgtcaaatccggcatataaagcagtgcttgattcatctcctagtagcaattcttcttgggaactgatgaaggaaatattgctttgcaaagtaagtttcaaaaatgacccaattgaccgccgtgtaattctgtatttgaaagattgtgattgtgggagaaagtattgccaagaaaatgcagcatatcttgttaagaatcatttgagaagagtcaaactcaaagatattgcagtagatttcatcattgaataccagcagcagcaaattgtatcagaaatagaggcaggccttgttgggcatatccttctcaataaggatctattgaaggagttgagtgttagtgtgcaagagattcatatgaagtgccaagaaactattaactcctttcgtaagaagaaaaaaactgctgaaacttttaagaggacagatttgtttgtcagtgaaagttgttccatccagcaatcctgtgtggacaaatggcttgacatgccatgcttgatgttcttttttcgaaatacaaatgatgataatctagatagtgctatacaaatcctggctgacatcatctaccctgttcttctacaaacagtgatcaagggtgaccctcgtatctgttcagcaaaaattatctgggttaaccctgatgcaacaacttggataagaaatccaagtaagactcagaagggtgaattggctttggaagttgttttggagaaatctgctgtgaagcagaacggtgatgcctggaggactgtcatcgattgttgtcttccagtgctaaatataattgacacccataggtctataccttatgccataaagcaagttgagcaactgctcggaatttcttgtgcttttgaacaagcagtgcagcgtctctccacttctgtgtcaatggtgacaagaggtgttctaaaggaacacctcatgctcttagctaacagcatgacatgttgtggaaatttaatcggcttcaactctggtggttataaaacactatctcgctcattgaatattcaagtgccatttaccgaagcaacactgtttacaccaagaaagtgttttgaaagggctgctgagaaatgctatgatgattccttgtcgagcatagttgcatcctgttcttggggtaaacgtgtggctgttggaacaggatcacggtttgacctcctgtggaatcaggagtctggatctgatcaaatgagtggaatggatgtctacaactttctgcacatggttagtggtgctggtggaagcaattctaatactgcttgcctgggagaagaagttgatgatttaatggatgagtggtgcttgtctccagaccatagcactggtttagataagccggtgtttgaggacgcagctgaatttgagaataatttagacggtcagtcagctagtgcaaattgggaaaaagatgtgtctttggacaaggtgtcagatgttggttgggatgcatctggatggaataaaaatgctgaggatgttgacaaatttgctgcagctgcgaccagttcggagaagcaaaatgagtggtctggttggggtgcgagcaaatctaactcacaagatgttggttgggatgctttgtctggatggaataaaaatgcagaggatggtgacaaatttgcagctgctgcaaccagttcgaagaagcaaaatgagtgttctgattggggggcgagcaaatctaaatcacaagatgttgtctctccaaaagtggatgttggttgggatgccttgtctgcatggcataaaaatgcagaggatggtgacaattttgcagcagctgcatccagttcaaagaagcaaagcgagtggtctgattgggggatgagcaaatctaaatcacaagatgtctctccaaaaacggatggaacttgtatgaaagagcaaactgaattgtctggttgggagatgaaaaagtttgatacacgagatgtccttcctgtggaagagagagcctccaagcccaatggttgggattctggtgctagttggggaataatgagcaaagaatctgaagaacttgatgctagtgctgcagctccatggtctggttgggggacaaaagattcctcccctaaaaaatctttggacaaaacttccaaatctagtagctgggatactgtttcttcttggggaaggaagactgctgcagttcatgaatctggcttcattggaaacgataaccagccgggccaagggagaattgaaaatgaatgggataataaagcaagtcaagtaaagccggtgcagtcagcatctggttggaataacaaagtgacagaggaaatggtagttcaatcgacatctagttgggatgaaaaagcttcttgggaaaagccagttcagtcaatgtctggttgggtttcctcatctgctgcaggctcagatgagtcacctacaaaaggctgtagtaagaatagtaattgggaccaacaaaaggcacagacaatgaataatgcttgggaccaacaaaagtcacctgcaacaaatagttcttgggatcggcaaaaatcatctacggcaaataattcttgggatcaacaaaagccaccagcaaatagttcttgggaccaagaaaagtcacctacaattaataattcatgggaccagcaaaagtcacccgaatgttcacagggttggggcacccttaatgacttaaaccaacctgcaagttctagtggctgggatatgccacagggtgaggataacactcaaagtgaaaaacagcatcagtggggacagagtaagggctcacgtcgttgggcttcagatgctaataagaagagtcgtcctttgaagccagctcgaatgatgaatgatgattccagtatggctgcaatgtacactgttacaagacaaagactagacatgtttacttctgaggagaaagatattctcttggatgttgagccactcatgcagtcaatcagaaaaataatgcaccagactgggtacaacgatggggatccactgtctgccgatgatcagacgtttgtacttgataatgttttagctcatcatccagacaaagctgtaaaaatgggtgctggtattgattatgtcatggtaaacaagcacagccttttcctggataccaggtgcctctatgttgtcacaaccgatggtcataagcaagatttctcttatctcaagtgtctggagaacatgatcaaggggaaatatcctgatttggctgaagcttttgttgcaaaatatttccgaaaatctcgagggaaccgtgagcgaggtgttgctccagagaattctcaagggaaccgcgaccaaagtgttactcaagatgataactctcaagggaaccgtgaccgaagtgaccgaagtgttgctcaggacgataatgagggggaggttaagcagtaggcatctgtctctccaagtgttaatatcattcagagaggtctagttaggtattttgttcattcctgatatgaatcttttgatatgtacatgtaaagcagatgttagtgtgtttatccccctcaaaaattatactttcatagatcccaatatgaactgccctcttttagatggcacacattagcagttacatgtattctggttaaagtggtttttacttatgttgcttcatactctcttcttttttaccaaaggaggcaaatgccttaaaaactagtgaaatcaaattacacagtcccgagcatagttaaaatggggcctaacaaacatatgcgg

SEQ ID NO: 431 - DNA, 6188 bp, Gossypium raimondii
atggaggaaaattcttcgtcagttattttagatggtgagatagttggtataaagttctgcctggcaacccctaaagaaattcttacagcatcagtcagtggctttcctattaaccatgttagtcaactctcgaattcctaccttggtttgccccttgaatttggtaaatgtagcgcatgtggtacatcagaacctggacaatgtgaaggtcattttggatatattgaattaccaataccaatataccatcctagccatatcagtgaattaaagcgactgttgagtttgctttgcttgaagtgcctaaaattgaagaacaagtttcagatgaaaagtggcagtgtcgctgaaagattgctatcgtcctgttgtgagaatactccacaagtttcaatcaaagaggttaaaacaacagatggtgcttgttatttggagttgaagcagccatctagacaatcaaaaactaactggaattttttagagagatatggttttcgctatggcgaccatcatactcgaactcttctgccttgtgaggtggtggaaatactgaagagaattccttcacagacaagacggaaactttctgggaaagggttcttcccacaagagggatatattttgcagtatttgcctgttcccccaaattgtttatctgttccggacgtttcggacggcgttagcgtcatgtcctcggatctttctacatcaatgctgagaaaggttctgaagcaagttgaaattatcaaaagttcaaggtctggtaccccaaattttgaatcgcatgaagtagaagctaacgatttgcaatcagcagttgagcaatatcttcaagttaggggtactgttaaagcatcccgcagcatagatgcacgatacggggttaacaaagatgctagtgattcgtcaacgaaagcatggctagagaaaatgagaacactgtttattagaaagggttcagggttttcttcacgcagtgtgattactggtgatccatacaaaaaggtgaatgagattggcattccatctgaaattgctcagagaattactttcgaggagagggttaacatgcacaacatgagatatttgcaaaatctggtggataacaagttgtgtttgacctacagagatggtggttctacatattcattgagggaggggtcaaaggggcatacatttttgagacctggtcaggtggtacatcggcgaattatggatggagatattgttttcataaataggccaccgactacacataagcattcattgcaggcactttctgtatatgtacatgatgatcatacagtgaagataaatcccctaatttgtgggccattaagtgctgattttgatggagattgtattcacttgttctatccgcagtctttatcagcaaaagcagaggtttatgagcttttttcagtggagaagcagttgcttagctcccatagtggcaacctaaatttgcagttggccactgattcattgttgtcactcagagttatgcttaagacatttttgtttaaaaaggcagatgctcaacaattgtctatgtttctctcttcagctttgccagaacctgcttttttaaagtgtaatcatgttgctccatgttggacagccttccaaattctgcagaccgcttttcctgcatgcctagattgctccagtgatagatacttaattggaaaaagtgatatattgaaagttgatttcaataaggaccttatgcagtctgtcatcaatgaagttgtggcatctattttctatgagaagggtccaaaagaggttcttaacttctttgattctttacaacctttattgatggagaatatctttgcagagggcttcactgtttgtctagaagatttttctgtctctagggaagttatagaaaatattcagaaggatattcaggttatttctcccttgctttatcagttaaggtcaacttataatgaattagttgagttgcaaatggagaatcacattcgagtagccaaagagccaatagctgatttcatactaaaaacatcctctttgggtaatttaattgactctaggagtgattctgctgtcaataaggttgttcagcagattggattcttgggaatgcaactttctgataaaggaaaattctactcgaagactttggttgaagatgtggctcaccaatttcaaagcatatatccttcagatgcaatcgattatccttctgctgagtttggactgattaaaagttgctttttccgtgggcttgatccgtatgagggcattgttcattcaatatctacaagagaagtaatggttcgctccactagaggattgtctgaacctgggaccttgtttaagaatttgatggccatccttcgtgatgttgttatttgttatgatggcacagttagaaatgtcagtagcaattcaataatacaatttcaatatgggctaagtgctagaactagacctcaattccccgctggtgaacctgtgggtgtcttagctgctactgcaatgtcaaatccggcatataaagcagtgcttgattcatctcctagtagcaattcttcttgggaactgatgaaggaaatattgctttgcaaagtaagtttcaaaaatgacccaattgaccgccgtgtaattctgtatttgaaagattgtgattgtgggagaaagtattgccaagaaaatgcagcatatcttgttaagaatcatttgagaagagtcaaactcaaagatattgcagtagatttcatcattgaataccagcagcagcaaattgtatcagaaatagaggcaggccttgttgggcatatccttctcaataaggatctattgaaggagttgagtgttagtgtgcaagagattcatatgaagtgccaagaaactattaactcctttcgtaagaagaaaaaaactgctgaaacttttaagaggacagatttgtttgtcagtgaaagttgttccatccagcaatcctgtgtggacaaatggcttgacatgccatgcttgatgttcttttttcgaaatacaaatgatgataatctagatagtgctatacaaatcctggctgacatcatctaccctgttcttctacaaacagtgatcaagggtgaccctcgtatctgttcagcaaaaattatctgggttaaccctgatgcaacaacttggataagaaatccaagtaagactcagaagggtgaattggctttggaagttgttttggagaaatctgctgtgaagcagaacggtgatgcctggaggactgtcatcgattgttgtcttccagtgctaaatataattgacacccataggtctataccttatgccataaagcaagttgagcaactgctcggaatttcttgtgcttttgaacaagcagtgcagcgtctctccacttctgtgtcaatggtgacaagaggtgttctaaaggaacacctcatgctcttagctaacagcatgacatgttgtggaaatttaatcggcttcaactctggtggttataaaacactatctcgctcattgaatattcaagtgccatttaccgaagcaacactgtttacaccaagaaagtgttttgaaagggctgctgagaaatgctatgatgattccttgtcgagcatagttgcatcctgttcttggggtaaacgtgtggctgttggaacaggatcacggtttgacctcctgtggaatcaggagtctggatctgatcaaatgagtggaatggatgtctacaactttctgcacatggttagtggtgctggtggaagcaattctaatactgcttgcctgggagaagaagttgatgatttaatggatgagtggtgcttgtctccagaccatagcactggtttagataagccggtgtttgaggacgcagctgaatttgagaataatttagacggtcagtcagctagtgcaaattgggaaaaagatgtgtctttggacaaggtgtcagatgttggttgggatgcatctggatggaataaaaatgctgaggatgttgacaaatttgctgcagctgcgaccagttcggagaagcaaaatgagtggtctggttggggtgcgagcaaatctaactcacaagatgttggttgggatgctttgtctggatggaataaaaatgcagaggatggtgacaaatttgcagctgctgcaaccagttcgaagaagcaaaatgagtgttctgattggggggcgagcaaatctaaatcacaagatgttgtctctccaaaagtggatgttggttgggatgccttgtctgcatggcataaaaatgcagaggatggtgacaattttgcagcagctgcatccagttcaaagaagcaaagcgagtggtctgattgggggatgagcaaatctaaatcacaagatgtctctccaaaaacggatggaacttgtatgaaagagcaaactgaattgtctggttgggagatgaaaaagtttgatacacgagatgtccttcctgtggaagagagagcctccaagcccaatggttgggattctggtgctagttggggaataatgagcaaagaatctgaagaacttgatgctagtgctgcagctccatggtctggttgggggacaaaagattcctcccctaaaaaatctttggacaaaacttccaaatctagtagctgggatactgtttcttcttggggaaggaagactgctgcagttcatgaatctggcttcattggaaacgataaccagccgggccaagggagaattgaaaatgaatgggataataaagcaagtcaagtaaagccggtgcagtcagcatctggttggaataacaaagtgacagaggaaatggtagttcaatcgacatctagttgggatgaaaaagcttcttgggaaaagccagttcagtcaatgtctggttgggtttcctcatctgctgcaggctcagatgagtcacctacaaaaggctgtagtaagaatagtaattgggaccaacaaaaggcacagacaatgaataatgcttgggaccaacaaaagtcacctgcaacaaatagttcttgggatcggcaaaaatcatctacggcaaataattcttgggatcaacaaaagccaccagcaaatagttcttgggaccaagaaaagtcacctacaattaataattcatgggaccagcaaaagtcacccgaatgttcacagggttggggcacccttaatgacttaaaccaacctgcaagttctagtggctgggatatgccacagggtgaggataacactcaaagtgaaaaacagcatcagtggggacagagtaagggctcacgtcgttgggcttcagatgctaataagaagagtcgtcctttgaagccagctcgaatgatgaatgatgattccagtatggctgcaatgtacactgttacaagacaaagactagacatgtttacttctgaggagaaagatattctcttggatgttgagccactcatgcagtcaatcagaaaaataatgcaccagactgggtacaacgatggggatccactgtctgccgatgatcagacgtttgtacttgataatgttttagctcatcatccagacaaagctgtaaaaatgggtgctggtattgattatgtcatgagaagaaaagaaaggattaatcaattatttgttgtgcatcaccatttgatgcaaaacaggtaaacaagcacagccttttcctggataccaggtgcctctatgttgtcacaaccgatggtcataagcaagatttctcttatctcaagtgtctggagaacatgatcaaggggaaatatcctgatttggctgaagcttttgttgcaaaatatttccgaaaatctcgagggaaccgtgagcgaggtgttgctccagagaattctcaagggaaccgcgaccaaagtgttactcaagatgataactctcaagggaaccgtgaccgaagtgaccgaagtgttgctcaggacgataatgagggggaggttaagcagtaggcatctgtctctccaagtgttaatatcattcagagaggtctagttaggtattttgttcattcctgatatgaatcttttgatatgtacatgtaaagcagatgttagtgtgtttatccccctcaaaaattatactttcatagatcccaatatgaactgccctcttttagatggcacacattagcagttacatgtattctggttaaagtggtttttacttatgttgcttca

SEQ ID NO: 432 - DNA, 6675 bp, Gossypium raimondii
cctaacctaaatcttaatcaagctattaatatctagatttttcttactcaaccctaccaaccaacccaaacaataaagtaaaaatcatgtatacaccaacatgctcaaaatttccctcacaaaaagaacaccagtttctataagtccctttctctttctctctcactctcactctcactcatttgactgtccaaatcttctgttatttcacttctcctcctctctttccttcagtcagggagaggaagagagaaaaattgtacaaaatcatggaagagaaatttctagttttatttgaaaaaaaaaacatttttttgggctacattttctcttccctccccactaattttatttttttggtttgatcagtcatttctggctcttacatcgagaacccatttggtttccttctttttaaatttttttagggttttagtgtttcaaaattttagtcagaaaattcagaagaaaccaaagatatttcagggttatttcatttaggtagactaaaaagaagaaattttcgagttttgtcttatagtttaaagcgagaaacatggaggaaaattcttcgtcagttattttagatggtgagatagttggtataaagttctgcctggcaacccctaaagaaattcttacagcatcagtcagtggctttcctattaaccatgttagtcaactctcgaattcctaccttggtttgccccttgaatttggtaaatgtagcgcatgtggtacatcagaacctggacaatgtgaaggtcattttggatatattgaattaccaataccaatataccatcctagccatatcagtgaattaaagcgactgttgagtttgctttgcttgaagtgcctaaaattgaagaacaagtttcagatgaaaagtggcagtgtcgctgaaagattgctatcgtcctgttgtgagaatactccacaagtttcaatcaaagaggttaaaacaacagatggtgcttgttatttggagttgaagcagccatctagacaatcaaaaactaactggaattttttagagagatatggttttcgctatggcgaccatcatactcgaactcttctgccttgtgaggtggtggaaatactgaagagaattccttcacagacaagacggaaactttctgggaaagggttcttcccacaagagggatatattttgcagtatttgcctgttcccccaaattgtttatctgttccggacgtttcggacggcgttagcgtcatgtcctcggttctgaagcaagttgaaattatcaaaagttcaaggtctggtaccccaaattttgaatcgcatgaagtagaagctaacgatttgcaatcagcagttgagcaatatcttcaagttaggggtactgttaaagcatcccgcagcatagatgcacgatacggggttaacaaagatgctagtgattcgtcaacgaaagcatggctagagaaaatgagaacactgtttattagaaagggttcagggttttcttcacgcagtgtgattactggtgatccatacaaaaaggtgaatgagattggcattccatctgaaattgctcagagaattactttcgaggagagggttaacatgcacaacatgagatatttgcaaaatctggtggataacaagttgtgtttgacctacagagatggtggttctacatattcattgagggaggggtcaaaggggcatacatttttgagacctggtcaggtggtacatcggcgaattatggatggagatattgttttcataaataggccaccgactacacataagcattcattgcaggcactttctgtatatgtacatgatgatcatacagtgaagataaatcccctaatttgtgggccattaagtgctgattttgatggagattgtattcacttgttctatccgcagtctttatcagcaaaagcagaggtttatgagcttttttcagtggagaagcagttgcttagctcccatagtggcaacctaaatttgcagttggccactgattcattgttgtcactcagagttatgcttaagacatttttgtttaaaaaggcagatgctcaacaattgtctatgtttctctcttcagctttgccagaacctgcttttttaaagtgtaatcatgttgctccatgttggacagccttccaaattctgcagaccgcttttcctgcatgcctagattgctccagtgatagatacttaattggaaaaagtgatatattgaaagttgatttcaataaggaccttatgcagtctgtcatcaatgaagttgtggcatctattttctatgagaagggtccaaaagaggttcttaacttctttgattctttacaacctttattgatggagaatatctttgcagagggcttcactgtttgtctagaagatttttctgtctctagggaagttatagaaaatattcagaaggatattcaggttatttctcccttgctttatcagttaaggtcaacttataatgaattagttgagttgcaaatggagaatcacattcgagtagccaaagagccaatagctgatttcatactaaaaacatcctctttgggtaatttaattgactctaggagtgattctgctgtcaataaggttgttcagcagattggattcttgggaatgcaactttctgataaaggaaaattctactcgaagactttggttgaagatgtggctcaccaatttcaaagcatatatccttcagatgcaatcgattatccttctgctgagtttggactgattaaaagttgctttttccgtgggcttgatccgtatgagggcattgttcattcaatatctacaagagaagtaatggttcgctccactagaggattgtctgaacctgggaccttgtttaagaatttgatggccatccttcgtgatgttgttatttgttatgatggcacagttagaaatgtcagtagcaattcaataatacaatttcaatatgggctaagtgctagaactagacctcaattccccgctggtgaacctgtgggtgtcttagctgctactgcaatgtcaaatccggcatataaagcagtgcttgattcatctcctagtagcaattcttcttgggaactgatgaaggaaatattgctttgcaaagtaagtttcaaaaatgacccaattgaccgccgtgtaattctgtatttgaaagattgtgattgtgggagaaagtattgccaagaaaatgcagcatatcttgttaagaatcatttgagaagagtcaaactcaaagatattgcagtagatttcatcattgaataccagcagcagcaaattgtatcagaaatagaggcaggccttgttgggcatatccttctcaataaggatctattgaaggagttgagtgttagtgtgcaagagattcatatgaagtgccaagaaactattaactcctttcgtaagaagaaaaaaactgctgaaacttttaagaggacagatttgtttgtcagtgaaagttgttccatccagcaatcctgtgtggacaaatggcttgacatgccatgcttgatgttcttttttcgaaatacaaatgatgataatctagatagtgctatacaaatcctggctgacatcatctaccctgttcttctacaaacagtgatcaagggtgaccctcgtatctgttcagcaaaaattatctgggttaaccctgatgcaacaacttggataagaaatccaagtaagactcagaagggtgaattggctttggaagttgttttggagaaatctgctgtgaagcagaacggtgatgcctggaggactgtcatcgattgttgtcttccagtgctaaatataattgacacccataggtctataccttatgccataaagcaagttgagcaactgctcggaatttcttgtgcttttgaacaagcagtgcagcgtctctccacttctgtgtcaatggtgacaagaggtgttctaaaggaacacctcatgctcttagctaacagcatgacatgttgtggaaatttaatcggcttcaactctggtggttataaaacactatctcgctcattgaatattcaagtgccatttaccgaagcaacactgtttacaccaagaaagtgttttgaaagggctgctgagaaatgctatgatgattccttgtcgagcatagttgcatcctgttcttggggtaaacgtgtggctgttggaacaggatcacggtttgacctcctgtggaatcaggagtctggatctgatcaaatgagtggaatggatgtctacaactttctgcacatggttagtggtgctggtggaagcaattctaatactgcttgcctgggagaagaagttgatgatttaatggatgagtggtgcttgtctccagaccatagcactggtttagataagccggtgtttgaggacgcagctgaatttgagaataatttagacggtcagtcagctagtgcaaattgggaaaaagatgtgtctttggacaaggtgtcagatgttggttgggatgcatctggatggaataaaaatgctgaggatgttgacaaatttgctgcagctgcgaccagttcggagaagcaaaatgagtggtctggttggggtgcgagcaaatctaactcacaagatgttggttgggatgctttgtctggatggaataaaaatgcagaggatggtgacaaatttgcagctgctgcaaccagttcgaagaagcaaaatgagtgttctgattggggggcgagcaaatctaaatcacaagatgttgtctctccaaaagtggatgttggttgggatgccttgtctgcatggcataaaaatgcagaggatggtgacaattttgcagcagctgcatccagttcaaagaagcaaagcgagtggtctgattgggggatgagcaaatctaaatcacaagatgtctctccaaaaacggatggaacttgtatgaaagagcaaactgaattgtctggttgggagatgaaaaagtttgatacacgagatgtccttcctgtggaagagagagcctccaagcccaatggttgggattctggtgctagttggggaataatgagcaaagaatctgaagaacttgatgctagtgctgcagctccatggtctggttgggggacaaaagattcctcccctaaaaaatctttggacaaaacttccaaatctagtagctgggatactgtttcttcttggggaaggaagactgctgcagttcatgaatctggcttcattggaaacgataaccagccgggccaagggagaattgaaaatgaatgggataataaagcaagtcaagtaaagccggtgcagtcagcatctggttggaataacaaagtgacagaggaaatggtagttcaatcgacatctagttgggatgaaaaagcttcttgggaaaagccagttcagtcaatgtctggttgggtttcctcatctgctgcaggctcagatgagtcacctacaaaaggctgtagtaagaatagtaattgggaccaacaaaaggcacagacaatgaataatgcttgggaccaacaaaagtcacctgcaacaaatagttcttgggatcggcaaaaatcatctacggcaaataattcttgggatcaacaaaagccaccagcaaatagttcttgggaccaagaaaagtcacctacaattaataattcatgggaccagcaaaagtcacccgaatgttcacagggttggggcacccttaatgacttaaaccaacctgcaagttctagtggctgggatatgccacagggtgaggataacactcaaagtgaaaaacagcatcagtggggacagagtaagggctcacgtcgttgggcttcagatgctaataagaagagtcgtcctttgaagccagctcgaatgatgaatgatgattccagtatggctgcaatgtacactgttacaagacaaagactagacatgtttacttctgaggagaaagatattctcttggatgttgagccactcatgcagtcaatcagaaaaataatgcaccagactggaaaattcatatttgaaggtacaacgatggggatccactgtctgccgatgatcagacgtttgtacttgataatgttttagctcatcatccagacaaagctgtaaaaatgggtgctggtattgattatgtcatggtaaacaagcacagccttttcctggataccaggtgcctctatgttgtcacaaccgatggtcataagcaagatttctcttatctcaagtgtctggagaacatgatcaaggggaaatatcctgatttggctgaagcttttgttgcaaaatatttccgaaaatctcgagggaaccgtgagcgaggtgttgctccagagaattctcaagggaaccgcgaccaaagtgttactcaagatgataactctcaagggaaccgtgaccgaagtgaccgaagtgttgctcaggacgataatgagggggaggttaagcagtaggcatctgtctctccaagtgttaatatcattcagagaggtctagttaggtattttgttcattcctgatatgaatcttttgatatgtacatgtaaagcagatgttagtgtgtttatccccctcaaaaattatactttcatagatcccaatatgaactgccctcttttagatggcacacattagcagttacatgtattctggttaaagtggtttttacttatgttgcttca

SEQ ID NO: 433 - DNA, 5999 bp, Gossypium raimondii
atggaggaaaattcttcgtcagttattttagatggtgagatagttggtataaagttctgcctggcaacccctaaagaaattcttacagcatcagtcagtggctttcctattaaccatgttagtcaactctcgaattcctaccttggtttgccccttgaatttggtaaatgtagcgcatgtggtacatcagaacctggacaatgtgaaggtcattttggatatattgaattaccaataccaatataccatcctagccatatcagtgaattaaagcgactgttgagtttgctttgcttgaagtgcctaaaattgaagaacaagtttcagatgaaaagtggcagtgtcgctgaaagattgctatcgtcctgttgtgagaatactccacaagtttcaatcaaagaggttaaaacaacagatggtgcttgttatttggagttgaagcagccatctagacaatcaaaaactaactggaattttttagagagatatggttttcgctatggcgaccatcatactcgaactcttctgccttgtgaggtggtggaaatactgaagagaattccttcacagacaagacggaaactttctgggaaagggttcttcccacaagagggatatattttgcagtatttgcctgttcccccaaattgtttatctgttccggacgtttcggacggcgttagcgtcatgtcctcggatctttctacatcaatgctgagaaaggttctgaagcaagttgaaattatcaaaagttcaaggtctggtaccccaaattttgaatcgcatgaagtagaagctaacgatttgcaatcagcagttgagcaatatcttcaagttaggggtactgttaaagcatcccgcagcatagatgcacgatacggggttaacaaagatgctagtgattcgtcaacgaaagcatggctagagaaaatgagaacactgtttattagaaagggttcagggttttcttcacgcagtgtgattactggtgatccatacaaaaaggtgaatgagattggcattccatctgaaattgctcagagaattactttcgaggagagggttaacatgcacaacatgagatatttgcaaaatctggtggataacaagttgtgtttgacctacagagatggtggttctacatattcattgagggaggggtcaaaggggcatacatttttgagacctggtcaggtggtacatcggcgaattatggatggagatattgttttcataaataggccaccgactacacataagcattcattgcaggcactttctgtatatgtacatgatgatcatacagtgaagataaatcccctaatttgtgggccattaagtgctgattttgatggagattgtattcacttgttctatccgcagtctttatcagcaaaagcagaggtttatgagcttttttcagtggagaagcagttgcttagctcccatagtggcaacctaaatttgcagttggccactgattcattgttgtcactcagagttatgcttaagacatttttgtttaaaaaggcagatgctcaacaattgtctatgtttctctcttcagctttgccagaacctgcttttttaaagtgtaatcatgttgctccatgttggacagccttccaaattctgcagaccgcttttcctgcatgcctagattgctccagtgatagatacttaattggaaaaagtgatatattgaaagttgatttcaataaggaccttatgcagtctgtcatcaatgaagttgtggcatctattttctatgagaagggtccaaaagaggttcttaacttctttgattctttacaacctttattgatggagaatatctttgcagagggcttcactgtttgtctagaagatttttctgtctctagggaagttatagaaaatattcagaaggatattcaggttatttctcccttgctttatcagttaaggtcaacttataatgaattagttgagttgcaaatggagaatcacattcgagtagccaaagagccaatagctgatttcatactaaaaacatcctctttgggtaatttaattgactctaggagtgattctgctgtcaataaggttgttcagcagattggattcttgggaatgcaactttctgataaaggaaaattctactcgaagactttggttgaagatgtggctcaccaatttcaaagcatatatccttcagatgcaatcgattatccttctgctgagtttggactgattaaaagttgctttttccgtgggcttgatccgtatgagggcattgttcattcaatatctacaagagaagtaatggttcgctccactagaggattgtctgaacctgggaccttgtttaagaatttgatggccatccttcgtgatgttgttatttgttatgatggcacagttagaaatgtcagtagcaattcaataatacaatttcaatatgggctaagtgctagaactagacctcaattccccgctggtgaacctgtgggtgtcttagctgctactgcaatgtcaaatccggcatataaagcagtgcttgattcatctcctagtagcaattcttcttgggaactgatgaaggaaatattgctttgcaaagtaagtttcaaaaatgacccaattgaccgccgtgtaattctgtatttgaaagattgtgattgtgggagaaagtattgccaagaaaatgcagcatatcttgttaagaatcatttgagaagagtcaaactcaaagatattgcagtagatttcatcattgaataccagcagcagcaaattgtatcagaaatagaggcaggccttgttgggcatatccttctcaataaggatctattgaaggagttgagtgttagtgtgcaagagattcatatgaagtgccaagaaactattaactcctttcgtaagaagaaaaaaactgctgaaacttttaagaggacagatttgtttgtcagtgaaagttgttccatccagcaatcctgtgtggacaaatggcttgacatgccatgcttgatgttcttttttcgaaatacaaatgatgataatctagatagtgctatacaaatcctggctgacatcatctaccctgttcttctacaaacagtgatcaagggtgaccctcgtatctgttcagcaaaaattatctgggttaaccctgatgcaacaacttggataagaaatccaagtaagactcagaagggtgaattggctttggaagttgttttggagaaatctgctgtgaagcagaacggtgatgcctggaggactgtcatcgattgttgtcttccagtgctaaatataattgacacccataggtctataccttatgccataaagcaagttgagcaactgctcggaatttcttgtgcttttgaacaagcagtgcagcgtctctccacttctgtgtcaatggtgacaagaggtgttctaaaggaacacctcatgctcttagctaacagcatgacatgttgtggaaatttaatcggcttcaactctggtggttataaaacactatctcgctcattgaatattcaagtgccatttaccgaagcaacactgtttacaccaagaaagtgttttgaaagggctgctgagaaatgctatgatgattccttgtcgagcatagttgcatcctgttcttggggtaaacgtgtggctgttggaacaggatcacggtttgacctcctgtggaatcaggagtctggatctgatcaaatgagtggaatggatgtctacaactttctgcacatggttagtggtgctggtggaagcaattctaatactgcttgcctgggagaagaagttgatgatttaatggatgagtggtgcttgtctccagaccatagcactggtttagataagccggtgtttgaggacgcagctgaatttgagaataatttagacggtcagtcagctagtgcaaattgggaaaaagatgtgtctttggacaaggtgtcagatgttggttgggatgcatctggatggaataaaaatgctgaggatgttgacaaatttgctgcagctgcgaccagttcggagaagcaaaatgagtggtctggttggggtgcgagcaaatctaactcacaagatatgttgtctctccaaaagtggatgttggttgggatgccttgtctgcatggcataaaaatgcagaggatggtgacaattttgcagcagctgcatccagttcaaagaagcaaagcgagtggtctgattgggggatgagcaaatctaaatcacaagatgtctctccaaaaacggatggaacttgtatgaaagagcaaactgaattgtctggttgggagatgaaaaagtttgatacacgagatgtccttcctgtggaagagagagcctccaagcccaatggttgggattctggtgctagttggggaataatgagcaaagaatctgaagaacttgatgctagtgctgcagctccatggtctggttgggggacaaaagattcctcccctaaaaaatctttggacaaaacttccaaatctagtagctgggatactgtttcttcttggggaaggaagactgctgcagttcatgaatctggcttcattggaaacgataaccagccgggccaagggagaattgaaaatgaatgggataataaagcaagtcaagtaaagccggtgcagtcagcatctggttggaataacaaagtgacagaggaaatggtagttcaatcgacatctagttgggatgaaaaagcttcttgggaaaagccagttcagtcaatgtctggttgggtttcctcatctgctgcaggctcagatgagtcacctacaaaaggctgtagtaagaatagtaattgggaccaacaaaaggcacagacaatgaataatgcttgggaccaacaaaagtcacctgcaacaaatagttcttgggatcggcaaaaatcatctacggcaaataattcttgggatcaacaaaagccaccagcaaatagttcttgggaccaagaaaagtcacctacaattaataattcatgggaccagcaaaagtcacccgaatgttcacagggttggggcacccttaatgacttaaaccaacctgcaagttctagtggctgggatatgccacagggtgaggataacactcaaagtgaaaaacagcatcagtggggacagagtaagggctcacgtcgttgggcttcagatgctaataagaagagtcgtcctttgaagccagctcgaatgatgaatgatgattccagtatggctgcaatgtacactgttacaagacaaagactagacatgtttacttctgaggagaaagatattctcttggatgttgagccactcatgcagtcaatcagaaaaataatgcaccagactgggtacaacgatggggatccactgtctgccgatgatcagacgtttgtacttgataatgttttagctcatcatccagacaaagctgtaaaaatgggtgctggtattgattatgtcatggtaaacaagcacagccttttcctggataccaggtgcctctatgttgtcacaaccgatggtcataagcaagatttctcttatctcaagtgtctggagaacatgatcaaggggaaatatcctgatttggctgaagcttttgttgcaaaatatttccgaaaatctcgagggaaccgtgagcgaggtgttgctccagagaattctcaagggaaccgcgaccaaagtgttactcaagatgataactctcaagggaaccgtgaccgaagtgaccgaagtgttgctcaggacgataatgagggggaggttaagcagtaggcatctgtctctccaagtgttaatatcattcagagaggtctagttaggtattttgttcattcctgatatgaatcttttgatatgtacatgtaaagcagatgttagtgtgtttatccccctcaaaaattatactttcatagatcccaatatgaactgccctcttttagatggcacacattagcagttacatgtattctggttaaagtggtttttacttatgttgcttca

SEQ ID NO: 434 - DNA, 2952 bp, Gossypium raimondii
agccaaagcttcaagtcaaatggaaataaagatgctaaaatcatgaatattgatagaatcaatggaatgggcttaaggagatctccaagattgagttcagccccgcctgaaaccaaagattgctcttcaaaaactatctttaaatcctctgagaatggttcctactctgaaacaagaccttctggaacggataaagaagctgttctttcaaagcgcaatgacccaaacttttctgatgaaaagcagaggagaaagtctcctagatttgttgcagggactgaacattgtggcggtaatgggtctttgagaaaatttcaagatcttaactcaggctttccattgaagcagttaagaagatctctgaaaattagccaggctactaaaaatgtttgccctgatgtctctattacaagattggatatggatgaaaggggctcttctggagagaagcggttgggaatatctcccagttccgtgcacgcaacagaaaatggtgacagtaatgcatcttttagagaacataggagggaaatgtctgttgaaaagcagttgaaaacaccttcctcactttctacattattggctgaaggtgatagtgctgaagtaaactcttcttccaatagattatccaattcatgtgatgaacagccttccaagaaatttaagatctcatcagcagaatcagatattgatgatgatgatgatgaagacaagatagtttggaatgtggaatgccattatgctcaagctgaaattgatggatgtaccataaatcttggggattgtgtttatattaagggtgaagaagcaaaacaccacattggcaggatattagaattttttagaacaacagatggagaaaattattttagagtccagtggttttatagagctgaagatacagttatgaaacaagaggctactcttcatggcgaaagtcgtctattttattcaaccatagtgaatgataatctcatagattgcattatttcaaaagttagtgttactcaaatatcacctaagtttggttcaaagtcaaattctcttccccaatctgatttctattttgacatggagtattgtgtggattattcaacattctgcaccttgccaactgatatattttcagataattctttcaagagccacagttcctcaaagtgctacgaggaggttttccctacgactcctgccttttcagcaaatattcctagttttggaacttacaaggcacaactcacaaaactagatctttactctggttgtggtggaatgtcaactggtttatgccttggtgcaaaagcttcgtgcaatgatctagtggcgaaatgggcagttgacagcgataagtcgccatgtgaaagcttgaaattaaatcatccagagacacatgtcaggaatgaagctgctgatgattttcttcaactactgaaggaatgggaaaagctttgcaaacaatatagagttaaaaatttagaaagaacatatccatcaagatcgagaatctccgaaactgtctggaataatgccagttctgcaaaagattctggtactcctgatgaacatgaagtttccagtctcgttgatatttgttatggagatccctgcgacacaggcaaccgtggtctaaagtttaaggtctgctggaagggttattctgcaagtgatgatacatgggaaccaattgaaagcttaaggaattgccaagaatgtattcaggaatttgtaacaaatggattcaggtccaaaatcttgcccctccgtggggatgttgatgttatttgtggtggccctccatgccaagggataagtggttataatcgccatagaaatgttgattctccactggatgatgaaaaaaatcgtcaaattgtggtcttcgtggacatagtggaatatttaaaacctaagtttgttttaatggaaaatgtggttgatattatgagacttgtcaaggcttcacttggaagatatgctttaagtcggttggtacttatgaaataccaagcaaggcttggaatagttgcagctggttgttatggtcttcctcaatttcggttgcgtgtttttttgtttggagcacattctagtgagaaacttccacagtttccacttcctactcatgatgttattatcagatatgggtatcctgctgagtttgagcgtaatacagttgcatatgatgaaggccaaccacgtcagctggaagatgctcttgttcttcgtgattccttttctgatcttccacctgttgcaaataatgaagcccgcgaaaaaatgacatatgaaaagcctcctgaaactgactttcaaagatatataagatcaagtgaatataagatgactggttctgaattaaatggtgccaaaagaataacgaacctgttgtatgaccatcggccttctccgttatctgaggatgattatattagagtttgtctgaatccaaagagaaagggggcaaattttcgagatctccctggtgtaattgttggaacagacaatgtggcttggaggggtcgaacacaggaacagcagtttttaccatctggaaagccattggtaccagattatgtctttaccttgaaacaaggaaaatctaaaagaccatttgcaagattatggtgggatgagacaatgccgactgttctaactgcacctttttgtcacagccaggcaatattacatccagagcaagactggcttctcacagcccgggaatgggcaagactgcaaggttttcctgactattatagattccgcgggacaattaaagagaggtattgtcaaattgggaatgctgttgctgttccagttggtcgagccttaggatacacaatggggatggcatttcagaaagggagcgggaatgaaccactgatgatcctccctcctaaagttttctctttccaccaatatccagttagcaaaatcattgtcccaaaacactga

SEQ ID NO: 435 - DNA, 5183 bp, Gossypium raimondii
aaagaagtttcgattttttttgtgtgtttttggcgtttggggaaaaaaacttgtaaaaaagttaaaaatggtagaaaattttcttttttggaggaatggcgccaacatttttttccaaaatcagtgttcccgcctttctttgcttttccccttcatttatttataatgttcagtgtttcttccctttctattcatcttcactaaacactgttctcactgaacgaagccaaacatcaaagaaacagtgagtttagagctaaggttttcgtctcttctccaagtcatgggatctgtcgcgcttttggattctaattccccttcaggaatgaagaagaataagaaaggcaagaataaatctgctaaatcttccaccaagaaagagatggaaactgataaaaaagtacagaagcgtaatagtgctcaggaaaatggggagccagtcccttcaaaaaggccaaagagagctgctgcctgcactgattttaaggagaaagcagtttgcatatctgaaaaggattcagttgttgagacaaagaaggatatggtagtagaagatgaaatcctagctgtagcgctgacttgtgaaaaagatgatggccggcctaataggaggctaactgattttgtattgcataattcagaaggtcttccacaaccctttgagatgttggaagtcattgacatgttcataactggtttgatattgccgcttgaagaaaatactgacaaggaaaaagtaaaggagaagagtgttagatgtgaaggatttggacatgttgagtcttgggacatctctggttatgaagatggttgtccagtgatatggctttcaactgatgtagctgattacacctgctgtaagccaagtggcagctataaaaaatattatgaacatttctttgaaaaagctcgagcttgtgtagaggtttataaaaaactttcaaagccttctggtggaaatcctgacttaagtcttgatgaattgcttgctggtgttgttcggtccatgagtggaagcaagagcttctctcgtggggcatcaattcgggattttgttatttcccagggagaatttatttataatcaactgattggtttggatgcaacttcgagggtaaatgaccaggtatttgctggattgcctgttcttactgccctcaaagatgagagcaggaagcgtgaaaatatagggctagacatagcactgttttctggtggtgctctgactattggtaaaaaaggagagggggaaagtaaattggatgagacatattcatctacttttacagctgaggaagatgaggatgcaaagttggcaaaactgttgcaagaggaagaatactggaaatctatgaaacagaagaggaaccaaggctcagcttctatgtcaaacaaattctatatcaaaatcaatgaagatgagattgcaaatgattatcctcttccagcatactacaagaattctaatgaagaaactgatgaacttgtagtttttgaaagtgactttgatgtgtgtgatcctgaggaactccctcgaagcgtgctccacaactggtcattttacaattcagactcaaggctgatttccttggagctgcttcctatgaaaccatgtgctgacattgatgttaccatttttggttctggggttatgactgctgatgatggaatcggattctgtcttgacaatgaccttagtcagtctacttcaggttcttcgagtgtgctgaatgctgatggaattccaatttttttgagtgctattaaggaatggatgattgaatttggatcatcaatgatattcatctcaatcaggacagacatggcctggtatagacttggcaaaccatcaaagcaatatcttccatggtatgaaccagtactcaaaacagcaagggttgcaataagcattattacattgttgaaggagcaaacacgagtatcacgcctctctttcaatgatgtaattaagagggtgtctgagttcaagaaggataatcgtgcttttatatcttctgatccagcagctgttgagagatatattgttgtgcatggacagataatactacaactctttgcagagtttcctgatgaaaagattaaaaagtgtgcatttgtggttggccttgcaaataaaatggaagagagacaccatacaaaatggttagtcaagaagaagaaagttgtacacaagaatgaaccaaatttaaatcctcgagcagcaatgatgcctatagcttctataagaaaggctatgcaggcgaccacaacaaggctaatcaataggatttggggggaatactattcaaactactctccagaagattcaaaggaggaaactaattgtgaggtgaaagatgaagatgaaaatgaggaacaagaagaaaatgaagatgatgatggtgatgctaatgctgaagctgaagctgaagctgaagctgaagctgaagctgaagctgatgctaatgctaatgctgaagataaaccgattccaatggagactcagaagtctccttcagtatcaaagcaacctagacagtgttctactgaggaagtaagctgggatggagagcctgtaagccaaacaagctctgataagcctctttataaacgagccattgtacatggagaagtagttgtggtcggaagtgctgtttctgttgaagttgatttgtatgaacttcctgcaatctattttgtggagtacatgtttgaaacttcaaagggaagaaaaatgtttcatggacgaatgatgcagagaggatctgaaactgtacttggcaatgcagctaatgagagagaggtgttcctaacaaataactgtggagattttgaattggaggatgtgaaacagactgtggtggtagatattcgattaagaccttggggatatcagcataggaaagataatgccaacatggacaaacttgatagagcagaagcagaggagaggaagagaaaaggacttccaatggagtattattgtaaaagcttgtattggcctgagaggggtgccttctatacgctccccattgattctttgggtttgggttctggttgctgccattcttgccaagttaaggatgctgggagggccaaagaagtgttcaaagtgaattcatcaaatacaggctttgtatacaagggaactgagtactctctccatgattatgtctatgtcagtccacatcaatttacagtagaaagggctgagactgaaaactttaaagctgggaggaatataggcttgaagccttatgttgtgtgccaagtgctagagattattatcccaaaggggcagaaaaaagtttgtgaagagtccacccaagttaaagtcaggagatttttccgaccagaggacatttcagctgaaaaggcttacagttctgatataagagaggtctattatagtgaagaaacagacattttgtttgttgaggcaatagaaggcaaatgtgaagtcagaaagaagaacgaccttccagcatgcaattctccagtaatatttcatcatgtcttcttttgcgatcgcatatatgacccttccaatggatctctcaagcagttaccagctcaagtaaaactaaggtactcaactggaattgtggataatgaaattgcataccaaaagaaaaagggtaagggtaaacaggaagaaagtgaattagaagttgagaaacagcaagaagcatatcaggagaaccgcttggctacgttagacatatttgcaggttgtggaggtctgtcagaggggttgcaccaatctggtgtatcattaactaaatgggcaattgaatatgaagagcctgctggagatgcattcaaactcaatcatcctgagtcattggtcttcattaaaaactgcaatgtcattcttagggctattatggagaagtgtggggatgtagatgactgcatctccacttctgaggcagctgaattagcggcatcacttgatgagaaagagattaatgatttgccattaccggggcaagtagatttcatcaatggaggccctccatgccagggtttctctggaatgaatagatttaaccatagtacatggagtaaagtacaatgtgagatgattttagctttcttatcatttgctgattacttccggccaaggtatttcctcttagagaatgtgaggaacttcgtgtctttcaataaaggacagacgtttaagttaactctggcttcacttcttgaaatgggttatcaggtgaggtttggtattttggaagctggagcctatggagtttctcagtcaagaaaacgagcattcatatgggcagcctcccctgaagagactcttcctgaatggccagagccaatgcatgtctttgctgttccagagttgaaagttacattatcacataatttgcagtatgcagctgtgaggagtactgcaagtggagcccctttccgtgcaattactgtgcgagatacaattggtgatctaccagctgtaggaaatggggcctcaaagacgaatctggagtatcaaagtgaagccgtctcatggtttcagaagaaaattcgaggaaacatggctgtccttactgatcatatatcaaaggaaatgaatgagcttaacctgattcggtgtcaaaagattccaaagcgaccaggcgcagattggcatgatcttccagacgagaaggttaaactctctactggacaattggtagatttaataccctggtgtctgccaaatacagccaaaaggcacaatcaatggaaagggctatttggaaggctggattgggaagggaacttcccaacttccatcactgaccctcaaccaatgggcaaggttggaatgtgctttcatccagaacaggacaggattctgacggttcgggaatgtgctcggtctcaaggtttcccagacatctacaagtttgctggtaacattcaacacaagcaccggcagataggaaatgcggttccacctccattggcatttgcattgggaaggaaactaaaggaagcattagacagtaaaaagtgaatgtaatttgaatttttagttgatgggattttgttaaagactcctccattttaccttagacaaaaggcccttaattcatttataaaaatttgttgtctggcttttttaaaaaaatctttttttgcgctctctcccttcctatatatatattgattacaattgatca

SEQ ID NO: 436 - DNA, 5062 bp, Gossypium raimondii
ggggaaaaaaacttgtaaaaaagttaaaaatggtagaaaattttcttttttggaggaatggcgccaacatttttttccaaaatcagtgttcccgcctttctttgcttttccccttcatttatttataatgttcagtgtttcttccctttctattcatcttcactaaacactgttctcactgaacgaagccaaacatcaaagaaacagtgagtttagagctaaggttttcgtctcttctccaagtcatgggatctgtcgcgcttttggattctaattccccttcaggaatgaagaagaataagaaaggcaagaataaatctgctaaatcttccaccaagaaagagatggaaactgataaaaaagtacagaagcgtaatagtgctcaggaaaatggggagccagtcccttcaaaaaggccaaagagagctgctgcctgcactgattttaaggagaaagcagtttgcatatctgaaaaggattcagttgttgagacaaagaaggatatggtagtagaagatgaaatcctagctgtagcgctgacttgtgaaaaagatgatggccggcctaataggaggctaactgattttgtattgcataattcagaaggtcttccacaaccctttgagatgttggaagtcattgacatgttcataactggtttgatattgccgcttgaagaaaatactgacaaggaaaaagtaaaggagaagagtgttagatgtgaaggatttggacatgttgagtcttgggacatctctggttatgaagatggttgtccagtgatatggctttcaactgatgtagctgattacacctgctgtaagccaagtggcagctataaaaaatattatgaacatttctttgaaaaagctcgagcttgtgtagaggtttataaaaaactttcaaagccttctggtggaaatcctgacttaagtcttgatgaattgcttgctggtgttgttcggtccatgagtggaagcaagagcttctctcgtggggcatcaattcgggattttgttatttcccagggagaatttatttataatcaactgattggtttggatgcaacttcgagggtaaatgaccaggtatttgctggattgcctgttcttactgccctcaaagatgagagcaggaagccactgttttctggtggtgctctgactattggtaaaaaaggagagggggaaagtaaattggatgagacatattcatctacttttacagctgaggaagatgaggatgcaaagttggcaaaactgttgcaagaggaagaatactggaaatctatgaaacagaagaggaaccaaggctcagcttctatgtcaaacaaattctatatcaaaatcaatgaagatgagattgcaaatgattatcctcttccagcatactacaagaattctaatgaagaaactgatgaacttgtagtttttgaaagtgactttgatgtgtgtgatcctgaggaactccctcgaagcgtgctccacaactggtcattttacaattcagactcaaggctgatttccttggagctgcttcctatgaaaccatgtgctgacattgatgttaccatttttggttctggggttatgactgctgatgatggaatcggattctgtcttgacaatgaccttagtcagtctacttcaggttcttcgagtgtgctgaatgctgatggaattccaatttttttgagtgctattaaggaatggatgattgaatttggatcatcaatgatattcatctcaatcaggacagacatggcctggtatagacttggcaaaccatcaaagcaatatcttccatggtatgaaccagtactcaaaacagcaagggttgcaataagcattattacattgttgaaggagcaaacacgagtatcacgcctctctttcaatgatgtaattaagagggtgtctgagttcaagaaggataatcgtgcttttatatcttctgatccagcagctgttgagagatatattgttgtgcatggacagataatactacaactctttgcagagtttcctgatgaaaagattaaaaagtgtgcatttgtggttggccttgcaaataaaatggaagagagacaccatacaaaatggttagtcaagaagaagaaagttgtacacaagaatgaaccaaatttaaatcctcgagcagcaatgatgcctatagcttctataagaaaggctatgcaggcgaccacaacaaggctaatcaataggatttggggggaatactattcaaactactctccagaagattcaaaggaggaaactaattgtgaggtgaaagatgaagatgaaaatgaggaacaagaagaaaatgaagatgatgatggtgatgctaatgctgaagctgaagctgaagctgaagctgaagctgaagctgaagctgatgctaatgctaatgctgaagataaaccgattccaatggagactcagaagtctccttcagtatcaaagcaacctagacagtgttctactgaggaagtaagctgggatggagagcctgtaagccaaacaagctctgataagcctctttataaacgagccattgtacatggagaagtagttgtggtcggaagtgctgtttctgttgaagttgatttgtatgaacttcctgcaatctattttgtggagtacatgtttgaaacttcaaagggaagaaaaatgtttcatggacgaatgatgcagagaggatctgaaactgtacttggcaatgcagctaatgagagagaggtgttcctaacaaataactgtggagattttgaattggaggatgtgaaacagactgtggtggtagatattcgattaagaccttggggatatcagcataggaaagataatgccaacatggacaaacttgatagagcagaagcagaggagaggaagagaaaaggacttccaatggagtattattgtaaaagcttgtattggcctgagaggggtgccttctatacgctccccattgattctttgggtttgggttctggttgctgccattcttgccaagttaaggatgctgggagggccaaagaagtgttcaaagtgaattcatcaaatacaggctttgtatacaagggaactgagtactctctccatgattatgtctatgtcagtccacatcaatttacagtagaaagggctgagactgaaaactttaaagctgggaggaatataggcttgaagccttatgttgtgtgccaagtgctagagattattatcccaaaggggcagaaaaaagtttgtgaagagtccacccaagttaaagtcaggagatttttccgaccagaggacatttcagctgaaaaggcttacagttctgatataagagaggtctattatagtgaagaaacagacattttgtttgttgaggcaatagaaggcaaatgtgaagtcagaaagaagaacgaccttccagcatgcaattctccagtaatatttcatcatgtcttcttttgcgatcgcatatatgacccttccaatggatctctcaagcagttaccagctcaagtaaaactaaggtactcaactggaattgtggataatgaaattgcataccaaaagaaaaagggtaagggtaaacaggaagaaagtgaattagaagttgagaaacagcaagaagcatatcaggagaaccgcttggctacgttagacatatttgcaggttgtggaggtctgtcagaggggttgcaccaatctggtgtatcattaactaaatgggcaattgaatatgaagagcctgctggagatgcattcaaactcaatcatcctgagtcattggtcttcattaaaaactgcaatgtcattcttagggctattatggagaagtgtggggatgtagatgactgcatctccacttctgaggcagctgaattagcggcatcacttgatgagaaagagattaatgatttgccattaccggggcaagtagatttcatcaatggaggccctccatgccagggtttctctggaatgaatagatttaaccatagtacatggagtaaagtacaatgtgagatgattttagctttcttatcatttgctgattacttccggccaaggtatttcctcttagagaatgtgaggaacttcgtgtctttcaataaaggacagacgtttaagttaactctggcttcacttcttgaaatgggttatcaggtgaggtttggtattttggaagctggagcctatggagtttctcagtcaagaaaacgagcattcatatgggcagcctcccctgaagagactcttcctgaatggccagagccaatgcatgtctttgctgttccagagttgaaagttacattatcacataatttgcagtatgcagctgtgaggagtactgcaagtggagcccctttccgtgcaattactgtgcgagatacaattggtgatctaccagctgtaggaaatggggcctcaaagacgaatctggagtatcaaagtgaagccgtctcatggtttcagaagaaaattcgaggaaacatggctgtccttactgatcatatatcaaaggaaatgaatgagcttaacctgattcggtgtcaaaagattccaaagcgaccaggcgcagattggcatgatcttccagacgagaaggttaaactctctactggacaattggtagatttaataccctggtgtctgccaaatacagccaaaaggcacaatcaatggaaagggctatttggaaggctggattgggaagggaacttcccaacttccatcactgaccctcaaccaatgggcaaggttggaatgtgctttcatccagaacaggacaggattctgacggttcgggaatgtgctcggtctcaaggtttcccagacatctacaagtttgctggtaacattcaacacaagcaccggcagataggaaatgcggttccacctccattggcatttgcattgggaaggaaactaaaggaagcattagacagtaaaaagtgaatgtaatttgaatttttagttgatgggattttgttaaagactcctccattttaccttagacaaaaggcccttaattcatttataaaaatttgttgtctggctttttt

SEQ ID NO: 437 - DNA, 4852 bp, Gossypium raimondii
caaaaatccctttttgttttggttttgtgattttcattgcaattatcgaaggaatgaagaagaataagaaaggcaagaataaatctgctaaatcttccaccaagaaagagatggaaactgataaaaaagtacagaagcgtaatagtgctcaggaaaatggggagccagtcccttcaaaaaggccaaagagagctgctgcctgcactgattttaaggagaaagcagtttgcatatctgaaaaggattcagttgttgagacaaagaaggatatggtagtagaagatgaaatcctagctgtagcgctgacttgtgaaaaagatgatggccggcctaataggaggctaactgattttgtattgcataattcagaaggtcttccacaaccctttgagatgttggaagtcattgacatgttcataactggtttgatattgccgcttgaagaaaatactgacaaggaaaaagtaaaggagaagagtgttagatgtgaaggatttggacatgttgagtcttgggacatctctggttatgaagatggttgtccagtgatatggctttcaactgatgtagctgattacacctgctgtaagccaagtggcagctataaaaaatattatgaacatttctttgaaaaagctcgagcttgtgtagaggtttataaaaaactttcaaagccttctggtggaaatcctgacttaagtcttgatgaattgcttgctggtgttgttcggtccatgagtggaagcaagagcttctctcgtggggcatcaattcgggattttgttatttcccagggagaatttatttataatcaactgattggtttggatgcaacttcgagggtaaatgaccaggtatttgctggattgcctgttcttactgccctcaaagatgagagcaggaagcgtgaaaatatagggctagacatagcactgttttctggtggtgctctgactattggtaaaaaaggagagggggaaagtaaattggatgagacatattcatctacttttacagctgaggaagatgaggatgcaaagttggcaaaactgttgcaagaggaagaatactggaaatctatgaaacagaagaggaaccaaggctcagcttctatgtcaaacaaattctatatcaaaatcaatgaagatgagattgcaaatgattatcctcttccagcatactacaagaattctaatgaagaaactgatgaacttgtagtttttgaaagtgactttgatgtgtgtgatcctgaggaactccctcgaagcgtgctccacaactggtcattttacaattcagactcaaggctgatttccttggagctgcttcctatgaaaccatgtgctgacattgatgttaccatttttggttctggggttatgactgctgatgatggaatcggattctgtcttgacaatgaccttagtcagtctacttcaggttcttcgagtgtgctgaatgctgatggaattccaatttttttgagtgctattaaggaatggatgattgaatttggatcatcaatgatattcatctcaatcaggacagacatggcctggtatagacttggcaaaccatcaaagcaatatcttccatggtatgaaccagtactcaaaacagcaagggttgcaataagcattattacattgttgaaggagcaaacacgagtatcacgcctctctttcaatgatgtaattaagagggtgtctgagttcaagaaggataatcgtgcttttatatcttctgatccagcagctgttgagagatatattgttgtgcatggacagataatactacaactctttgcagagtttcctgatgaaaagattaaaaagtgtgcatttgtggttggccttgcaaataaaatggaagagagacaccatacaaaatggttagtcaagaagaagaaagttgtacacaagaatgaaccaaatttaaatcctcgagcagcaatgatgcctatagcttctataagaaaggctatgcaggcgaccacaacaaggctaatcaataggatttggggggaatactattcaaactactctccagaagattcaaaggaggaaactaattgtgaggtgaaagatgaagatgaaaatgaggaacaagaagaaaatgaagatgatgatggtgatgctaatgctgaagctgaagctgaagctgaagctgaagctgaagctgaagctgatgctaatgctaatgctgaagataaaccgattccaatggagactcagaagtctccttcagtatcaaagcaacctagacagtgttctactgaggaagtaagctgggatggagagcctgtaagccaaacaagctctgataagcctctttataaacgagccattgtacatggagaagtagttgtggtcggaagtgctgtttctgttgaagttgatttgtatgaacttcctgcaatctattttgtggagtacatgtttgaaacttcaaagggaagaaaaatgtttcatggacgaatgatgcagagaggatctgaaactgtacttggcaatgcagctaatgagagagaggtgttcctaacaaataactgtggagattttgaattggaggatgtgaaacagactgtggtggtagatattcgattaagaccttggggatatcagcataggaaagataatgccaacatggacaaacttgatagagcagaagcagaggagaggaagagaaaaggacttccaatggagtattattgtaaaagcttgtattggcctgagaggggtgccttctatacgctccccattgattctttgggtttgggttctggttgctgccattcttgccaagttaaggatgctgggagggccaaagaagtgttcaaagtgaattcatcaaatacaggctttgtatacaagggaactgagtactctctccatgattatgtctatgtcagtccacatcaatttacagtagaaagggctgagactgaaaactttaaagctgggaggaatataggcttgaagccttatgttgtgtgccaagtgctagagattattatcccaaaggggcagaaaaaagtttgtgaagagtccacccaagttaaagtcaggagatttttccgaccagaggacatttcagctgaaaaggcttacagttctgatataagagaggtctattatagtgaagaaacagacattttgtttgttgaggcaatagaaggcaaatgtgaagtcagaaagaagaacgaccttccagcatgcaattctccagtaatatttcatcatgtcttcttttgcgatcgcatatatgacccttccaatggatctctcaagcagttaccagctcaagtaaaactaaggtactcaactggaattgtggataatgaaattgcataccaaaagaaaaagggtaagggtaaacaggaagaaagtgaattagaagttgagaaacagcaagaagcatatcaggagaaccgcttggctacgttagacatatttgcaggttgtggaggtctgtcagaggggttgcaccaatctggtgtatcattaactaaatgggcaattgaatatgaagagcctgctggagatgcattcaaactcaatcatcctgagtcattggtcttcattaaaaactgcaatgtcattcttagggctattatggagaagtgtggggatgtagatgactgcatctccacttctgaggcagctgaattagcggcatcacttgatgagaaagagattaatgatttgccattaccggggcaagtagatttcatcaatggaggccctccatgccagggtttctctggaatgaatagatttaaccatagtacatggagtaaagtacaatgtgagatgattttagctttcttatcatttgctgattacttccggccaaggtatttcctcttagagaatgtgaggaacttcgtgtctttcaataaaggacagacgtttaagttaactctggcttcacttcttgaaatgggttatcaggtgaggtttggtattttggaagctggagcctatggagtttctcagtcaagaaaacgagcattcatatgggcagcctcccctgaagagactcttcctgaatggccagagccaatgcatgtctttgctgttccagagttgaaagttacattatcacataatttgcagtatgcagctgtgaggagtactgcaagtggagcccctttccgtgcaattactgtgcgagatacaattggtgatctaccagctgtaggaaatggggcctcaaagacgaatctggagtatcaaagtgaagccgtctcatggtttcagaagaaaattcgaggaaacatggctgtccttactgatcatatatcaaaggaaatgaatgagcttaacctgattcggtgtcaaaagattccaaagcgaccaggcgcagattggcatgatcttccagacgagaaggttaaactctctactggacaattggtagatttaataccctggtgtctgccaaatacagccaaaaggcacaatcaatggaaagggctatttggaaggctggattgggaagggaacttcccaacttccatcactgaccctcaaccaatgggcaaggttggaatgtgctttcatccagaacaggacaggattctgacggttcgggaatgtgctcggtctcaaggtttcccagacatctacaagtttgctggtaacattcaacacaagcaccggcagataggaaatgcggttccacctccattggcatttgcattgggaaggaaactaaaggaagcattagacagtaaaaagtgaatgtaatttgaatttttagttgatgggattttgttaaagactcctccattttaccttagacaaaaggcccttaattcatttataaaaatttgttgtctggctttttt

SEQ ID NO: 438 - DNA, 4924 bp, Gossypium raimondii
atcatgcagtgatatagaagaggcatgttgtgtttatgctataccatttatttatatttttgtttctgatggttttttaaagtgcctaaactcaagttcacaagatctttttttggcatttaggaatgaagaagaataagaaaggcaagaataaatctgctaaatcttccaccaagaaagagatggaaactgataaaaaagtacagaagcgtaatagtgctcaggaaaatggggagccagtcccttcaaaaaggccaaagagagctgctgcctgcactgattttaaggagaaagcagtttgcatatctgaaaaggattcagttgttgagacaaagaaggatatggtagtagaagatgaaatcctagctgtagcgctgacttgtgaaaaagatgatggccggcctaataggaggctaactgattttgtattgcataattcagaaggtcttccacaaccctttgagatgttggaagtcattgacatgttcataactggtttgatattgccgcttgaagaaaatactgacaaggaaaaagtaaaggagaagagtgttagatgtgaaggatttggacatgttgagtcttgggacatctctggttatgaagatggttgtccagtgatatggctttcaactgatgtagctgattacacctgctgtaagccaagtggcagctataaaaaatattatgaacatttctttgaaaaagctcgagcttgtgtagaggtttataaaaaactttcaaagccttctggtggaaatcctgacttaagtcttgatgaattgcttgctggtgttgttcggtccatgagtggaagcaagagcttctctcgtggggcatcaattcgggattttgttatttcccagggagaatttatttataatcaactgattggtttggatgcaacttcgagggtaaatgaccaggtatttgctggattgcctgttcttactgccctcaaagatgagagcaggaagcgtgaaaatatagggctagacatagcactgttttctggtggtgctctgactattggtaaaaaaggagagggggaaagtaaattggatgagacatattcatctacttttacagctgaggaagatgaggatgcaaagttggcaaaactgttgcaagaggaagaatactggaaatctatgaaacagaagaggaaccaaggctcagcttctatgtcaaacaaattctatatcaaaatcaatgaagatgagattgcaaatgattatcctcttccagcatactacaagaattctaatgaagaaactgatgaacttgtagtttttgaaagtgactttgatgtgtgtgatcctgaggaactccctcgaagcgtgctccacaactggtcattttacaattcagactcaaggctgatttccttggagctgcttcctatgaaaccatgtgctgacattgatgttaccatttttggttctggggttatgactgctgatgatggaatcggattctgtcttgacaatgaccttagtcagtctacttcaggttcttcgagtgtgctgaatgctgatggaattccaatttttttgagtgctattaaggaatggatgattgaatttggatcatcaatgatattcatctcaatcaggacagacatggcctggtatagacttggcaaaccatcaaagcaatatcttccatggtatgaaccagtactcaaaacagcaagggttgcaataagcattattacattgttgaaggagcaaacacgagtatcacgcctctctttcaatgatgtaattaagagggtgtctgagttcaagaaggataatcgtgcttttatatcttctgatccagcagctgttgagagatatattgttgtgcatggacagataatactacaactctttgcagagtttcctgatgaaaagattaaaaagtgtgcatttgtggttggccttgcaaataaaatggaagagagacaccatacaaaatggttagtcaagaagaagaaagttgtacacaagaatgaaccaaatttaaatcctcgagcagcaatgatgcctatagcttctataagaaaggctatgcaggcgaccacaacaaggctaatcaataggatttggggggaatactattcaaactactctccagaagattcaaaggaggaaactaattgtgaggtgaaagatgaagatgaaaatgaggaacaagaagaaaatgaagatgatgatggtgatgctaatgctgaagctgaagctgaagctgaagctgaagctgaagctgaagctgatgctaatgctaatgctgaagataaaccgattccaatggagactcagaagtctccttcagtatcaaagcaacctagacagtgttctactgaggaagtaagctgggatggagagcctgtaagccaaacaagctctgataagcctctttataaacgagccattgtacatggagaagtagttgtggtcggaagtgctgtttctgttgaagttgatttgtatgaacttcctgcaatctattttgtggagtacatgtttgaaacttcaaagggaagaaaaatgtttcatggacgaatgatgcagagaggatctgaaactgtacttggcaatgcagctaatgagagagaggtgttcctaacaaataactgtggagattttgaattggaggatgtgaaacagactgtggtggtagatattcgattaagaccttggggatatcagcataggaaagataatgccaacatggacaaacttgatagagcagaagcagaggagaggaagagaaaaggacttccaatggagtattattgtaaaagcttgtattggcctgagaggggtgccttctatacgctccccattgattctttgggtttgggttctggttgctgccattcttgccaagttaaggatgctgggagggccaaagaagtgttcaaagtgaattcatcaaatacaggctttgtatacaagggaactgagtactctctccatgattatgtctatgtcagtccacatcaatttacagtagaaagggctgagactgaaaactttaaagctgggaggaatataggcttgaagccttatgttgtgtgccaagtgctagagattattatcccaaaggggcagaaaaaagtttgtgaagagtccacccaagttaaagtcaggagatttttccgaccagaggacatttcagctgaaaaggcttacagttctgatataagagaggtctattatagtgaagaaacagacattttgtttgttgaggcaatagaaggcaaatgtgaagtcagaaagaagaacgaccttccagcatgcaattctccagtaatatttcatcatgtcttcttttgcgatcgcatatatgacccttccaatggatctctcaagcagttaccagctcaagtaaaactaaggtactcaactggaattgtggataatgaaattgcataccaaaagaaaaagggtaagggtaaacaggaagaaagtgaattagaagttgagaaacagcaagaagcatatcaggagaaccgcttggctacgttagacatatttgcaggttgtggaggtctgtcagaggggttgcaccaatctggtgtatcattaactaaatgggcaattgaatatgaagagcctgctggagatgcattcaaactcaatcatcctgagtcattggtcttcattaaaaactgcaatgtcattcttagggctattatggagaagtgtggggatgtagatgactgcatctccacttctgaggcagctgaattagcggcatcacttgatgagaaagagattaatgatttgccattaccggggcaagtagatttcatcaatggaggccctccatgccagggtttctctggaatgaatagatttaaccatagtacatggagtaaagtacaatgtgagatgattttagctttcttatcatttgctgattacttccggccaaggtatttcctcttagagaatgtgaggaacttcgtgtctttcaataaaggacagacgtttaagttaactctggcttcacttcttgaaatgggttatcaggtgaggtttggtattttggaagctggagcctatggagtttctcagtcaagaaaacgagcattcatatgggcagcctcccctgaagagactcttcctgaatggccagagccaatgcatgtctttgctgttccagagttgaaagttacattatcacataatttgcagtatgcagctgtgaggagtactgcaagtggagcccctttccgtgcaattactgtgcgagatacaattggtgatctaccagctgtaggaaatggggcctcaaagacgaatctggagtatcaaagtgaagccgtctcatggtttcagaagaaaattcgaggaaacatggctgtccttactgatcatatatcaaaggaaatgaatgagcttaacctgattcggtgtcaaaagattccaaagcgaccaggcgcagattggcatgatcttccagacgagaaggttaaactctctactggacaattggtagatttaataccctggtgtctgccaaatacagccaaaaggcacaatcaatggaaagggctatttggaaggctggattgggaagggaacttcccaacttccatcactgaccctcaaccaatgggcaaggttggaatgtgctttcatccagaacaggacaggattctgacggttcgggaatgtgctcggtctcaaggtttcccagacatctacaagtttgctggtaacattcaacacaagcaccggcagataggaaatgcggttccacctccattggcatttgcattgggaaggaaactaaaggaagcattagacagtaaaaagtgaatgtaatttgaatttttagttgatgggattttgttaaagactcctccattttaccttagacaaaaggcccttaattcatttataaaaatttgttgtctggctttttt

SEQ ID NO: 439 - DNA, 2095 bp, Gossypium raimondii
gaatagtgcctttttgcttaacgtattgtatatctgtgtgtgtgtgtgtttactctgtttggctttaacgagatagtgaaggaaaaggagaaggaaaatgtcgatacatgatatatatgtgcttgctctgtttggctttgacgaaagtgaaggaaaatgttaatatgtttgttcatccatggaagggcatcattgccaatattccaacaacattgcaagatggaaaacatgtaggggaaagtggaaggaaactgagggaggatttggcaaaaaagggattcaatccattgaaggttcaacctctttggaaccgacacggtcactcaggatacgccatagtagagttcaataaagaatgggatggttttaacaatgccatcatgtttgaaaagagttttgaattggaccattatggaaagaaggattactactcatctcggaggaaaaaagacaaattgtatgcatgggttgctcgtgaagacgactactactctggtggactgattggtgaatatcttcgtaggaacggagacttgaagaccgtttcgagcaaagaagccgaagatcgaaggaagacctcaaagctattgacaacactaaacaataccttggagaccaagaatcaacgccttcaggaaatgcagaacaaattcaatgaagtgagtagctcaatgagtacattgatgtggcaaaaagatgacatgatcagagcttataatgaagagtgtaaaaagatgcaggagaatgctcataatcatttcaagcagatttctttagaacatgagaggaatgcaaaatgtattctagaccagaaaagagaattagagcagcgtgagaaggaattgttgcaacgggaggcccaaaatgaaaatgagaccaaaaaacttcagcacgagaagatgataaacgagagagcagccttggaacaaaagaaggctgatgaaactatgttcaaactggctgaagagcacaagagagataaagagaaacttcacagagaaatcattaagctagaaaagcaacttgatactagacaaggattagaacttgagatacagcgtttgagaggggctttacaagtgatggagcacatgaatggtgatggggatgcagacacaaagaaaaggatggaggtaattcaagatgaactgaaagaaaaggaagaagaactggaagacttggaagatcttaatcaagctcttatcatcaaggaacgcaaaagcaatgatgagttgcaagatgcccgaaaagagctaatcactgcatttaaagatgtttccaccagagctcatattggtgtcaagaaaatgggagaagtggacattaaacccttcttagttgctgccaaaagaaaatactcagctaaagaagctgatgtgaaatcagcagagctatgtacactgtggcaagactatcttagagatcctagctggcatccttttaaaatcctcaaagacaaggaaggaaattgcaaggaaatacttgatgaggaagatgaaaaattggtcgaactcaagacagagctcggcgacgaagcatacaatgctgtgacgatggcattgaaacagatgaacgagtacaatccgagcggcagatacgtagtaccggaactttggaatttcaatgaaggaaggaaggcaacattaactgatggagtgcaacatttactgaacaaatggaaactgcataagcgtaggagatactaaaatttcttcatcaattttctttcactgaaggatcattttgcaaatcttcgaaaaaaaggtaaacttatactgcaagacagagaaaatgtgttaattcttcccccaagtaaaccaagttgaacgtacttttttgttttaagaagtttgattaggtttttactagttcgagctccaacttaatatacttgaattagtcaatgattgagcttggattaaatttcaaactcttttttcgagtggaactgtatttagcttatttgaattttttttggagttgaatggtattagaggtaaaagttaggagtgtaaaagaattgttctcaagcaaacaaagctttgtttgcatttgtttgtttatttttaaagttgtttatgttcggttcgtattc

SEQ ID NO: 440 - DNA, 2029 bp, Gossypium raimondii
gtaactctaggtttttcaaggttttcagtgttccacggcggtgattttgcgacgacggtgatctgttttcaagcttcttgccaaagtttcgtcaacgaatcatcgtctttgtaaggtaaggcatcattgccaatattccaacaacattgcaagatggaaaacatgtaggggaaagtggaaggaaactgagggaggatttggcaaaaaagggattcaatccattgaaggttcaacctctttggaaccgacacggtcactcaggatacgccatagtagagttcaataaagaatgggatggttttaacaatgccatcatgtttgaaaagagttttgaattggaccattatggaaagaaggattactactcatctcggaggaaaaaagacaaattgtatgcatgggttgctcgtgaagacgactactactctggtggactgattggtgaatatcttcgtaggaacggagacttgaagaccgtttcgagcaaagaagccgaagatcgaaggaagacctcaaagctattgacaacactaaacaataccttggagaccaagaatcaacgccttcaggaaatgcagaacaaattcaatgaagtgagtagctcaatgagtacattgatgtggcaaaaagatgacatgatcagagcttataatgaagagtgtaaaaagatgcaggagaatgctcataatcatttcaagcagatttctttagaacatgagaggaatgcaaaatgtattctagaccagaaaagagaattagagcagcgtgagaaggaattgttgcaacgggaggcccaaaatgaaaatgagaccaaaaaacttcagcacgagaagatgataaacgagagagcagccttggaacaaaagaaggctgatgaaactatgttcaaactggctgaagagcacaagagagataaagagaaacttcacagagaaatcattaagctagaaaagcaacttgatactagacaaggattagaacttgagatacagcgtttgagaggggctttacaagtgatggagcacatgaatggtgatggggatgcagacacaaagaaaaggatggaggtaattcaagatgaactgaaagaaaaggaagaagaactggaagacttggaagatcttaatcaagctcttatcatcaaggaacgcaaaagcaatgatgagttgcaagatgcccgaaaagagctaatcactgcatttaaagatgtttccaccagagctcatattggtgtcaagaaaatgggagaagtggacattaaacccttcttagttgctgccaaaagaaaatactcagctaaagaagctgatgtgaaatcagcagagctatgtacactgtggcaagactatcttagagatcctagctggcatccttttaaaatcctcaaagacaaggaaggaaattgcaaggaaatacttgatgaggaagatgaaaaattggtcgaactcaagacagagctcggcgacgaagcatacaatgctgtgacgatggcattgaaacagatgaacgagtacaatccgagcggcagatacgtagtaccggaactttggaatttcaatgaaggaaggaaggcaacattaactgatggagtgcaacatttactgaacaaatggaaactgcataagcgtaggagatactaaaatttcttcatcaattttctttcactgaaggatcattttgcaaatcttcgaaaaaaaggtaaacttatactgcaagacagagaaaatgtgttaattcttcccccaagtaaaccaagttgaacgtacttttttgttttaagaagtttgattaggtttttactagttcgagctccaacttaatatacttgaattagtcaatgattgagcttggattaaatttcaaactcttttttcgagtggaactgtatttagcttatttgaattttttttggagttgaatggtattagaggtaaaagttaggagtgtaaaagaattgttctcaagcaaacaaagctttgtttgcatttgtttgtttatttttaaagttgtttatgttcggttcgtattc

SEQ ID NO: 441 - DNA, 2279 bp, Gossypium raimondii
aaaaaaaaaaaatccacggccatagccaaaaccttctactttgattcctccattttcgttccttgcatgcatcagcttttctcttcttcttctttttctgcaccgactattgtgaactgcactatcgacttaacggatttctttgagataatttcaggatcagattaacaattttgtctttgattcgttgatgttgagaagcttttcttggcccatactacaagtcaaaagaatggttgacaataattcgggtggagaagctgataattttgactgggatactgaagatgatctggaaatcgataattatgccatctcggccccttcgggtttgtctactccctgtggagaagctgttttgggttcggcagaggcgggctcatctggaaattctcccaattccaagataattgatcattttgtcggaatggggttctcaagagaaatggttgccaaagtgattgaagaaaaaggagaggaaaactcagacttgatacttgaaaccctccttgagtactcggcaagcacattacctagttcttccaattccaagttgatcgatcattttgtagggatgggattttctgaagaaatggttgtcaaagtggttcaggaaaatggagagggaaatacagattccatattggagactctattgacatattcagcacttgaaacaactgctcccgttcagcaaaatcctgactctggtaactgctcatcagattatgaagggagtttgctgaatgatttctctgattttgatagtttttctgagaccgaggaaattattagtcctagttctgaggaggggagaaaattgttacacttgacaaaaatggggtactcagaagcggaggcttcagtagccatggagagatgtggtccagactccacaattgaggagttaacggactttatatgtgctgcacaaattgcaaaggctgctgatgcactttttccacttgaagacaagaagccattcagcaatggctctagtcacaagaagaggcgaaactggggttatgatttgttgttaaggaagaagaagcttaagcttgaaaagaggtttgatgaagatgatgatgtagttcatcttcctaatcctatgattggttttggggtccccaatgaaccagatcagatcactcatagagtacttccagaagcagctttagggcctccatacttctactacgagaatgtagcacttgctccaaaaggtgtttggaccaccatttcgcgcttcttatatgatgtggagcctgagtttgttgattcaaagttcttttgtgctgctgcaaggaagaggggctatgttcataatctgccaattgacaatagatttccccttcttccatttcctccacgaactattcatgaagcttttccactaacaaggaaatggtggccatcctgggacacgcgaacgaaattgaactgcttgcaaacctgtatagcaagtgcaagattgacggataagattcgcaaggcattagaagattctgatggtgaaccgctgttgggcatccaaaagtttgttctcgaacaatgcagaaagtggaatctggtttgggttggaaggaacaaggttgctccacttgaacctgatgaagtggaaatgcttttgggattccctagaaaccacacaagaggagggggaatcagtcggacagatagatacaaatcacttggtaactcatttcagattgacacagtggcgtatcacttttcggttttaaaagataagttccccggtggtatcaatctgttgtctcttttctctgggattggaggtgcggaggttgctctccaccgactcggtatccctttgaaaaatgtggtagcggtggaaatagctgaagtgaaccgaaatattcttaggagttggtgggaacaaacaaaccagagaggtactttgactgacatccaagatgttcaagaactaaacggggaccgtttggagcaactgattaaaaattttggaggatttgaccttgtggtgggagggagtccttgcaacaacctcactggcagcaatagatatcatcgagacggactcgaaggtaaagattctgccctcttctttgatttctgtcgaatactggatttggtgaaatgtattatgaatggcacgaaatcaatgattgtctgaagaagattgcatttgaaataatttccgaaactcctcttaatatcaaattaaaagggaaatgaagtgctgtttaagcaaatatatatttatcattccggcttactcgtcgtattagacactgttt

SEQ ID NO: 442 - DNA, 2276 bp, Gossypium raimondii
aaaaaaaaaaaatccacggccatagccaaaaccttctactttgattcctccattttcgttccttgcatgcatcagcttttctcttcttcttctttttctgcaccgactattgtgaactgcactatcgacttaacggatttctttgagataatttcaggatcagattaacaattttgtctttgattcgttgatgttgagaagcttttcttggcccatactacaagtcaaaagaatggttgacaataattcgggtggagaagctgataattttgactgggatactgaagatgatctggaaatcgataattatgccatctcggccccttcgggtttgtctactccctgtggagaagctgttttgggttcggcagaggcgggctcatctggaaattctcccaattccaagataattgatcattttgtcggaatggggttctcaagagaaatggttgccaaagtgattgaagaaaaaggagaggaaaactcagacttgatacttgaaaccctccttgagtactcggcaagcacattacctagttcttccaattccaagttgatcgatcattttgtagggatgggattttctgaagaaatggttgtcaaagtggttcaggaaaatggagagggaaatacagattccatattggagactctattgacatattcagcacttgaaacaactgctcccgttcagcaaaatcctgactctggtaactgctcatcagattatgaagggagtttgctgaatgatttctctgattttgatagtttttctgagaccgaggaaattattagtcctagttctgaggaggggagaaaattgttacacttgacaaaaatggggtactcagaagcggaggcttcagtagccatggagagatgtggtccagactccacaattgaggagttaacggactttatatgtgctgcacaaattgcaaaggctgctgatgcactttttccacttgaagacaagccattcagcaatggctctagtcacaagaagaggcgaaactggggttatgatttgttgttaaggaagaagaagcttaagcttgaaaagaggtttgatgaagatgatgatgtagttcatcttcctaatcctatgattggttttggggtccccaatgaaccagatcagatcactcatagagtacttccagaagcagctttagggcctccatacttctactacgagaatgtagcacttgctccaaaaggtgtttggaccaccatttcgcgcttcttatatgatgtggagcctgagtttgttgattcaaagttcttttgtgctgctgcaaggaagaggggctatgttcataatctgccaattgacaatagatttccccttcttccatttcctccacgaactattcatgaagcttttccactaacaaggaaatggtggccatcctgggacacgcgaacgaaattgaactgcttgcaaacctgtatagcaagtgcaagattgacggataagattcgcaaggcattagaagattctgatggtgaaccgctgttgggcatccaaaagtttgttctcgaacaatgcagaaagtggaatctggtttgggttggaaggaacaaggttgctccacttgaacctgatgaagtggaaatgcttttgggattccctagaaaccacacaagaggagggggaatcagtcggacagatagatacaaatcacttggtaactcatttcagattgacacagtggcgtatcacttttcggttttaaaagataagttccccggtggtatcaatctgttgtctcttttctctgggattggaggtgcggaggttgctctccaccgactcggtatccctttgaaaaatgtggtagcggtggaaatagctgaagtgaaccgaaatattcttaggagttggtgggaacaaacaaaccagagaggtactttgactgacatccaagatgttcaagaactaaacggggaccgtttggagcaactgattaaaaattttggaggatttgaccttgtggtgggagggagtccttgcaacaacctcactggcagcaatagatatcatcgagacggactcgaaggtaaagattctgccctcttctttgatttctgtcgaatactggatttggtgaaatgtattatgaatggcacgaaatcaatgattgtctgaagaagattgcatttgaaataatttccgaaactcctcttaatatcaaattaaaagggaaatgaagtgctgtttaagcaaatatatatttatcattccggcttactcgtcgtattagacactgttt

SEQ ID NO: 443 - DNA, 2018 bp, Gossypium raimondii
aggttgagaagcttttcttggcccatactacaagtcaaaagaatggttgacaataattcgggtggagaagctgataattttgactgggatactgaagatgatctggaaatcgataattatgccatctcggccccttcgggtttgtctactccctgtggagaagctgttttgggttcggcagaggcgggctcatctggaaattctcccaattccaagataattgatcattttgtcggaatggggttctcaagagaaatggttgccaaagtgattgaagaaaaaggagaggaaaactcagacttgatacttgaaaccctccttgagtactcggcaagcacattacctagttcttccaattccaagttgatcgatcattttgtagggatgggattttctgaagaaatggttgtcaaagtggttcaggaaaatgattccatattggagactctattgacatattcagcacttgaaacaactgctcccgttcagcaaaatcctgactctggtaactgctcatcagattatgaagggagtttgctgaatgatttctctgattttgatagtttttctgagaccgaggaaattattagtcctagttctgaggaggggagaaaattgttacacttgacaaaaatggggtactcagaagcggaggcttcagtagccatggagagatgtggtccagactccacaattgaggagttaacggactttatatgtgctgcacaaattgcaaaggctgctgatgcactttttccacttgaagacaagaagccattcagcaatggctctagtcacaagaagaggcgaaactggggttatgatttgttgttaaggaagaagaagcttaagcttgaaaagaggtttgatgaagatgatgatgtagttcatcttcctaatcctatgattggttttggggtccccaatgaaccagatcagatcactcatagagtacttccagaagcagctttagggcctccatacttctactacgagaatgtagcacttgctccaaaaggtgtttggaccaccatttcgcgcttcttatatgatgtggagcctgagtttgttgattcaaagttcttttgtgctgctgcaaggaagaggggctatgttcataatctgccaattgacaatagatttccccttcttccatttcctccacgaactattcatgaagcttttccactaacaaggaaatggtggccatcctgggacacgcgaacgaaattgaactgcttgcaaacctgtatagcaagtgcaagattgacggataagattcgcaaggcattagaagattctgatggtgaaccgctgttgggcatccaaaagtttgttctcgaacaatgcagaaagtggaatctggtttgggttggaaggaacaaggttgctccacttgaacctgatgaagtggaaatgcttttgggattccctagaaaccacacaagaggagggggaatcagtcggacagatagatacaaatcacttggtaactcatttcagattgacacagtggcgtatcacttttcggttttaaaagataagttccccggtggtatcaatctgttgtctcttttctctgggattggaggtgcggaggttgctctccaccgactcggtatccctttgaaaaatgtggtagcggtggaaatagctgaagtgaaccgaaatattcttaggagttggtgggaacaaacaaaccagagaggtactttgactgacatccaagatgttcaagaactaaacggggaccgtttggagcaactgattaaaaattttggaggatttgaccttgtggtgggagggagtccttgcaacaacctcactggcagcaatagatatcatcgagacggactcgaaggtaaagattctgccctcttctttgatttctgtcgaatactggatttggtgaaatgtattatgaatggcacgaaatcaatgattgtctgaagaagattgcatttgaaataatttccgaaactcctcttaatatcaaattaaaagggaaatgaagtgct

SEQ ID NO: 444 - DNA, 2509 bp, Gossypium raimondii
aatatttataaataattacataggtgactttccaaacacaatcatagttatagaaaaaaattgaaaaaccctgtgaaaactgaacccacagctcctcgtttcctcttcttctccgttaccgccgttggggcttcccctatgtatattttatttctttttctccaccggtaacttctgtgtcagaactcgtcgacgatcgccgctgctgccgtgttaagaaactgttcttgggctgtactatagctcaaggaaaatggatcaaaatggttctggtggtgatgctgataattttgactgggataccgaagatgagctggaaattgataattatgcaatcgcctctcgctcaggagtgtcacttaccaatggggaagctgttttaggcacagcagaggtgagctcgtctgcagattctccgaattccaagttaattgatcattttgttgggatggggttctcccaggaacttgttacgaaagcaattgaggaaaatggagaggagaattcaaatttgatacttgaagctctccttcggtactctgcaagctcgttggctagttcttccaattccaagttgattgatcattttgttgggatgggattctctgaagaaatggttctcaaagcggttcaagaaaatggagaggggaatacagataccatattggagactctattgacatattcggctcttgaaaagtctgctcctgtgcaacaacatgctgattctgatgacttctcgtcagattgtgaagggaattttttggatgatttcacagatattgatagttcttctgataccgaggaaataattaatactggttctgatgaggagagtaaactgttgtacttgacaaaaatggggtactcagaggctgaggcttcagtagccatggagagatgcggtccagactcatcaattgcagagctgacagactttatatgtgctgctcaaatggctaaggctgctgatgcacttttccctgttgaagacaggaagccattctgcaatggctctaattacaataaaaggcgaaacttgggctatgatttgtggaaaaggaagaagcagatgaagcttgaaaagaagcttcttaatgaagatgatgatgcccttcatcttcctaatcctatgattggttttggggtcccaactgaaccagatctgataactcaaagaacacttccagaagctgctgttgggcctccttatttctactatgagaatgtggcacttgctccaaaaggcgtttggagcaccatttcacggttcttatatgatgtggaaccagagtttgttgattccaagtttttttgtgctgctgctcggaaaaggggctatattcataatctgccaattgagaacagatttccccttcttccatttcctccacgcaccatacatgaagcttttccgttgacaaggaaatggtggccttcctgggacccaagaacaaaattgaactgcatacaaacatgtacagcgagtgcgagattgacagaaaggatccgcaaggctcttgaagcttatgatggtgagccacctttgaatgtccagaaatacgttcttgatgagtgcagaaagtggaatctagtatgggttggaaggaataaggttgcgccacttgaagctgatgaggtggaaatgcttctgggtttccctaaaaaccatacacgaggaggaggaatgagtcggacagataggtataagtcacttggcaattcattccaggtcgacacagtggcttatcatctttcagttttaaaagacatgttccctggtgggatcaatcttctgtctcttttctctgggattggtggtgccgaggttgccctccaccggcttgggatacccctgaagaatgttgtatcggtggaaatatcggaggtgaatagaaacatagtaaggggttggtgggagcaaacgaatcagcgggggactttgattgatatagcagatgtgcaagaactgaatggtgatcgattggagcaattgatgagtagatttggtggatttgaccttgttgtgggtggcagcccatgtaacaaccttgcgggtagcaacagacatcatcgagatggactcgagggtaaagaatcttctctcttcttcgattattgtcgtatattagacttggttagatgcatgcaaaggaaccaatgatttgatgtaaagggggctgatttgtggatacttgctccaaactgtatttatcttgcatcttcattattgcctgagcataacattgaaataatgactgacattctttgcaacttatgacaacttcaaattcttagggaaatgaaaattgatggaaaagttgttggttactgttttccccaagtttgtttgtcactgggaatctttccattttgcttgagtattaaacttatattatccgggtttaggagtgagtggtgtacattggatattttaaaataacaatgtacagattggatgatgaaattgataaggatatggatgaagttgatctgttacttcaatttt

SEQ ID NO: 445 - DNA, 2467 bp, Gossypium raimondii
tttttttcttctcttctcagttctcccgctgccgtgtccgtcggtttccgccggatctgatctcgtattcagtgtcggaaatccgtgtcggatcgtgtcgacactggtacggcacccctaattgccgagtccgggtaacggagttctgataagttttcattgtttcttttacaggttaagaaactgttcttgggctgtactatagctcaaggaaaatggatcaaaatggttctggtggtgatgctgataattttgactgggataccgaagatgagctggaaattgataattatgcaatcgcctctcgctcaggagtgtcacttaccaatggggaagctgttttaggcacagcagaggtgagctcgtctgcagattctccgaattccaagttaattgatcattttgttgggatggggttctcccaggaacttgttacgaaagcaattgaggaaaatggagaggagaattcaaatttgatacttgaagctctccttcggtactctgcaagctcgttggctagttcttccaattccaagttgattgatcattttgttgggatgggattctctgaagaaatggttctcaaagcggttcaagaaaatggagaggggaatacagataccatattggagactctattgacatattcggctcttgaaaagtctgctcctgtgcaacaacatgctgattctgatgacttctcgtcagattgtgaagggaattttttggatgatttcacagatattgatagttcttctgataccgaggaaataattaatactggttctgatgaggagagtaaactgttgtacttgacaaaaatggggtactcagaggctgaggcttcagtagccatggagagatgcggtccagactcatcaattgcagagctgacagactttatatgtgctgctcaaatggctaaggctgctgatgcacttttccctgttgaagacaggaagccattctgcaatggctctaattacaataaaaggcgaaacttgggctatgatttgtggaaaaggaagaagcagatgaagcttgaaaagaagcttcttaatgaagatgatgatgcccttcatcttcctaatcctatgattggttttggggtcccaactgaaccagatctgataactcaaagaacacttccagaagctgctgttgggcctccttatttctactatgagaatgtggcacttgctccaaaaggcgtttggagcaccatttcacggttcttatatgatgtggaaccagagtttgttgattccaagtttttttgtgctgctgctcggaaaaggggctatattcataatctgccaattgagaacagatttccccttcttccatttcctccacgcaccatacatgaagcttttccgttgacaaggaaatggtggccttcctgggacccaagaacaaaattgaactgcatacaaacatgtacagcgagtgcgagattgacagaaaggatccgcaaggctcttgaagcttatgatggtgagccacctttgaatgtccagaaatacgttcttgatgagtgcagaaagtggaatctagtatgggttggaaggaataaggttgcgccacttgaagctgatgaggtggaaatgcttctgggtttccctaaaaaccatacacgaggaggaggaatgagtcggacagataggtataagtcacttggcaattcattccaggtcgacacagtggcttatcatctttcagttttaaaagacatgttccctggtgggatcaatcttctgtctcttttctctgggattggtggtgccgaggttgccctccaccggcttgggatacccctgaagaatgttgtatcggtggaaatatcggaggtgaatagaaacatagtaaggggttggtgggagcaaacgaatcagcgggggactttgattgatatagcagatgtgcaagaactgaatggtgatcgattggagcaattgatgagtagatttggtggatttgaccttgttgtgggtggcagcccatgtaacaaccttgcgggtagcaacagacatcatcgagatggactcgagggtaaagaatcttctctcttcttcgattattgtcgtatattagacttggttagatgcatgcaaaggaaccaatgatttgatgtaaagggggctgatttgtggatacttgctccaaactgtatttatcttgcatcttcattattgcctgagcataacattgaaataatgactgacattctttgcaacttatgacaacttcaaattcttagggaaatgaaaattgatggaaaagttgttggttactgttttccccaagtttgtttgtcactgggaatctttccattttgcttgagtattaaacttatattatccgggtttaggagtgagtggtgtacattggatattttaaaataacaatgtacagattggatgatgaaattgataaggatatggatgaagttgatctgttacttcaa

SEQ ID NO: 446 - DNA, 5848 bp, Gossypium raimondii
cagcactgctactgttttcgagtttcaatgagtttaaataaaatctaacaaaaccccatcaccaaatttcattttatactggtatcatacattaagtgcctttagcgagttagtgttcttatagcttctggtagttggctagttaattgcgacccgaggtttcattgtaaaccgttcggtgttggggcagggttcttcctttttctccataaaaatagcaaaatgagttaattggaaaattcccagaacagtacattttatataatccatgtctttgctgaagtcccattcaacaccccaattttctccggttatcttaaccaaactaatcgtacgttagggtttcacatattttgtgttttcactcttttttttttaatacttatcagtcccattcggtaaaggtttagtctttttactcttattacaatctcacaaactacatgcattctccaaaggaggaacagggtgagcctctaaaacgaagtttcagtgaggcgaactcagacccacctgattggatggttctagacgacaatgaaactgctaaggaagaagacccttcttcatcttcaaaacctaaggactttaaccccagagggtatcaattgcaggtatatgaggtggcaaagggaagaaacataatagcagtgttggatacaggtgtagggaagacaatgatagctgtgatgctcataaaagattttgttcaagctatcgagtctactgaaagtaaaaaattgattattttcttggctcccactgttcatctagtcaatcagcaatttgaatatgtaaaagatcatactagtttggaagttgaacagtattatggagctaagggggttgatgaatggaccttggattgttgggagaaagaaacaaaggagcatgatgttctggttatgacaccccaaattctattggatgccttaaggaaggcattcttgagtctggagatggtgtccttaatgataatagacgagtgccaccgtgctactggcaaccatccatatgccaaaataatgaaggaattttatcacaaatctaataacaagccaaagatttttggaatgacagcatcacctgtggttagcaaaggtgtgttgtccagcaataattgcgatggtcaaatgtcagaacttgaatgtgttttggattccttgatatacactattgaagacaggacagagatggaagcgtgtgttccttctgctaaagaaagttgtagattttttgatccagcacaattttctagcttggatttgaaagcaaaggtagaagcctcttggttaaagacagatgcgtcattgtcaaatttgcaaagctcactgcaaacttcttataaaggcatggatgataaacttaagaatctacggaagcgattatcaaatgaccatgctaaggttctgcattgccttgataatcttggtctcatatgtgcttatgaggctgttaacatttgtctagagaacatccttgacaccacagaggaatctaaagcatatagagaaagtgtgttgcagtataaaaatttccttgaggaagtccaatgtagaattggggagtctcttcccctcggtgataaaaattttctgaatactggatttgactatttgaaggcagtagatcttggctatatttctccaaaactgcatgaactacttcaactgttccaatcatttggagaaactagacaagtattgtgcctgatttttgttgaaagaattattactgctaaagtaattgaaagatttgcgaagaaagtaagctgtttatcacatttcatggtttcatatatgactggaagtaatacatctgttgattccctggcaccaaaaatgcaaaaggaaaccttggagtcatttcgatctgggaaggtgaatctattgtttactactgatgtggttgaggagggaattcatgtaccaaattgctgttatgtgatacgtttcgacctgccaaagacagtccggagttatgtacaatctcgaggaagagctaggcagaacaattctgaattcattatgatgcttgagaggggaaatgtgaaacaaagaaatcaactatatgatataatcaggagtgagtattcaatgacaaattcggcaattaaaagagatcccgattctgatccatgccttcttaaagatcatacatttgaagaaacaaatgtttttattgtggatgctactggagcttcagttactgcagattctgctgttagcctcatccataaatattgtgggaagctccccggtgataagtattacacaccaaaaccaaatttccagttcacgtcttctgaaggattatataagtgtaaattaacattacctgttaatgcagccgttcaaacaatagttggtccactgtctaggaattctcatttagcaaagcagcttgtatgcttagaagcatgtaagcagcttcatcaaatgggtgccttggatgatcatctcactccatccattgaagagccttcagaaaatgcttgtatttctaaaggaaaagattcaggtgcaggtgcaggtgcaggaactacaaaacggaaggagcttcatggaacaacttgcatacaggcattatgtggaagctggggagaaaaatctgatgatgctgttttctttgcctataaatttgacttcaaatgcaatatcattactgtggtttattctggatttgttcttctaattgaatcaaagcttgcggatgatgtggggaatactgaaatggatcttttcttgattggtaagatggttaaggctagcgtttcttcctgtgggcaagtgtatttgaatgcagaacagatggtgaaagcgaagcgctttcaggaatttttctttaatggcttgtttgggaagttatttgttggatctaaatcatctggagcaccaagagaatttctacttcgggataaaacaagctccttgtggagtccatcccacatgtatttgcttttgcccctcgaggataattcaactgatgaattgagaatacactggccagggataacagcttgcacattagctgcggaatttttaaataaaaattctttgttgggcactgagcaatctgatgatgatggaagcaatccatcattgaacagtactggttcacctgtgacatactgcaaagaaaccaatataatccgctttgctaacagttcagttgatgctaatagtcttagaaatacggtagtattggctattcacactggaagaatctactgcatcattgaagctgtgagtgataaaactgctgaaagttctttcgctgaaactgttgatacggtctcatcagagtttgctaccttctatgaatacttctacaaaaagtacaatattgtgctgaaacatccaggacagcctttgatgctgttaaagcagagccataacccgcacaacttgcttgtgaattttaatgatgaaggtgtatcagctaaggcatcacaagctggcgtggttaatgaaaagcctcggtttcatgtccacatgccccctgagcttttacttgtccttgatgtcccagtgagtgttctaaaatcattgtacttactgccatcattgatgcatcggctggagtccttaatgttggccaaccaactcagagaagagataaacttttgttctagcaacattgatattccaagctcaatgatcctggaagcattaacaacacttagatgctgtgaaagtttttcaatggaaaggctggaattgcttggggattcagttctgaagtatgctgttagctgccacctctttcttagatatcccaacaaacatgagggacaattatctgccaggcgttcgttggcagtttgtaattcaaccctgcataagttgggaactgaccacaaaatacagggatacattagggacagtgcttttgatccccgtcgttgggtagctccaggacaacgagtgcttcgccctgttccttgcaagtgtggtgtggactctctagaagttcctttagataaaaaatttcagacagaagaccctaaagttaaggttggtaaatcctgtgatagaggccaccgatggttgtgttcaaaaaccatatcagattgtgttgaagctctcataggagcatactacttaagtggtggacttgttgctgcccttcatgtgatgaagtggctcgggattgatgccgaacttgatcccttggtggtagctgaggtcattaatcaggcatccttaagaacttatgtccccaattacgaaatccacatgatagagtcaaaagttggctacaatttttctgtcaagtttttcttgcaggaggcattgacacatgaatctttgcacgagtcctactgttaccagagacttgaatttcttggtgattctgtgttggacttgctgatcacccagtatctctacaaccatcacactgatatagatccgggtgagttgactgacctgcgctccgcttcggttaataatgaaaattttgctcaagttgccgtgcgccatgaccttcataagcatcttcaacattgttcaactttactatcaaaccaaataagtgaatatgtgcggtccttcactgaatctgataacaccaccagattagatcccagcataaaaggtcccaaggctcttggagacctggttgaaagtattgttggggcaattctgattgatacaaacctgaatcttgacaaagtctggagaattgttgaaccgttgttgtctccaattgtaaccccagataagcttgagctgcctccattccgggaactgaatgaattatgcgactctcttggatattttattaaggaaaaatgtaaaaataagggggaagtagtgcacgccgagcttctattgcagctagatcatgatttgttggtaggagaggggtttgatagaagtagaaaagtagcaaaaggaaaagccgcttcttgtctgttgaaggaccttgagaacagaggaatctccaggaagaaaaggaaacatgactgtgtggattcaagtcaaaccatggaagatgactcgttagaaccaacaatccctaagaggcaaaggagcgccgaaattcagttgcttgatgaatcaaagaaagcatgcagtgctacgcctgccaccccagttattgtaacagtaaaaacgaagaaaggagggccgaggaccactctttttgagctttgcaagaaactgctgtggcctatgcctagtatcaaagcaacagaacacaaatcaagtgctcccatggaaattggtgaaggtcccgagaggaaaaaagggtttatcagctttgtgtcgaaaatcatcttgaatgtcccaggatacgacattattgaatgcactggagatgcaaaagctgacaaaaaaagttcttcagactcagcagcactgtttatgctttatgagcttgaacagcgtgggaagctcatcatcgaggaaaccttataagtctactagcagttgaccatcaatggtgttcattaaaggtgatctgcaatatcctcactgtccagttattaacttttgactcttggtttaaaattgtaagcgatgactgtgagggctcgtaacaaaatatcaacgatatatcatgtatgtatatattgtccataatctaccaacaagccatgttaataaatctgcagttatttctgaattttatctatttgtcaatgttagggtgagtttggattggcgatgcgtttatttgcggttagtataaaaacagcagtagcggtgagattagatactttagcgtgagacaaaaagtaagctaaacataccgcactgcacccaatcgtccatccaaatctacccttattgttgtatatcaattgtagatttccaaagggaatgtcttttctgcaaattac

SEQ ID NO: 447 - DNA, 5426 bp, Gossypium raimondii
taatacttatcagtcccattcggtaaaggtttagtctttttactcttattacaatctcacaaactacatgcattctccaaaggaggaacagggtgagcctctaaaacgaagtttcagtgaggcgaactcagacccacctgattggatggttctagacgacaatgaaactgctaaggaagaagacccttcttcatcttcaaaacctaaggactttaaccccagagggtatcaattgcaggtatatgaggtggcaaagggaagaaacataatagcagtgttggatacaggtgtagggaagacaatgatagctgtgatgctcataaaagattttgttcaagctatcgagtctactgaaagtaaaaaattgattattttcttggctcccactgttcatctagtcaatcagcaatttgaatatgtaaaagatcatactagtttggaagttgaacagtattatggagctaagggggttgatgaatggaccttggattgttgggagaaagaaacaaaggagcatgatgttctggttatgacaccccaaattctattggatgccttaaggaaggcattcttgagtctggagatggtgtccttaatgataatagacgagtgccaccgtgctactggcaaccatccatatgccaaaataatgaaggaattttatcacaaatctaataacaagccaaagatttttggaatgacagcatcacctgtggttagcaaaggtgtgttgtccagcaataattgcgatggtcaaatgtcagaacttgaatgtgttttggattccttgatatacactattgaagacaggacagagatggaagcgtgtgttccttctgctaaagaaagttgtagattttttgatccagcacaattttctagcttggatttgaaagcaaaggtagaagcctcttggttaaagacagatgcgtcattgtcaaatttgcaaagctcactgcaaacttcttataaaggcatggatgataaacttaagaatctacggaagcgattatcaaatgaccatgctaaggttctgcattgccttgataatcttggtctcatatgtgcttatgaggctgttaacatttgtctagagaacatccttgacaccacagaggaatctaaagcatatagagaaagtgtgttgcagtataaaaatttccttgaggaagtccaatgtagaattggggagtctcttcccctcggtgataaaaattttctgaatactggatttgactatttgaaggcagtagatcttggctatatttctccaaaactgcatgaactacttcaactgttccaatcatttggagaaactagacaagtattgtgcctgatttttgttgaaagaattattactgctaaagtaattgaaagatttgcgaagaaagtaagctgtttatcacatttcatggtttcatatatgactggaagtaatacatctgttgattccctggcaccaaaaatgcaaaaggaaaccttggagtcatttcgatctgggaaggtgaatctattgtttactactgatgtggttgaggagggaattcatgtaccaaattgctgttatgtgatacgtttcgacctgccaaagacagtccggagttatgtacaatctcgaggaagagctaggcagaacaattctgaattcattatgatgcttgagaggggaaatgtgaaacaaagaaatcaactatatgatataatcaggagtgagtattcaatgacaaattcggcaattaaaagagatcccgattctgatccatgccttcttaaagatcatacatttgaagaaacaaatgtttttattgtggatgctactggagcttcagttactgcagattctgctgttagcctcatccataaatattgtgggaagctccccggtgataagtattacacaccaaaaccaaatttccagttcacgtcttctgaaggattatataagtgtaaattaacattacctgttaatgcagccgttcaaacaatagttggtccactgtctaggaattctcatttagcaaagcagcttgtatgcttagaagcatgtaagcagcttcatcaaatgggtgccttggatgatcatctcactccatccattgaagagccttcagaaaatgcttgtatttctaaaggaaaagattcaggtgcaggtgcaggaactacaaaacggaaggagcttcatggaacaacttgcatacaggcattatgtggaagctggggagaaaaatctgatgatgctgttttctttgcctataaatttgacttcaaatgcaatatcattactgtggtttattctggatttgttcttctaattgaatcaaagcttgcggatgatgtggggaatactgaaatggatcttttcttgattggtaagatggttaaggctagcgtttcttcctgtgggcaagtgtatttgaatgcagaacagatggtgaaagcgaagcgctttcaggaatttttctttaatggcttgtttgggaagttatttgttggatctaaatcatctggagcaccaagagaatttctacttcgggataaaacaagctccttgtggagtccatcccacatgtatttgcttttgcccctcgaggataattcaactgatgaattgagaatacactggccagggataacagcttgcacattagctgcggaatttttaaataaaaattctttgttgggcactgagcaatctgatgatgatggaagcaatccatcattgaacagtactggttcacctgtgacatactgcaaagaaaccaatataatccgctttgctaacagttcagttgatgctaatagtcttagaaatacggtagtattggctattcacactggaagaatctactgcatcattgaagctgtgagtgataaaactgctgaaagttctttcgctgaaactgttgatacggtctcatcagagtttgctaccttctatgaatacttctacaaaaagtacaatattgtgctgaaacatccaggacagcctttgatgctgttaaagcagagccataacccgcacaacttgcttgtgaattttaatgatgaaggtgtatcagctaaggcatcacaagctggcgtggttaatgaaaagcctcggtttcatgtccacatgccccctgagcttttacttgtccttgatgtcccagtgagtgttctaaaatcattgtacttactgccatcattgatgcatcggctggagtccttaatgttggccaaccaactcagagaagagataaacttttgttctagcaacattgatattccaagctcaatgatcctggaagcattaacaacacttagatgctgtgaaagtttttcaatggaaaggctggaattgcttggggattcagttctgaagtatgctgttagctgccacctctttcttagatatcccaacaaacatgagggacaattatctgccaggcgttcgttggcagtttgtaattcaaccctgcataagttgggaactgaccacaaaatacagggatacattagggacagtgcttttgatccccgtcgttgggtagctccaggacaacgagtgcttcgccctgttccttgcaagtgtggtgtggactctctagaagttcctttagataaaaaatttcagacagaagaccctaaagttaaggttggtaaatcctgtgatagaggccaccgatggttgtgttcaaaaaccatatcagattgtgttgaagctctcataggagcatactacttaagtggtggacttgttgctgcccttcatgtgatgaagtggctcgggattgatgccgaacttgatcccttggtggtagctgaggtcattaatcaggcatccttaagaacttatgtccccaattacgaaatccacatgatagagtcaaaagttggctacaatttttctgtcaagtttttcttgcaggaggcattgacacatgaatctttgcacgagtcctactgttaccagagacttgaatttcttggtgattctgtgttggacttgctgatcacccagtatctctacaaccatcacactgatatagatccgggtgagttgactgacctgcgctccgcttcggttaataatgaaaattttgctcaagttgccgtgcgccatgaccttcataagcatcttcaacattgttcaactttactatcaaaccaaataagtgaatatgtgcggtccttcactgaatctgataacaccaccagattagatcccagcataaaaggtcccaaggctcttggagacctggttgaaagtattgttggggcaattctgattgatacaaacctgaatcttgacaaagtctggagaattgttgaaccgttgttgtctccaattgtaaccccagataagcttgagctgcctccattccgggaactgaatgaattatgcgactctcttggatattttattaaggaaaaatgtaaaaataagggggaagtagtgcacgccgagcttctattgcagctagatcatgatttgttggtaggagaggggtttgatagaagtagaaaagtagcaaaaggaaaagccgcttcttgtctgttgaaggaccttgagaacagaggaatctccaggaagaaaaggaaacatgactgtgtggattcaagtcaaaccatggaagatgactcgttagaaccaacaatccctaagaggcaaaggagcgccgaaattcagttgcttgatgaatcaaagaaagcatgcagtgctacgcctgccaccccagttattgtaacagtaaaaacgaagaaaggagggccgaggaccactctttttgagctttgcaagaaactgctgtggcctatgcctagtatcaaagcaacagaacacaaatcaagtgctcccatggaaattggtgaaggtcccgagaggaaaaaagggtttatcagctttgtgtcgaaaatcatcttgaatgtcccaggatacgacattattgaatgcactggagatgcaaaagctgacaaaaaaagttcttcagactcagcagcactgtttatgctttatgagcttgaacagcgtgggaagctcatcatcgaggaaaccttataagtctactagcagttgaccatcaatggtgttcattaaaggtgatctgcaatatcctcactgtccagttattaacttttgactcttggtttaaaattgtaagcgatgactgtgagggctcgtaacaaaatatcaacgatatatcatgtatgtatatattgtccataatctaccaacaagccatgttaataaatctgcagttatttctgaattttatctatttgtcaatgttagggtgagtttggattggcgatgcgtttatttgcggttagtataaaaacagcagtagcggtgagattagatactttagcgtgagacaaaaagtaagctaaacataccgcactgcacccaatcgtccatccaaatctacccttattgttgtatatca

SEQ ID NO: 448 - DNA, 5800 bp, Gossypium raimondii
taatacttatcagtcccattcggtaaaggtttagtctttttactcttattacaatctcacaaactacatgcattctccaaaggaggaacagggtgagcctctaaaacgaagtttcagtgaggcgaactcagacccacctgattggatggttctagacgacaatgaaactgctaaggaagaagacccttcttcatcttcaaaacctaaggactttaaccccagagggtatcaattgcaggtatatgaggtggcaaagggaagaaacataatagcagtgttggatacaggtgtagggaagacaatgatagctgtgatgctcataaaagattttgttcaagctatcgagtctactgaaagtaaaaaattgattattttcttggctcccactgttcatctagtcaatcagcaatttgaatatgtaaaagatcatactagtttggaagttgaacagtattatggagctaagggggttgatgaatggaccttggattgttgggagaaagaaacaaaggagcatgatgttctggttatgacaccccaaattctattggatgccttaaggaaggcattcttgagtctggagatggtgtccttaatgataatagacgagtgccaccgtgctactggcaaccatccatatgccaaaataatgaaggaattttatcacaaatctaataacaagccaaagatttttggaatgacagcatcacctgtggttagcaaaggtgtgttgtccagcaataattgcgatggtcaaatgtcagaacttgaatgtgttttggattccttgatatacactattgaagacaggacagagatggaagcgtgtgttccttctgctaaagaaagttgtagattttttgatccagcacaattttctagcttggatttgaaagcaaaggtagaagcctcttggttaaagacagatgcgtcattgtcaaatttgcaaagctcactgcaaacttcttataaaggcatggatgataaacttaagaatctacggaagcgattatcaaatgaccatgctaaggttctgcattgccttgataatcttggtctcatatgtgcttatgaggctgttaacatttgtctagagaacatccttgacaccacagaggaatctaaagcatatagagaaagtgtgttgcagtataaaaatttccttgaggaagtccaatgtagaattggggagtctcttcccctcggtgataaaaattttctgaatactggatttgactatttgaaggcagtagatcttggctatatttctccaaaactgcatgaactacttcaactgttccaatcatttggagaaactagacaagtattgtgcctgatttttgttgaaagaattattactgctaaagtaattgaaagatttgcgaagaaagtaagctgtttatcacatttcatggtttcatatatgactggaagtaatacatctgttgattccctggcaccaaaaatgcaaaaggaaaccttggagtcatttcgatctgggaaggtgaatctattgtttactactgatgtggttgaggagggaattcatgtaccaaattgctgttatgtgatacgtttcgacctgccaaagacagtccggagttatgtacaatctcgaggaagagctaggcagaacaattctgaattcattatgatgcttgagaggggaaatgtgaaacaaagaaatcaactatatgatataatcaggagtgagtattcaatgacaaattcggcaattaaaagagatcccgattctgatccatgccttcttaaagatcatacatttgaagaaacaaatgtttttattgtggatgctactggagcttcagttactgcagattctgctgttagcctcatccataaatattgtgggaagctccccggtgataagtattacacaccaaaaccaaatttccagttcacgtcttctgaaggattatataagtgtaaattaacattacctgttaatgcagccgttcaaacaatagttggtccactgtctaggaattctcatttagcaaagcagcttgtatgcttagaagcatgtaagcagcttcatcaaatgggtgccttggatgatcatctcactccatccattgaagagccttcagaaaatgcttgtatttctaaaggaaaagattcaggtgcaggtgcaggaactacaaaacggaaggagcttcatggaacaacttgcatacaggcattatgtggaagctggggagaaaaatctgatgatgctgttttctttgcctataaatttgacttcaaatgcaatatcattactgtggtttattctggatttgttcttctaattgaatcaaagcttgcggatgatgtggggaatactgaaatggatcttttcttgattggtaagatggttaaggctagcgtttcttcctgtgggcaagtgtatttgaatgcagaacagatggtgaaagcgaagcgctttcaggaatttttctttaatggcttgtttgggaagttatttgttggatctaaatcatctggagcaccaagagaatttctacttcgggataaaacaagctccttgtggagtccatcccacatgtatttgcttttgcccctcgaggataattcaactgatgaattgagaatacactggccagggataacagcttgcacattagctgcggaatttttaaataaaaattctttgttgggcactgagcaatctgatgatgatggaagcaatccatcattgaacagtactggttcacctgtgacatactgcaaagaaaccaatataatccgctttgctaacagttcagttgatgctaatagtcttagaaatacggtagtattggctattcacactggaagaatctactgcatcattgaagctgtgagtgataaaactgctgaaagttctttcgctgaaactgttgatacggtctcatcagagtttgctaccttctatgaatacttctacaaaaagtacaatattgtgctgaaacatccaggacagcctttgatgctgttaaagcagagccataacccgcacaacttgcttgtgaattttaatgatgaaggtgtatcagctaaggcatcacaagctggcgtggttaatgaaaagcctcggtttcatgtccacatgccccctgagcttttacttgtccttgatgtcccagtgagtgttctaaaatcattgtacttactgccatcattgatgcatcggctggagtccttaatgttggccaaccaactcagagaagagataaacttttgttctagcaacattgatattccaagctcaatgatcctggaagcattaacaacacttagatgctgtgaaagtttttcaatggaaaggctggaattgcttggggattcagttctgaagtatgctgttagctgccacctctttcttagatatcccaacaaacatgagggacaattatctgccaggcgttcgttggcagtttgtaattcaaccctgcataagttgggaactgaccacaaaatacagggatacattagggacagtgcttttgatccccgtcgttgggtagctccaggacaacgagtgcttcgccctgttccttgcaagtgtggtgtggactctctagaagttcctttagataaaaaatttcagacagaagaccctaaagttaaggttggtaaatcctgtgatagaggccaccgatggttgtgttcaaaaaccatatcagattgtgttgaagctctcataggagcatactacttaagtggtggacttgttgctgcccttcatgtgatgaagtggctcgggattgatgccgaacttgatcccttggtggtagctgaggtcattaatcaggcatccttaagaacttatgtccccaattacgaaatccacatgatagagtcaaaagttggctacaatttttctgtcaagtttttcttgcaggaggcattgacacatgaatctttgcacgagtcctactgttaccagagacttgaatttcttggtgattctgtgttggacttgctgatcacccagtatctctacaaccatcacactgatatagatccgggtgagttgactgacctgcgctccgcttcggttaataatgaaaattttgctcaagttgccgtgcgccatgaccttcataagcatcttcaacattgttcaactttactatcaaaccaaataagtgaatatgtgcggtccttcactgaatctgataacaccaccagattagatcccagcataaaaggtcccaaggctcttggagacctggttgaaagtattgttggggcaattctgattgatacaaacctgaatcttgacaaagtctggagaattgttgaaccgttgttgtctccaattgtaaccccagataagcttgagctgcctccattccgggaactgaatgaattatgcgactctcttggatattttattaaggaaaaatgtaaaaataagggggaagtagtgcacgccgagcttctattgcagctagatcatgatttgttggtaggagaggggtttgatagaagtagaaaagtagcaaaaggaaaagccgcttcttgtctgttgaaggaccttgaggtacgcattcataaaagtttgtcaggacatgagaaaggagtgagtctggtcacatcagccatttaacttcacaattattcttcactccctgccttcctttgaccaatcagaagtttctttcatttcatataatataatattaaggttctacatttatgcttacaattggttatcatatgtgtgtctagtctttgtttctttaggtggatttgttgatttgtttgattcccttaggcttcggtcttttagatatgtagtcatgttcggtttaggctttagtcatttaggcatatagtcataaatccatcactgcatgttgagaactgattgtttgcgctaacattggcaatggtcctgatactccatgtcaacagaacagaggaatctccaggaagaaaaggaaacatgactgtgtggattcaagtcaaaccatggaagatgactcgttagaaccaacaatccctaagaggcaaaggagcgccgaaattcagttgcttgatgaatcaaagaaagcatgcagtgctacgcctgccaccccagttattgtaacagtaaaaacgaagaaaggagggccgaggaccactctttttgagctttgcaagaaactgctgtggcctatgcctagtatcaaagcaacagaacacaaatcaagtgctcccatggaaattggtgaaggtcccgagaggaaaaaagggtttatcagctttgtgtcgaaaatcatcttgaatgtcccaggatacgacattattgaatgcactggagatgcaaaagctgacaaaaaaagttcttcagactcagcagcactgtttatgctttatgagcttgaacagcgtgggaagctcatcatcgaggaaaccttataagtctactagcagttgaccatcaatggtgttcattaaaggtgatctgcaatatcctcactgtccagttattaacttttgactcttggtttaaaattgtaagcgatgactgtgagggctcgtaacaaaatatcaacgatatatcatgtatgtatatattgtccataatctaccaacaagccatgttaataaatctgcagttatttctgaattttatctatttgtcaatgttagggtgagtttggattggcgatgcgtttatttgcggttagtataaaaacagcagtagcggtgagattagatactttagcgtgagacaaaaagtaagctaaacataccgcactgcacccaatcgtccatccaaatctacccttattgttgtatatca

SEQ ID NO: 449 - DNA, 4389 bp, Gossypium raimondii
atgcattctcccatggaagaagagcagtgttaccctctaaaaacaaccttcagtgaaacacacttacacccatctcagattatggtttcaatcaatgacgatcatgctaagaaccaccacccttcttcatcttcaaatcctgatcactctagccctagagggcatcagctgcaggttgttagatacaaaatgatagctgtaatgcttatcaaagattttgttcaacctatcaactccattgataaaaaaaagttgattattttcttggcccccactgttcatcttgttaatcagcaatttgaatatataaagttccatacaagtttggatgttgaacaatattatggagataaaggggttaatgaatggaactcagggtattgggagaaagacataaaggagcatgatgttcttgttatgacaccccaaattctgttggatgccttgtggaaagcattcttgagtttagagatggtgtccttaatgataatcgacgagtgccaccatgctaccggtaaccatccgtatgcgaaaataatgaaggaattctatcacaaatcgaacaacaaaccgaagattttcgggatgacggcatcgcccttagttagcaaaggtgcattatccaacaatgattgtgaggatcaactttcagaacttgaaaatgttatggattgcatgatatatgcaattgaagacatgacagagatggaaacatatgttcctacagcaaaagaaagttgtaggtttttcgatccaacacgattttgtagttcgggtttgaaagcaatgatcgaagcctcgtggttaaagatagatgcttcattatcaacgttgcaaggctcgattcaaacttcttatacagacatggatgataagtttaaggccctccataaacggtcatccaatgaccatgctaagattctgcattgtctcgacgatcttggtctcatatgtgcttatgaggctgttaaagtctgtcttgagaacatccctgatacaaaagaggagtgtgaagcatataaagaaggtgtattgcagtgcaaaaggttcctcaacgaagtgctacagataatcagggaatcccttcccctgggtgatgaaaattttctgaattccgggtttgactacttaaaggcggtagattcgggctatatatctccgaaactgcatgaactaattgaatttttcttatcactcggagaacctagtcaagtattgtgcctcgtttttgttgaaagaattgttaccgctaaagtaattgaaagatttgtgaagaaagtaagttgtttatcgtgttttgtggtttcgtgtttgactggaagtaatacgtcagttgattccatggcaccaaagattcaaaaggaaactttggaatattttatggtcaatgattgtggagagggaattcatataccaaactgctcatatgtgatacgttttgacttgccgaaaacagtgttgagttatgtacaatctcgaggaagagctaggcagagtggttcccaattcatcatgattctagagaggggaaatgagaaacaaagagatcaactatacgatctaattcggagtgaacattcaatgacgaatacagctatgaatagagatcctgatctatctcttccggaaaaccgtacattggaagaaacaaatgtttctatcgtggctgctactggagcttccattgaagaaacttccaaaaatcgttgcgcttctaaaggaaaagatcccattttcgattcaggaactacaagatggaaggagctgcacggaacaactcagattcgtgcattttccgggagctggggagaaaaagccgatgcttcagttttctttgcctataaaattgacttttcatgcaatgttgttagcgttgtttactctggatttcttactgatgatgtggggaacatcgaagtagatctttacttgatcggaaagatagctaaggctcgtgtttctttttatgggaaagtacatttggatgctgtacagattaccgcagcaaagcgttttcaggaaattttctttaatggcttgttcgggaggctgtttgttggatcatccagaacatcgagggaacttttatttcatagtaaaacgagcttgttgtggcatccatttaacatgtatttgcttctgcccctagaggatagtttgagtaatgaactgagaataaactggcctgggataacagcttgtacattagctgtagagtttttaactgctgacggtaacagaggtaatccgtcattgaaccaaactgattcatccgtgacagaacacaaggagaccaatgtaatccactttgctaacagatctatagatgttaacaatatcagtaacatcgtagtattggcaattcataccggaagaatctattccaccattgaattagttcatgatacatccgccaaaagttctttcaatgacattgttgatatgaactcattgaagttcgcgaccttctccgaatactacaacagaaagtactgcatcgtgctgaaacatccaggacaacctttattgctgttaaagcagagtcataacccgcacaacttgctggttgattttaacgatgaaggttgcagattttcagcacaagcattacaagcaagctcggttaatgaaaagtcatggaatactatccacatgccacccaagcttttgctcatccttgatgtcccggtctatgttctaaaagccttttacttactaccatcactgatgcaccggctcgagtccttaatgttggctagccaacttagggaagagatcgattttcgttcaagcaacttcgatataccgagctcaatgatcctggaagcgttaacaacgcttagatgttgtgaaagcttttcgatggagaggctggaatttctcggtgattcagttctgaagtatgctggttacattagagacagtgctttcgacccccgacgttgggtagctccaggacaactacgtcttcggtcttttccttgtaactgcagggtggactctcgagaagttcctttagataaaaagtttcagactgaagatctggaaattaaggtcagtatatcttgtgatagaggccaccgatggatgtgttcgaaaaccatatcggattgtgttgaagctctcataggagcatactatgtaagtggtggactcattgctgctcttcatatgatgaaatggcttgggatcgatgccgaacttgatccctctttggtagctgaagccattaatcgtgcatccctacaatcttataaattttctatgaagtttttcttacaggaggccttgacacatgcatcggcaaacgagttttactgttaccagaggcttgaatttcttggtgattccgtgttggacttgctgataacccgatatctctactgcaatcacaccgatatagattcaggagaactgactgacctccgatcggcttcagttagtaatgaaacttttgctcaagttgctgtccgtaatgaccttcataagcatcttcgacattgttcaactttactattggaccaaataagtgaatatgcacagtccctccctgaatcttgggacactacacgatcagtacccggcataaaaggtccaaagatatgttcaaaccttattgaaagtatcgtcgcggcaatcttgatcgatacaaacctgaaccttgacgaagtttggagaattgttgagccattgttatctctgatcgtgactcccgataagctcgaggaaaagtgcgttaatacgggagaaatggtgcatgccaagctttggttacagctggatgatattttgttggtcggagaggcattcaatcgaagcaaaaaggtagcaaaaggaaaagcagctttatatctattgaaggaactcgaggatagagggatctcccgaaagagaacgaaacaggatcatgccggttcgagtggaaccactgatgatgatttgttagagccaaaaatgtgcaagaagcagaggatagctgagattccttctccgactaacgactcttcaaggacagcatatggagctgagattccttctccggctaacgcttcttcaaggacagcatatgttattgcaaggataaacacaaataaaggacgaccgagggccactctttacgagatttgtcggaaacagttatggcctaggcctacattcgaaacaacagaaggaagatcacgttctcctatggaaatcggcaaaggtgcagaccgaaaaatcgggtttaacagctttgtaacgaagatcaccttgaatggaccgagttcaggcattattgaatgcagcggagatgtaagagccgacaaaaagagctcttgtgactctgcagcaatccttatgctttacaggcttaaagagctagggaagctcatcatccgcgaatcctag

SEQ ID NO: 450 - DNA, 3584 bp, Gossypium raimondii
aatttcattccccctttgattttggagccactccatttattattaaacccttcattttcccccattcctttttatttccctcccacttcccaaaaccctttcctacatttcccgccgtccaaatcagctcaattcctcacttcggattcggcgccagttcggccatcgttgtttatccggctctctgaacaatcatcgccgactggtcagaatccataaaattacctttgtttcggttcaagggtttcttttctcttgtctaaatcgataatgccgagcacgcgaagagcttctaatcctatgaaggacactgattcgaccaagaatccgactcgctcgagccagcgtaatcggaagacagtgttggagcctgaaaatgatgaagtcatcgttgtcagtgaaggagagaacagtgaagtctctcgtggtggtaagcggaaggaaagctctgcctctggagcgggcaacaacgctaagaagtcaaaaccaagtgtagctaaaatgacgcctttggataccgagaatggtgaagctatggtcgttgacggtactgagaacggcagcaaaacgacaccaaaaaattcgaaaaagacgaaaacggatgtagctgttaatgaagacaaggaggaaacaaagtttttaggggaacctgttgatgacgaggaagccagacggcgatggccaaaacgctatcaaggaaagggagcaaaaaaggtcatttcaaagagttcgaatggtgactctgaagagatcattcaagctcgacggcactatacccaggcaaaagttgatggttgtatgatatttaatctttatgatgatgctcatgttaaagctgaagatggagaagattgctatatatgtaaaattgttgagatgtttgaagcagttgatggagatttgtactttacagctcaatggttttacagggctcaagacacagtacttaaaacgttaggccaccttattgacaagaagcgtgtattcttttcacaaattcaagacgacaatcccttggattgtcttgttgcaaagcttaatattgcaaaagtatctttgaacgttgatttggaggcaaagaataaagagattccaagttgtgattattattgtgacatgttatacacattggaatattcgtctttcactaacttgcccccagaagggaaaacaaatgctagcgaagaagcttcatctacaatttctgatgacagcccagatacagtaaatggagctaacagtggttccgaggatgcttcattgctggacctgtattctggttgtggagcaatgtcaaccggcttgtgccttggggcaaatatggccggactaaggctagtgactaaatgggctgtggatataaataaatatgcttgtgaaagtctccaatggaatcatccggaaacaacggtcaggaatgaatctgctgaagattttttagcattattaaaagaatgggaacggctgtgtgcttcattttcatcgtcaaaatctgagaatttggagaggcagtcattcaattcaagtgtaaatgaagataatgtaaatgatgaagaggaagaggaagatgaaaatgaagatggtgatggtgaagtgtttgaagtagagaaatttcttgctatatgttacggtgatccgaaagagaaaggggaacgtgggttgtacttaaaggttcgttggaagaattatgggccagaagaagatacatgggaacctttagatggattgggtgattgtcgagaatgcttgaaggattttgttacaagtggcttcaaagcaaaaattctgcccttacctggtgatgttgatgtggtttgtggagggcctccatgccaaggcatcagtggctttaataggtttagaaacaaggataaccccttgcaagatgaaaagaacaaacaacttcaggttttcatggagatagtggagtacttgaagccaaagtttgttttgatggagaatgttgttgacatagtaaagtttgcagagggatatcttggacgatatgctttgagtaagctaattcatttaaattaccaagtccgaatgggaatgatggcagctggtgcttatggtcttccccaatttcgtatgcgtgctttcttttggggtgctcgtcctaatcaaaaattgccacaatatccacttcctacgcatgatcttgtcctgagaggtgtcatacctgttgagtttgagatgaacactgtaggctgggaagaaggtaaaaagatagagttggaaaagaaacttctactagaagatgccatttctgaccttccatcagttggaaattatgaggataaagatgaaatggactatgacaaagatcctaaaacagagtttcagagattcatcaggttaagaagagaggagatgccaggtttttcttcactaaatgcaaaaccaacaaaacatttgctctatgatcatcgtccacttcaactcaacaccgatgattaccaacgtgtttgccgggttcccaaaaggaagggggcaaattttagagactttccaggtgttatagttaatagtggtaataaagtcgagtgggatcctaacgttgagagggtttatttggaatccggaaaaccattggtccctgattatgccatgtcttttgtcggcggctcatcaagcaaaccatttgctcgtctatggtgggatgaaactgtacccacagtggtcactagggcagaacctcataatcaggcgatattgcatcctgtacaagaccgagttctctcaattcgcgagaacgcaaggttgcaaggcttccctgattactacaagctttttggccccgtcaaggaaaggtacattcaagttggaaatgctgtagcagtgccagtttcaagggcattagggtatgccctggggttagcttaccaaggtgtagtttcaaatgatgaaccattaacgaaacttcctccaagattccctaacatatctgagaaagcatcttcggattcatctcaagataattcttaaacccccccttttttcttcaatctaattaatattagtcaatggaattgtgtattactttttagattttgaaactctaagagtaattaaaacctagtttaatgttcttcattcgatcccttgttgtacgactacgtgttgtcggtgctaatatttttttaattgagttttaatggttaaaacccattaggtaaactagttactaaattgttagtatgtttttattttgttctctaaatgtattgctaataaggtaactgttagtttacattttttgtattgaacttatttgagtagaattgctattactttgagttgaaatgatatatgcatgtattaagtttgtcaaaaaggaatggataaatttgttagtgattataagacttgatattaaagtgtcttatgaaatatttgattaggcacattataatatagtgtcttataatcaccactaaatttatccatttccttttcacaaacttaatacgttcatgtaacatattgtcttgtaatatcgtgtttatatacaatgtgcaatggtatggggattatggaattgatgtttatatacatttattattgcacgatgttcaatatgg

SEQ ID NO: 451 - DNA, 3384 bp, Gossypium raimondii; identical to SEQ ID NO: 399

SEQ ID NO: 452 - DNA, 3477 bp, Gossypium raimondii; identical to SEQ ID NO: 400

SEQ ID NO: 453 - DNA, 3148 bp, Gossypium raimondii; identical to SEQ ID NO: 401

SEQ ID NO: 454 - DNA, 3372 bp, Gossypium raimondii; identical to SEQ ID NO: 406

SEQ ID NO: 455 - DNA, 3257 bp, Gossypium raimondii
gctcctataagaattaagaagcaggaaaattactattttaatatttttcccttacaccctccattgtcgctctcttttacttttagtgccaaagacccgactcttcagtaatcctgccttcttcttctgtttttactttgcggatggagaaagcaagtactgaagaggcactagaattaccatctctgcccctaccactgccaacaataccatccaatgtgaagctagagagcttgaagcctcccaagtattctattgtcagtaggagagaagttgggacgagtggacgaaagatatccctgcttgccaaccacttcaaagtttctgtcaatgccccagatgctgtattttaccagtatactgttacagttttgtcagaagatagtagagttgttgaaagcaagaggattgggagaaaacttgttgataaactttatcaaacatactcttcggaacttgctggaaaaagatttgcctatgatggggaaaagagtttgtatacagtgggtcctttgccacagaacaagtttgaatttacaatagtgctagaagactcatttgcaaaatggagtcctgatgctgatggaggccctgctgagactggcaagaggacaaagcgttcttttcagtcaaagacttacaaagtggaactaagctattctgctaagatacccttgaagtcaatatctcttgccctcaaaggagttcagtcagatgatagcactcaggatgctttgagagtacttgacatcattctaaggcagcaagctgctgatcgaggttgccttttggtgagacaatcattctttcaagatgattcaaggaattatgttgatttgggaggaggggtattgggtctgcggggcttccattccagttttcgtcccactcaggggggcttgtctttgaatatggatgtatctacaacaatgattttaaggcctggaccagtatttgagtttctaaaacaaaacctgaatctaaatgatgaacgtttctggctgaaagccagacgaatgttgaagaatatgaggattaaaacaagacaccgtaacatggaattcaaaatcactggtctaagtgagaagccctgttgtgagctattcttcccaatgaaagttaaaaatggtggttgtggtgaagtccggactgttgagatcacagtgtatgagtatttcaccaaacactgtggaattgaactcacatattctgcagacatgccatgccttgatgttggtaaaccaaaacgtcctaactatttacccctagagctctgttcacttgtttcacttcagcggtacacaaaagcgttaactacaaatcaaagggcgaccctggttgaaagatccaggcaaaagcctcgggaaagaattcaaattctgactgatgctttgaaaaacaacaaattcaatgagaaccctgtactttctgcatgtgaaatttcaataggtaggcaattgacagaagttgagggtcggatcctggagactccaaggttgaaggttgggaatcacgaggattgcatccctcgaaatggtagatggaactataacaacaagagatttctggatccaaagaaaattgaacgttggattgctgtcaacttctctgctcgctgtgatctcagtcaaatttcaagggatttaatcagttgtgcaagaaacaagggcattgaaatggaacgtccgcacacattgattgaggaggaacggcatcaagctgctaaagctggccctgctgctagagtggaagcaatgtttgatcagattatagcaaagcttcctggcccccctgagttcattctttgtgtcttgccagtgagaaaaaactctgatatatatggaccttggaagaaaaaatgtctttgcgatatgggaattgccacacaatgcattagccctggaaaaattaatgaccaatacctcacaaatgtcctccttaaaatcaattcaaagcttggaggaatcaactctttattggaaatagagaaaccttcaatcctcccattgctgaaggatactcctacattgattttgggaatggatgtctctcatgggtcccctggtcgatcagatgtcccatcaatagctgcagttgttggttcgctccattggcctttgatttcaaggtacagagcatctgtgagaacacaatctccaaagatggagatgattgaagctttatataagccatcaccagacggaaaggttgatgatggtattatcagggaactgcttgttgatttctataaaacgagcggtaatcgcaaaccaaaacaaattatcatcttcagggatggagtaagtgaatcacagtttaaccaagtattaaacattgagctggagcaaatcatcaagtcatatcagtttctgggcgagtctgatgttcccaagttcacagtagtcgttgctcagaagaatcatcatacaaaattattccaagctaatgcccctgaaaatgttccaccagggacagtagtggacacaaaaattgtgcatccgagaaactatgatttctacatgtctgctcatgcagggatgatcggaacatctaggccagctcattatcatgtcttgcttgatgagataggtttctctcctaatgacctgcagaatcttatccactgtctttcctatgtataccaaaggagcacagcagcagtctcaatagtggctcctatttgttatgctcaccttgcggcatatcagatgggccaatttttgaagctggatgaactttcagaaacatcttcaggaaacgtaacatccacaggaagtatccttgtgccagaccttccgaggctgaaaaagaatgtggcaagtacaatgttcttctgttgaggggatcacccatttcagtaaatacatgctaggctaactgtagatagtttgggtaggctaggggtatacaaagcatacaactccaggcttttgcttttgtgattgattattgaggctggctggctttaacaagcaaaagtttttgtttaaaccatgactaggttatgttgaggggttaggagccattataagaaaagcttaggtgtatcttatatttgtttcatattttactttagtcaaaatcctgctattgctcagaagcttcattcagatagaaaaagctttttttccgtttcttctacttttctttgagcttttagaatccatatttaaagtgtgaatacaagaaaatgtttgatttgagctgggggtgttaggagtaagtattcagaagtgaaaaaattgagttgagtctta

SEQ ID NO: 456 - DNA, 3089 bp, Gossypium raimondii
ttactgattgatttcaagatggagaaagcaagtactgaagaggcactagaattaccatctctgcccctaccactgccaacaataccatccaatgtgaagctagagagcttgaagcctcccaagtattctattgtcagtaggagagaagttgggacgagtggacgaaagatatccctgcttgccaaccacttcaaagtttctgtcaatgccccagatgctgtattttaccagtatactgttacagttttgtcagaagatagtagagttgttgaaagcaagaggattgggagaaaacttgttgataaactttatcaaacatactcttcggaacttgctggaaaaagatttgcctatgatggggaaaagagtttgtatacagtgggtcctttgccacagaacaagtttgaatttacaatagtgctagaagactcatttgcaaaatggagtcctgatgctgatggaggccctgctgagactggcaagaggacaaagcgttcttttcagtcaaagacttacaaagtggaactaagctattctgctaagatacccttgaagtcaatatctcttgccctcaaaggagttcagtcagatgatagcactcaggatgctttgagagtacttgacatcattctaaggcagcaagctgctgatcgaggttgccttttggtgagacaatcattctttcaagatgattcaaggaattatgttgatttgggaggaggggtattgggtctgcggggcttccattccagttttcgtcccactcaggggggcttgtctttgaatatggatgtatctacaacaatgattttaaggcctggaccagtatttgagtttctaaaacaaaacctgaatctaaatgatgaacgtttctggctgaaagccagacgaatgttgaagaatatgaggattaaaacaagacaccgtaacatggaattcaaaatcactggtctaagtgagaagccctgttgtgagctattcttcccaatgaaagttaaaaatggtggttgtggtgaagtccggactgttgagatcacagtgtatgagtatttcaccaaacactgtggaattgaactcacatattctgcagacatgccatgccttgatgttggtaaaccaaaacgtcctaactatttacccctagagctctgttcacttgtttcacttcagcggtacacaaaagcgttaactacaaatcaaagggcgaccctggttgaaagatccaggcaaaagcctcgggaaagaattcaaattctgactgatgctttgaaaaacaacaaattcaatgagaaccctgtactttctgcatgtgaaatttcaataggtaggcaattgacagaagttgagggtcggatcctggagactccaaggttgaaggttgggaatcacgaggattgcatccctcgaaatggtagatggaactataacaacaagagatttctggatccaaagaaaattgaacgttggattgctgtcaacttctctgctcgctgtgatctcagtcaaatttcaagggatttaatcagttgtgcaagaaacaagggcattgaaatggaacgtccgcacacattgattgaggaggaacggcatcaagctgctaaagctggccctgctgctagagtggaagcaatgtttgatcagattatagcaaagcttcctggcccccctgagttcattctttgtgtcttgccagtgagaaaaaactctgatatatatggaccttggaagaaaaaatgtctttgcgatatgggaattgccacacaatgcattagccctggaaaaattaatgaccaatacctcacaaatgtcctccttaaaatcaattcaaagcttggaggaatcaactctttattggaaatagagaaaccttcaatcctcccattgctgaaggatactcctacattgattttgggaatggatgtctctcatgggtcccctggtcgatcagatgtcccatcaatagctgcagttgttggttcgctccattggcctttgatttcaaggtacagagcatctgtgagaacacaatctccaaagatggagatgattgaagctttatataagccatcaccagacggaaaggttgatgatggtattatcagggaactgcttgttgatttctataaaacgagcggtaatcgcaaaccaaaacaaattatcatcttcagggatggagtaagtgaatcacagtttaaccaagtattaaacattgagctggagcaaatcatcaagtcatatcagtttctgggcgagtctgatgttcccaagttcacagtagtcgttgctcagaagaatcatcatacaaaattattccaagctaatgcccctgaaaatgttccaccagggacagtagtggacacaaaaattgtgcatccgagaaactatgatttctacatgtctgctcatgcagggatgatcggaacatctaggccagctcattatcatgtcttgcttgatgagataggtttctctcctaatgacctgcagaatcttatccactgtctttcctatgtataccaaaggagcacagcagcagtctcaatagatgggccaatttttgaagctggatgaactttcagaaacatcttcaggaaacgtaacatccacaggaagtatccttgtgccagaccttccgaggctgaaaaagaatgtggcaagtacaatgttcttctgttgaggggatcacccatttcagtaaatacatgctaggctaactgtagatagtttgggtaggctaggggtatacaaagcatacaactccaggcttttgcttttgtgattgattattgaggctggctggctttaacaagcaaaagtttttgtttaaaccatgactaggttatgttgaggggttaggagccattataagaaaagcttaggtgtatcttatatttgtttcatattttactttagtcaaaatcctgctattgctcagaagcttcattcagatagaaaaagctttttttccgtttcttctacttttctttgagcttttagaatccatatttaaagtgtgaatacaagaaaatgtttgatttgagctgggggtgttaggagtaagtattcagaagtgaaaaaattgagttgag

SEQ ID NO: 457 - DNA, 2886 bp, Gossypium raimondii
gactcttcagtaatcctgccttcttcttctgtttttactttgcggatggagaaagcaagtactgaagaggcactagaattaccatctctgcccctaccactgccaacaataccatccaatgtgaagctagagagcttgaagcctcccaagtattctattgtcagtaggagagaagttgggacgagtggacgaaagatatccctgcttgccaaccacttcaaagtttctgtcaatgccccagatgctgtattttaccagtatactgttacagttttgtcagaagatagtagagttgttgaaagcaagaggattgggagaaaacttgttgataaactttatcaaacatactcttcggaacttgctggaaaaagatttgcctatgatggggaaaagagtttgtatacagtgggtcctttgccacagaacaagtttgaatttacaatagtgctagaagactcatttgcaaaatggagtcctgatgctgatggaggccctgctgagactggcaagaggacaaagcgttcttttcagtcaaagacttacaaagtggaactaagctattctgctaagatacccttgaagtcaatatctcttgccctcaaaggagttcagtcagatgatagcactcaggatgctttgagagtacttgacatcattctaaggcagcaagctgctgatcgaggttgccttttggtgagacaatcattctttcaagatgattcaaggaattatgttgatttgggaggaggggtattgggtctgcggggcttccattccagttttcgtcccactcaggggggcttgtctttgaatatggatgtatctacaacaatgattttaaggcctggaccagtatttgagtttctaaaacaaaacctgaatctaaatgatgaacgtttctggctgaaagccagacgaatgttgaagaatatgaggattaaaacaagacaccgtaacatggaattcaaaatcactggtctaagtgagaagccctgttgtgagctattcttcccaatgaaagttaaaaatggtggttgtggtgaagtccggactgttgagatcacagtgtatgagtatttcaccaaacactgtggaattgaactcacatattctgcagacatgccatgccttgatgttggtaaaccaaaacgtcctaactatttacccctagagctctgttcacttgtttcacttcagcggtacacaaaagcgttaactacaaatcaaagggcgaccctggttgaaagatccaggcaaaagcctcgggaaagaattcaaattctgactgatgctttgaaaaacaacaaattcaatgagaaccctgtactttctgcatgtgaaatttcaataggtaggcaattgacagaagttgagggtcggatcctggagactccaaggttgaaggttgggaatcacgaggattgcatccctcgaaatggtagatggaactataacaacaagagatttctggatccaaagaaaattgaacgttggattgctgtcaacttctctgctcgctgtgatctcagtcaaatttcaagggatttaatcagttgtgcaagaaacaagggcattgaaatggaacgtccgcacacattgattgaggaggaacggcatcaagctgctaaagctggccctgctgctagagtggaagcaatgtttgatcagattatagcaaagcttcctggcccccctgagttcattctttgtgtcttgccagtgagaaaaaactctgatatatatggaccttggaagaaaaaatgtctttgcgatatgggaattgccacacaatgcattagccctggaaaaattaatgaccaatacctcacaaatgtcctccttaaaatcaattcaaagcttggaggaatcaactctttattggaaatagagaaaccttcaatcctcccattgctgaaggatactcctacattgattttgggaatggatgtctctcatgggtcccctggtcgatcagatgtcccatcaatagctgcagttgttggttcgctccattggcctttgatttcaaggtacagagcatctgtgagaacacaatctccaaagatggagatgattgaagctttatataagccatcaccagacggaaaggttgatgatggtattatcagggaactgcttgttgatttctataaaacgagcggtaatcgcaaaccaaaacaaattatcatcttcagggatggagtaagtgaatcacagtttaaccaagtattaaacattgagctggagcaaatcatcaagtcatatcagtttctgggcgagtctgatgttcccaagttcacagtagtcgttgctcagaagaatcatcatacaaaattattccaagctaatgcccctgaaaatgttccaccagggacagtagtggacacaaaaattgtgcatccgagaaactatgatttctacatgtctgctcatgcagggatgatcggaacatctaggccagctcattatcatgtcttgcttgatgagataggtttctctcctaatgacctgcagaatcttatccactgtctttcctatgtgtaagttataccaaaggagcacagcagcagtctcaatagtggctcctatttgttatgctcaccttgcggcatatcagatgggccaatttttgaagctggatgaactttcagaaacatcttcaggaaacgtaacatccacaggaagtatccttgtgccagaccttccgaggctgaaaaagaatgtggcaagtacaatgttcttctgttgaggggatcacccatttcagtaaatacatgctaggctaactgtagatagtttgggtaggctaggggtatacaaagcatacaactccaggcttttgcttttgtgattgattattgaggctggctggctttaacaagcaaa

SEQ ID NO: 458 - DNA, 3137 bp, Gossypium raimondii
agtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacatatactgaggtgggaaggtcttttttccatacatcattaggtcctagaggagaacttggtaatggaatagaatactggtctggatattatcagagtcttcgacccactcagatgggtttatctcttaatattgatgtgtctgctcgatcattctatgagccaattttagtttcagagtttgttgcgaaacatttccgacgatcaaacctgtcaaagccgctgtctgatcaagatcgtattaaagtgaaaaaggccttgaagggagtaagagttaagctcatctacatggattatgccaaaacttgcaagattattggagtatctagagaccctataagccagttgacatttactcatgatgataagagaacaaatgtctctgtggtcaagtatttccgtgagaaatacaatgttgtgcttaaatatccatccttgcctgcacttcaaagtggaagcgaagctagacctgtctacctgccaatggagctttgtagtatcgttgagggtcaaagatacacaaaaaaactaaatgaacaacaagttagatctctgctgagagcaacttgtcaacgtccgaacattagggaggggaatattacaaagatggtccaggtcaataattttgaggtggaggagcttgttactaaagaatttggaatgcatgttcgcaaagaacttgcattgattaatgcacgagttctaaatcctccagtgctaaagtatcacgatagtggacgtgacaaaattgttaatcctagctgtgggcaatggaacatgatcaacaagaaaatggtcaatgggggtaaagttgatttctggtcttgtgtgaacttctcctctgaatataggaatatgtcagaagacttctgtgcggggctggtgaatatgtgtaacagcaaaggaatggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggaaaaataaagcgaatttgtgagacggagctaggtattgtttcacaatgttgtaagcctgcgcaagcttcaaagtttagcaaccaatattttgaaaatgttgctctcaagatcaatgctaaggttggggggagaaatactgtgctgaacgatgctgttttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccgggtggaaataatcgaggatctttataaacaaactagggatccacagaagggtttagttgagggtggaatggttagggagttgcttcttgctttctacaggtcaacgaaacaaaagccttctagaattatcttctatagagatggtgttagtgaaggacaattcagccaagttttgctttatgaaatggatgcgattcggaaggcttgttcctcgctacaggaaggatatatgcctcgggttacatttgttgtggttcaaaagaggcatcatactcgcttattccctactgatcgcaacaaaactgataggagtggcaacatattaccaggtactgttgtggatactagcatctgtcatccaactgagtttgatttttatctcaatagtcatgctggaatccaggggacaagcaagcccacacattaccacgttttgttggatgaaaatggcttcagtgctgacatcttgcaagtgctcacaaacaatttatgttacacgtatgcgaggtgtaccaagtccgtttccatagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggatcttgttgattccattggtggactttgtaattatttaatttt

SEQ ID NO: 459 - DNA, 3400 bp, Gossypium raimondii
cttctattataaaatgggctcattcattcctagcctctctgtactcaagagtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacatatactgaggtgggaaggtcttttttccatacatcattaggtcctagaggagaacttggtaatggaatagaatactggtctggatattatcagagtcttcgacccactcagatgggtttatctcttaatattgatgtgtctgctcgatcattctatgagccaattttagtttcagagtttgttgcgaaacatttccgacgatcaaacctgtcaaagccgctgtctgatcaagatcgtattaaagtgaaaaaggccttgaagggagtaagagttaagctcatctacatggattatgccaaaacttgcaagattattggagtatctagagaccctataagccagttgacatttactcatgatgataagagaacaaatgtctctgtggtcaagtatttccgtgagaaatacaatgttgtgcttaaatatccatccttgcctgcacttcaaagtggaagcgaagctagacctgtctacctgccaatggagctttgtagtatcgttgagggtcaaagatacacaaaaaaactaaatgaacaacaagttagatctctgctgagagcaacttgtcaacgtccgaacattagggaggggaatattacaaagatggtccaggtcaataattttgaggtggaggagcttgttactaaagaatttggaatgcatgttcgcaaagaacttgcattgattaatgcacgagttctaaatcctccagtgctaaagtatcacgatagtggacgtgacaaaattgttaatcctagctgtgggcaatggaacatgatcaacaagaaaatggtcaatgggggtaaagttgatttctggtcttgtgtgaacttctcctctgaatataggaatatgtcagaagacttctgtgcggggctggtgaatatgtgtaacagcaaaggaatggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggaaaaataaagcgaatttgtgagacggagctaggtattgtttcacaatgttgtaagcctgcgcaagcttcaaagtttagcaaccaatattttgaaaatgttgctctcaagatcaatgctaaggttggggggagaaatactgtgctgaacgatgctgttttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccgggtggaaataatcgaggatctttataaacaaactagggatccacagaagggtttagttgagggtggaatggttagggagttgcttcttgctttctacaggtcaacgaaacaaaagccttctagaattatcttctatagagatggtgttagtgaaggacaattcagccaagttttgctttatgaaatggatgcgattcggaaggcttgttcctcgctacaggaaggatatatgcctcgggttacatttgttgtggttcaaaagaggcatcatactcgcttattccctactgatcgcaacaaaactgataggagtggcaacatattaccaggtactgttgtggatactagcatctgtcatccaactgagtttgatttttatctcaatagtcatgctggaatccaggggacaagcaagcccacacattaccacgttttgttggatgaaaatggcttcagtgctgacatcttgcaagtgctcacaaacaatttatgttacacgtatgcgaggtgtaccaagtccgtttccatagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggagtctaattttggagtttttgttttggtggttgagcgacttgttgtctgaagtttgaattattataaatcacacactgtttgtggattacgaaaattacataaatgttctttatttttaagacatgttcttagaaaggagttttggtatcattcttaagcttcttttatatcaccgattaatacaagagacgatgaaattttagagaataatgtctttttattaagagtttttaaatgttcagtacacaaatggtaa

SEQ ID NO: 460 - DNA, 3286 bp, Gossypium raimondii
agtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacatatactgaggtgggaaggtcttttttccatacatcattaggtcctagaggagaacttggtaatggaatagaatactggtctggatattatcagagtcttcgacccactcagatgggtttatctcttaatattgatgtgtctgctcgatcattctatgagccaattttagtttcagagtttgttgcgaaacatttccgacgatcaaacctgtcaaagccgctgtctgatcaagatcgtattaaagtgaaaaaggccttgaagggagtaagagttaagctcatctacatggattatgccaaaacttgcaagattattggagtatctagagaccctataagccagttgacatttactcatgatgataagagaacaaatgtctctgtggtcaagtatttccgtgagaaatacaatgttgtgcttaaatatccatccttgcctgcacttcaaagtggaagcgaagctagacctgtctacctgccaatggagctttgtagtatcgttgagggtcaaagatacacaaaaaaactaaatgaacaacaagttagatctctgctgagagcaacttgtcaacgtccgaacattagggaggggaatattacaaagatggtccaggtcaataattttgaggtggaggagcttgttactaaagaatttggaatgcatgttcgcaaagaacttgcattgattaatgcacgagttctaaatcctccagtgctaaagtatcacgatagtggacgtgacaaaattgttaatcctagctgtgggcaatggaacatgatcaacaagaaaatggtcaatgggggtaaagttgatttctggtcttgtgtgaacttctcctctgaatataggaatatgtcagaagacttctgtgcggggctggtgaatatgtgtaacagcaaaggaatggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggaaaaataaagcgaatttgtgagacggagctaggtattgtttcacaatgttgtaagcctgcgcaagcttcaaagtttagcaaccaatattttgaaaatgttgctctcaagatcaatgctaaggttggggggagaaatactgtgctgaacgatgctgttttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccgggtggaaataatcgaggatctttataaacaaactagggatccacagaagggtttagttgagggtggaatggttagggagttgcttcttgctttctacaggtcaacgaaacaaaagccttctagaattatcttctatagagatggtgttagtgaaggacaattcagccaagttttgctttatgaaatggatgcgattcggaaggaaggatatatgcctcgggttacatttgttgtggttcaaaagaggcatcatactcgcttattccctactgatcgcaacaaaactgataggagtggcaacatattaccaggtactgttgtggatactagcatctgtcatccaactgagtttgatttttatctcaatagtcatgctggaatccaggggacaagcaagcccacacattaccacgttttgttggatgaaaatggcttcagtgctgacatcttgcaagtgctcacaaacaatttatgttacacgtatgcgaggtgtaccaagtccgtttccatagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggagtctaattttggagtttttgttttggtggttgagcgacttgttgtctgaagtttgaattattataaatcacacactgtttgtggattacgaaaattacataaatgttctttatttttaagacatgttcttagaaaggagttttggtatcattcttaagcttcttttatatcaccgattaatacaagagacgatgaaattttagagaata

SEQ ID NO: 461 - DNA, 3388 bp, Gossypium raimondii
agtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacatatactgaggtgggaaggtcttttttccatacatcattaggtcctagaggagaacttggtaatggaatagaatactggtctggatattatcagagtcttcgacccactcagatgggtttatctcttaatattgatgtgtctgctcgatcattctatgagccaattttagtttcagagtttgttgcgaaacatttccgacgatcaaacctgtcaaagccgctgtctgatcaagatcgtattaaagtgaaaaaggccttgaagggagtaagagttaagctcatctacatggattatgccaaaacttgcaagattattggagtatctagagaccctataagccagttgacatttactcatgatgataagagaacaaatgtctctgtggtcaagtatttccgtgagaaatacaatgttgtgcttaaatatccatccttgcctgcacttcaaagtggaagcgaagctagacctgtctacctgccaatggagctttgtagtatcgttgagggtcaaagatacacaaaaaaactaaatgaacaacaagttagatctctgctgagagcaacttgtcaacgtccgaacattagggaggggaatattacaaagatggtccaggtcaataattttgaggtggaggagcttgttactaaagaatttggaatgcatgttcgcaaagaacttgcattgattaatgcacgagttctaaatcctccagtgctaaagtatcacgatagtggacgtgacaaaattgttaatcctagctgtgggcaatggaacatgatcaacaagaaaatggtcaatgggggtaaagttgatttctggtcttgtgtgaacttctcctctgaatataggaatatgtcagaagacttctgtgcggggctggtgaatatgtgtaacagcaaaggaatggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggaaaaataaagcgaatttgtgagacggagctaggtattgtttcacaatgttgtaagcctgcgcaagcttcaaagtttagcaaccaatattttgaaaatgttgctctcaagatcaatgctaaggttggggggagaaatactgtgctgaacgatgctgttttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccgggtggaaataatcgaggatctttataaacaaactagggatccacagaagggtttagttgagggtggaatggttagggagttgcttcttgctttctacaggtcaacgaaacaaaagccttctagaattatcttctatagagatggtgttagtgaaggacaattcagccaagttttgctttatgaaatggatgcgattcggaaggcttgttcctcgctacaggaaggatatatgcctcgggttacatttgttgtggttcaaaagaggcatcatactcgcttattccctactgatcgcaacaaaactgataggagtggcaacatattaccaggtactgttgtggatactagcatctgtcatccaactgagtttgatttttatctcaatagtcatgctggaatccaggtaaaatgaggccttcccttgaagtgtgatggtttttatgttaattttgtccgatctgatattgatattgatgttgttgtgtaggggacaagcaagcccacacattaccacgttttgttggatgaaaatggcttcagtgctgacatcttgcaagtgctcacaaacaatttatgttacacgtatgcgaggtgtaccaagtccgtttccatagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggagtctaattttggagtttttgttttggtggttgagcgacttgttgtctgaagtttgaattattataaatcacacactgtttgtggattacgaaaattacataaatgttctttatttttaagacatgttcttagaaaggagttttggtatcattcttaagcttcttttatatcaccgattaatacaagagacgatgaaattttagagaata

SEQ ID NO: 462 - DNA, 3270 bp, Gossypium raimondii
ggctcattcattcctagcctctctgtactcaagagtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaactggcctccaagccagaccttcattatctcagggagtttttgagcagaaagcattttgaatgtcctcaagaagctattcaagttctggatgttgttcttagagctaaaccatctcagatatatactgaggtgggaaggtcttttttctatacatcattaggtcctagaggagaacttggtaatggaacagaatactggtctggatattatcagagtcttcgacccactcagatgggtttatctcttaatattgatgtgtctgctcgatcattctatgagccaattttagtttcagagtttgttgtgaaacatttccgacgatcaaacctgtcaaagccgctgtctgatcaagatcgtattaaagtgaaaaaggccttgaagggagtaagagttaggctcatctacatggattatgccaaaacttgcaagattattggagtatctagagaccctataagccagttgacatttcctcttgatgataagagaacaaatgtctctgtggtcaagtatttccgtgagaaatacaatgttgtgcttaaatatccatccttgcctgcacttcaaagtggaagtgaagctagacctgtctacctgccaatggagctttgtagtatcgttgagggtcaaagatacacaaaaaaactaaatgaacaacaagttagatctctgctgagagcaacttgtcaacgtccgaacattagggaggggaatattacaaagatggtccaggtcaataattttgaggtggaggagcttgttactaaagaatttggaatgcatgttcgcaaagaacttgcattgattaatgcacaagttctaaatcctccagtgctaaagtatcacgatagtggacgtgacaaaatcgttaatcctagttgcgggcaatggaacatgatcaacaagaaaatggtcaattggggtaaagtcgatttctggtcttgtgtgaacttctcctcggaatattggaatatgtcagaagagttctgtgcggagctggtgaatatgtgtaacaacaaaggaatggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggaaaaataaagcgaatttgtgagacggagctaggtattgtttcacaatgttgtaagcctgtgcaagctgcaaagtttagcaaccaatattttgaaaatgttgctctcaagatcaatgctaaggttggggggcgaaatactgtgctgaacgatgctattttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccggatggaaataatccaggatctttataaacaaacaaaggatccacagaagggtttagttgagggtggaatggttagggaattgcttgttgctttcttcaagtcaacaagacaaaagccttctagaattatcttctatagaggtggtgttagtgaaggacaattcagccaagttttgctttatgaaatggatgcgatttggaaggcttgttcctcgctacaggaaggatatatgcctcgggttacatttgttgtggttcaaaagaggcatcatactcgcttattccctactgatcgcaacaaaactgatgggagtggcaacatattaccaggggacaagcaaggccacacgttaccacgttttgtttgatgaaaatggcttcagtgctgacatcttgcaagtgctcacaaacagtttatgttacacgtatgcgaggtgtaccaagtccgtttccatagtgcctccggcatactatgctcacctcgctgcttatagggcacgctattatattgaggatgagatgtcggatagtgggtctactggtggaggccgaaagccgaaagacaaggttgtagagtttaggccgctccccagcataaaggacaatgtgaaggaagtgtttggttggtggaaagttgcgcaagtatagttgcacagtttgtggatgatggtggagtcttgttgattccattggtggactttgtaattatttaattttggagtttctgttttggtggttgagcgaattgtcgtctgaagtttggattaccataatgcacacactgtttgtggattacgaaaatttcagaaatgtcctgtattttcaagaaaagttcttagaaaggatttttagtattatttttaagtttcttttagatcaccaattaatacaagtgatgatgaaattttaaagaataa

SEQ ID NO: 463 - DNA, 3240 bp, Gossypium raimondii
agtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacatatactgaggtgggaaggtcttttttccatacatcattaggtcctagaggagaacttggtaatggaatagaatactggtctggatattatcagagtcttcgacccactcagatgggtttatctcttaatattgatgtgtctgctcgatcattctatgagccaattttagtttcagagtttgttgcgaaacatttccgacgatcaaacctgtcaaagccgctgtctgatcaagatcgtattaaagtgaaaaaggccttgaagggagtaagagttaagctcatctacatggattatgccaaaacttgcaagattattggagtatctagagaccctataagccagttgacatttactcatgatgataagagaacaaatgtctctgtggtcaagtatttccgtgagaaatacaatgttgtgcttaaatatccatccttgcctgcacttcaaagtggaagcgaagctagacctgtctacctgccaatggagctttgtagtatcgttgagggtcaaagatacacaaaaaaactaaatgaacaacaagttagatctctgctgagagcaacttgtcaacgtccgaacattagggaggggaatattacaaagatggtccaggtcaataattttgaggtggaggagcttgttactaaagaatttggaatgcatgttcgcaaagaacttgcattgattaatgcacgagttctaaatcctccagtgctaaagtatcacgatagtggacgtgacaaaatcgttaatcctagttgcgggcaatggaacatgatcaacaagaaaatggtcaattggggtaaagtcgatttctggtcttgtgtgaacttctcctcggaatattggaatatgtcagaagagttctgtgcggagctggtgaatatgtgtaacaacaaaggaatggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggaaaaataaagcgaatttgtgagacggagctaggtattgtttcacaatgttgtaagcctgtgcaagctgcaaagtttagcaaccaatattttgaaaatgttgctctcaagatcaatgctaaggttggggggcgaaatactgtgctgaacgatgctattttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccggatggaaataatccaggatctttataaacaaacaaaggatccacagaagggtttagttgagggtggaatggttagggaattgcttgttgctttcttcaagtcaacaagacaaaagccttctagaattatcttctatagaggtggtgttagtgaaggacaattcagccaagttttgctttatgaaatggatgcgatttggaaggcttgttcctcgctacaggaaggatatatgcctcgggttacatttgttgtggttcaaaagaggcatcatactcgcttattccctactgatcgcaacaaaactgatgggagtggcaacatattaccaggggacaagcaaggccacacgttaccacgttttgtttgatgaaaatggcttcagtgctgacatcttgcaagtgctcacaaacagtttatgttacacgtatgcgaggtgtaccaagtccgtttccatagtgcctccggcatactatgctcacctcgctgcttatagggcacgctattatattgaggatgagatgtcggatagtgggtctactggtggaggccgaaagccgaaagacaaggttgtagagtttaggccgctccccagcataaaggacaatgtgaaggaagtgtttggttggtggaaagttgcgcaagtatagttgcacagtttgtggatgatggtggagtcttgttgattccattggtggactttgtaattatttaattttggagtttctgttttggtggttgagcgaattgtcgtctgaagtttggattaccataatgcacacactgtttgtggattacgaaaatttcagaaatgtcctgtattttcaagaaaagttcttagaaaggatttttagtattatttttaagtttcttttagatcaccaattaatacaagtgatgatgaaattttaaagaataatgt

SEQ ID NO: 464 - DNA, 3240 bp, Gossypium raimondii
agtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacatatactgaggtgggaaggtcttttttccatacatcattaggtcctagaggagaacttggtaatggaatagaatactggtctggatattatcagagtcttcgacccactcagatgggtttatctcttaatattgatgtgtctgctcgatcattctatgagccaattttagtttcagagtttgttgcgaaacatttccgacgatcaaacctgtcaaagccgctgtctgatcaagatcgtattaaagtgaaaaaggccttgaagggagtaagagttaagctcatctacatggattatgccaaaacttgcaagattattggagtatctagagaccctataagccagttgacatttactcatgatgataagagaacaaatgtctctgtggtcaagtatttccgtgagaaatacaatgttgtgcttaaatatccatccttgcctgcacttcaaagtggaagcgaagctagacctgtctacctgccaatggagctttgtagtatcgttgagggtcaaagatacacaaaaaaactaaatgaacaacaagttagatctctgctgagagcaacttgtcaacgtccgaacattagggaggggaatattacaaagatggtccaggtcaataattttgaggtggaggagcttgttactaaagaatttggaatgcatgttcgcaaagaacttgcattgattaatgcacgagttctaaatcctccagtgctaaagtatcacgatagtggacgtgacaaaattgttaatcctagctgtgggcaatggaacatgatcaacaagaaaatggtcaatgggggtaaagttgatttctggtcttgtgtgaacttctcctctgaatataggaatatgtcagaagacttctgtgcggggctggtgaatatgtgtaacagcaaaggaatggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggaaaaataaagcgaatttgtgagacggagctaggtattgtttcacaatgttgtaagcctgtgcaagctgcaaagtttagcaaccaatattttgaaaatgttgctctcaagatcaatgctaaggttggggggcgaaatactgtgctgaacgatgctattttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccggatggaaataatccaggatctttataaacaaacaaaggatccacagaagggtttagttgagggtggaatggttagggaattgcttgttgctttcttcaagtcaacaagacaaaagccttctagaattatcttctatagaggtggtgttagtgaaggacaattcagccaagttttgctttatgaaatggatgcgatttggaaggcttgttcctcgctacaggaaggatatatgcctcgggttacatttgttgtggttcaaaagaggcatcatactcgcttattccctactgatcgcaacaaaactgatgggagtggcaacatattaccaggggacaagcaaggccacacgttaccacgttttgtttgatgaaaatggcttcagtgctgacatcttgcaagtgctcacaaacagtttatgttacacgtatgcgaggtgtaccaagtccgtttccatagtgcctccggcatactatgctcacctcgctgcttatagggcacgctattatattgaggatgagatgtcggatagtgggtctactggtggaggccgaaagccgaaagacaaggttgtagagtttaggccgctccccagcataaaggacaatgtgaaggaagtgtttggttggtggaaagttgcgcaagtatagttgcacagtttgtggatgatggtggagtcttgttgattccattggtggactttgtaattatttaattttggagtttctgttttggtggttgagcgaattgtcgtctgaagtttggattaccataatgcacacactgtttgtggattacgaaaatttcagaaatgtcctgtattttcaagaaaagttcttagaaaggatttttagtattatttttaagtttcttttagatcaccaattaatacaagtgatgatgaaattttaaagaataatgt

SEQ ID NO: 465 - DNA, 3240 bp, Gossypium raimondii
agtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacatatactgaggtgggaaggtcttttttccatacatcattaggtcctagaggagaacttggtaatggaatagaatactggtctggatattatcagagtcttcgacccactcagatgggtttatctcttaatattgatgtgtctgctcgatcattctatgagccaattttagtttcagagtttgttgcgaaacatttccgacgatcaaacctgtcaaagccgctgtctgatcaagatcgtattaaagtgaaaaaggccttgaagggagtaagagttaagctcatctacatggattatgccaaaacttgcaagattattggagtatctagagaccctataagccagttgacatttactcatgatgataagagaacaaatgtctctgtggtcaagtatttccgtgagaaatacaatgttgtgcttaaatatccatccttgcctgcacttcaaagtggaagcgaagctagacctgtctacctgccaatggagctttgtagtatcgttgagggtcaaagatacacaaaaaaactaaatgaacaacaagttagatctctgctgagagcaacttgtcaacgtccgaacattagggaggggaatattacaaagatggtccaggtcaataattttgaggtggaggagcttgttactaaagaatttggaatgcatgttcgcaaagaacttgcattgattaatgcacaagttctaaatcctccagtgctaaagtatcacgatagtggacgtgacaaaatcgttaatcctagttgcgggcaatggaacatgatcaacaagaaaatggtcaattggggtaaagtcgatttctggtcttgtgtgaacttctcctcggaatattggaatatgtcagaagagttctgtgcggagctggtgaatatgtgtaacaacaaaggaatggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggaaaaataaagcgaatttgtgagacggagctaggtattgtttcacaatgttgtaagcctgtgcaagctgcaaagtttagcaaccaatattttgaaaatgttgctctcaagatcaatgctaaggttggggggcgaaatactgtgctgaacgatgctattttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccggatggaaataatccaggatctttataaacaaacaaaggatccacagaagggtttagttgagggtggaatggttagggaattgcttgttgctttcttcaagtcaacaagacaaaagccttctagaattatcttctatagaggtggtgttagtgaaggacaattcagccaagttttgctttatgaaatggatgcgatttggaaggcttgttcctcgctacaggaaggatatatgcctcgggttacatttgttgtggttcaaaagaggcatcatactcgcttattccctactgatcgcaacaaaactgatgggagtggcaacatattaccaggggacaagcaaggccacacgttaccacgttttgtttgatgaaaatggcttcagtgctgacatcttgcaagtgctcacaaacagtttatgttacacgtatgcgaggtgtaccaagtccgtttccatagtgcctccggcatactatgctcacctcgctgcttatagggcacgctattatattgaggatgagatgtcggatagtgggtctactggtggaggccgaaagccgaaagacaaggttgtagagtttaggccgctccccagcataaaggacaatgtgaaggaagtgtttggttggtggaaagttgcgcaagtatagttgcacagtttgtggatgatggtggagtcttgttgattccattggtggactttgtaattatttaattttggagtttctgttttggtggttgagcgaattgtcgtctgaagtttggattaccataatgcacacactgtttgtggattacgaaaatttcagaaatgtcctgtattttcaagaaaagttcttagaaaggatttttagtattatttttaagtttcttttagatcaccaattaatacaagtgatgatgaaattttaaagaataatgt

SEQ ID NO: 466 - DNA, 2631 bp, Gossypium raimondii
agtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaactggcctccaagccagaccttcattatctcagggagtttttgagcagaaagcattttgaatgtcctcaagaagctattcaagttctggatgttgttcttagagctaaaccatctcagatatatactgaggtgggaaggtcttttttctatacatcattaggtcctagaggagaacttggtaatggaacagaatactggtctggatattatcagagtcttcgacccactcagatgggtttatctcttaatattgatgtgtctgctcgatcattctatgagccaattttagtttcagagtttgttgtgaaacatttccgacgatcaaacctgtcaaagccgctgtctgatcaagatcgtattaaagtgaaaaaggccttgaagggagtaagagttaggctcatctacatggattatgccaaaacttgcaagattattggagtatctagagaccctataagccagttgacatttcctcttgatgataagagaacaaatgtctctgtggtcaagtatttccgtgagaaatacaatgttgtgcttaaatatccatccttgcctgcacttcaaagtggaagtgaagctagacctgtctacctgccaatggagatggtccaggtcaataattttgaggtggaggagcttgttactaaagaatttggaatgcatgttcgcaaagaacttgcattgattaatgcacaagttctaaatcctccagtgctaaagtatcacgatagtggacgtgacaaaatcgttaatcctagttgcgggcaatggaacatgatcaacaaggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggaaaaataaagcgaatttgtgagacggagctaggtattgtttcacaatgttgtaagcctgtgcaagctgcaaagtttagcaaccaatattttgaaaatgttgctctcaagatcaatgctaaggttggggggcgaaatactgtgctgaacgatgctattttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccggatggaaataatccaggatctttataaacaaacaaaggatccacagaagggtttagttgagggtggaatggttagaggtggtgttagtgaaggacaattcagccaagttttgctttatgaaatggatgcgatttggaaggcttgttcctcgctacaggaaggatatatgcctcgggttacatttgttgtggttcaaaagaggcatcatactcgcttattccctactgatcgcaacaaaactgatgggagtggcaacatattaccaggtactgttgtggatactagcatctgtcatccaaccgagtttgatttttatctcaatagtcatgctggaatcctggggacaagcaaggccacacgttaccacgttttgtttgatgaaaatggcttcagtgctgacatcttgcaagtgctcacaaacagtttatgttacacgtatgcgaggtgtaccaagtccgtttccatagggcacgctattatattgaggatgagatgtcggatagtgggtctactggtggaggccgaaagccgaaagacaaggttgtag

SEQ ID NO: 467 - DNA, 2964 bp, Gossypium raimondii
ccttactaccctaactcaacgacattattttttgaaagaactcgatcaagattgctttttccgtagttacttttccttaaaaaaacccaagggaaagtttaactgttaatgatttgcttaaatgagttgggctttttgttatttattgtctcgttaatttttattttcattggattttaatgtgtattttccttttctgttttcttatttatttacttgtctctttgtccatctctgttacttgcatcttcttctcgtctcttttgatggcctttggtgcttcattgcttataggttactgtaacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggaaggagcgacaatttaaggttgcaatcaaactggcctccaagccagaccttcattatctcagggagtttttgagcagaaagcattttgaatgtcctcaagaagctattcaagttctggatgttgttcttagagctaaaccatctcagatatatactgaggtgggaaggtcttttttctatacatcattaggtcctagaggagaacttggtaatggaacagaatactggtctggatattatcagagtcttcgacccactcagatgggtttatctcttaatattgatgtgtctgctcgatcattctatgagccaattttagtttcagagtttgttgtgaaacatttccgacgatcaaacctgtcaaagccgctgtctgatcaagatcgtattaaagtgaaaaaggccttgaagggagtaagagttaggctcatctacatggattatgccaaaacttgcaagattattggagtatctagagaccctataagccagttgacatttcctcttgatgataagagaacaaatgtctctgtggtcaagtatttccgtgagaaatacaatgttgtgcttaaatatccatccttgcctgcacttcaaagtggaagtgaagctagacctgtctacctgccaatggagctttgtagtatcgttgagggtcaaagatacacaaaaaaactaaatgaacaacaagttagatctctgctgagagcaacttgtcaacgtccgaacattagggaggggaatattacaaagatggtccaggtcaataattttgaggtggaggagcttgttactaaagaatttggaatgcatgttcgcaaagaacttgcattgattaatgcacaagttctaaatcctccagtgctaaagtatcacgatagtggacgtgacaaaatcgttaatcctagttgcgggcaatggaacatgatcaacaagaaaatggtcaattggggtaaagtcgatttctggtcttgtgtgaacttctcctcggaatattggaatatgtcagaagagttctgtgcggagctggtgaatatgtgtaacaacaaaggaatggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggaaaaataaagcgaatttgtgagacggagctaggtattgtttcacaatgttgtaagcctgtgcaagctgcaaagtttagcaaccaatattttgaaaatgttgctctcaagatcaatgctaaggttggggggcgaaatactgtgctgaacgatgctattttaaggagaattccgcttgtgactgatgtccctacaatcatttttggggcagatgtcactcatccgccgcctggcgaagactctagttcttctatagctgcagtcgttgcttcaatggattggcctgaggtaaccaagtatcgtggaattgtctctgcacagactcaccggatggaaataatccaggatctttataaacaaacaaaggatccacagaagggtttagttgagggtggaatggttagggaattgcttgttgctttcttcaagtcaacaagacaaaagccttctagaattatcttctatagaggtggtgttagtgaaggacaattcagccaagttttgctttatgaaatggatgcgatttggaaggcttgttcctcgctacaggaaggatatatgcctcgggttacatttgttgtggttcaaaagaggcatcatactcgcttattccctactgatcgcaacaaaactgatgggagtggcaacatattaccaggggacaagcaaggccacacgttaccacgttttgtttgatgaaaatggcttcagtgctgacatcttgcaagtgctcacaaacagtttatgttacacgtatgcgaggtgtaccaagtccgtttccatagtgcctccggcatactatgctcacctcgctgcttatagggcacgctattatattgaggatgagatgtcggatagtgggtctactggtggaggccgaaagccgaaagacaaggttgtagagtttaggccgctccccagcataaaggacaatgtgaaggaagtgtttggttggtggaaagttgcgcaagtatagttgcacagtttgtggatgatggtggagtcttgttgattccattggtggactttgtaattatttaattttggagtttctgttttggtggttgagcgaattgtcgtctgaagtttggattaccataatgcacacactgtttgtggattacgaaaatttcagaaatgtcctgtattttcaagaaaagttcttagaaaggatttttagtattatttttaagtttcttttagatcaccaattaatacaagtgatgatgaaattttaaagaataa

SEQ ID NO: 468 - DNA, 5643 bp, Gossypium raimondii
gttcgactcattaataagcgaacaaatgtaatgataaaaaattgttggaagaggagttaccagatttgactttccattgaccgagcacaattcattacaagaaatcctaggagaccgctctgcttagtaaaccgaatgggatttcgacatctatttgtccatttgatcaaagcaaacaaaaatctttttttctttttgcttagcggttgagacttggaaaataagcaatttttaccagtcttctcaccgctgtggctataattccctcgttgatgccgggcggcgaattgtccaccgacgggaccgagccgttcatggcctctaaagttaaagccttttctactccgtcgccgatcgttgaaatcagccgaaaagatgaacctataatggaaaagaaagagaaggatccacgaaaaattgctagaaagtatcaactggagttatgcaagaaagccatggaagagaacataattgtttatttggagactggttgtgggaagacccacatcgcagttctgcttatttatgagcttggccatttgatacggaaacctcagaatagggtatgcatttttcttgctcccacagtggctcttgttcagcagcaagcccgggttatagaagattctcttgatttcaaggttgggacttattgtggtaactgcagacacttgaagaaccatcatgactgggaaatagagatcaaagaatatgaggttcttgttatgactccccaaatactacttcgtagcttatatcactgcttcatcaggatggacttaatcgctcttctgatatttgatgagtgtcatcatgctcaaataaaaagcaaccatccttatgcagaaatcatgaaagttttttatgataaagctactgcatcaatgcttcctcgtatatttggaatgacagcatctcccgttgttggtaaagatgcttccagtcaagtaaatttacctaaaagcatcaacagcctcgaaaacttgcttgatgctaaggtatattcagttggagataaggaggaattggaaagctttgtagcatctcctgtggttagagtatatgattatggtcctgtcaattttggttcttcttgttccaccattatctattgtagtaaacttgaggagattaagcgccagtgcataccttttgtcaggaagaatggtgatattcaatctgccaggaacacaaaaaagctgctcaacagaatgcatgataatataatcttttgcttggaaaatttgggcatttggggagcattgcaagcttgccgacttcttttaactggtaataactctgagaggaatgaattgatagaagatgaagggattttaagtgacgactctgtatgtgatcgatatcttgttcatgctgctgatgtttttgcttcagattgtacgagagatggatctgcaaacgatttatctgatgtagagattttgaaggaaccatttttctcgaaaaagctgctacgtcttgttggaattctttccaccttcaggttacagccaaatatgaaatgcataatttttgtgaataggattgttactgcaagatccttgtcatacatactgcaaaaccttaagttcctattattttggaagtgccattttcttgtgggagtccactctggacttaaaagtatgtcaagaaagacaatgaaaaacattcttgagaagttcagaacaggagagttgaatcttttgattgcaactaaagtcggtgaagaaggacttgacattcagacatgctgccttgtgatacgttttgaccttccagaaactgttgcgagctttatccaatcaagaggacgtgcaagaatgcctctctctgagtatgcatttctggtgaacagtgggaacgagaaggaactagatttgattaaaaattttaagaaagatgaagatcgtatgaatgtggaaatttctttcagaacatctactgaggtttctattggtcttgaggagagaatctatatggttgattcatctggtgcttccatcagttcaggatatagtatctctctacttcatcattactgctcaaaactgccccatgatgagtactttttccccaagccaagcttttattattttgaagattcaggaggaacaatctgcaatataatattaccttcgaatgctccaataaatcaaattgccagtacacctcaatcttcagttaatgctgccaaaaaagatgcttgtctaaaagcaattgaagaattgcataaattgggagccttgactgaccatctcttgccactgcaaaacagtgttcttgaggaggaaacattgctggtgtcttctgattctgggagctctgaagatgaggattcacgaggtgaactacatgagatgcttgttcctgctgtgcttaaagaatcatggactaacttagagaactgtgtcctcctttatgcttactatataaaatttaatccgaatcctaaggacaggagctataaagagtttgctctctttgtcaagtctcctctccctaaggaggctgagagaatggagctggatcttcacctatctcggcgtaggtcggtgatgacaaagcttaccccatctggagttgcagaatttaagagagaagagatcatgcaggcacagcattttcaagaaatgttcttcaaggtcatccttgatagatcagaactcctttctgaatttattactttaggaaatgtctttctttcatcaagctcctcaacattctatttattgcttcctgttattctctccaattgtgagaataaagtgacagtggattgggggattgtccaaagatgtttgtcgtctccactttttaagcctcctgttgcagctgcaaagattgaaaatttcccttcagatgtttgcttgcaccttgtaaatggttgtaggagtataagagacattgagaatagtttggtgtatgccacacacaagagggccttttactttattactagcattgttggtgaaaaaaatggttacagcccatatagagattcaggcactttaaatcacgtggagcacttaaacatgtctggcattcatcttaagtaccctgaacaacctcttctgcatgcaaaaccactttttaagttgcacaatttgctccacaaccgaaagccggaggattcagaagcaaatgaactggaagaatacttcattgatttgcctcctgagctttgtcagctgaaaataataggcttctccaaagagatagggagttcgctttctttgttaccatcaattatgcatcgcctggagaacttgcttgtggctattgaactgaagcatgttttttctgcttcatttgccgagggagctgaagttactgcccttagggtcctagaagcacttactacagagaagtgtcaagagcgtttttctcttgaaaggcttgagacacttggtgattccttcctcaagtttgctgtggcccgccatctttttcttttacatgatgcacttgatgaaggggaattgactaggagaaggtctaatgttgtaaataattctaatttattcaagctggcaacaaggcgaaatttacaggtttacatacgtgatcaaccttttgatccttatcagttctttcccttgggccatccctgcccagtaatttgtacaaaagaaactaaaggaactgttcacccacaatctagttgtcaagtagatcatacaaagagtgaagtcaaatgtagtagaaatcaccattggctacataaggacacaatttctgatgtggttgaggctcttgtaggagcatttatagttgataggggcttccaagcggcaacagcatttcttagatggataggcatacgagtggacttccaaggttctcaacttaatagtatttgcgctgcaagcaagagatttatgccactttcctccctattggatattggagatcttgaaaatttgttgggttaccagtttcttcataagggtctcctccttcaggcgattgtgcatccttcttttaataggcatgggggaggctgctaccagagattggagtttcttggagatgctgtcttagattatttaattacatcatatctgttttcactgtatccaaagttgaaacctggtcagttgactgatttgagatcagtgtcagtgaacaacaagtcctttgccaatgttgcagtggacagacgcttacacaaatttcttatgtgtgactcttgtcacctcaacgaggccatagaaaaatatgttgacttcatcacatcatcatcaccagacaggggattgtttgaagggccaaaatgtccgaaggctcttggtgacttggtagagtcttgtttcggtgctattctccttgatacagggttcaacttgaaccgtgtttggaagataatgctatccattctggatccaatcaagagcctttcaagtgtgcagctcaatcctatcagggaagtacaggagctttcccagtgttataactgggatttgcagtttctagttgcaaaagttggtagaaatttttcagtggatgcaaaggtaaatgcaggagatgtacctctatgtgtttcttacagcaacattaatagaaaagaagctatcagaactactgcacatcaactatatgtaaagttaaaggctctaggatatgcacccaaatcaaagtccttggaagaagttttgaagggaagccccaagaatgaagccaagctgattggatacgatgaaacacccattgatgtcagtgttactgacatagttggatttgaaaacatgaaattgcaagaatctcttgtgaatgatttcaaccccaaaactcgttctattaaaaggacaacttctagcggtgtatcttgcatctcacctggtagcagacctccaccttcttttgaagtaaaagcagcaaggggttcagcctctggtattgaagccaaaggcaaaccccccaattgctccattgtggatcctagttgtgggattgactcgccatccaaaggtgaatcacatggtcgtactgctagatcacagttatacgaaatctgtgctatcaattgctggaaaccccctttgtttgaatgttgcaaagaggaaggaccaagtcatttgagatcattcacttacagggtaatagttgaaatcgaagaagctccagatatgatattggagtgcttcagcagtcctcggaccacaaagaaggcagcagccgagcatgcagcggaaggtgcactctggtatttaaaacatggaggatacttacaataggtcaacttaaccgactgaacctcattgctagacataatggagatcaaggtttgaatttagtcattttgctatctcagttcaatggctctagtctctctcttcatcccctatttaatgaacttaaaaaccagcattttctttaaaagtcgaataaaagatgatttaacaacaaaattaaaattttgcttcgaacttgttaacgtggcatttttggtatgtccatgtatccaacaaggagcccaatttaattcaatccatgtatctggtgctgtgtcatgaaagtgtaaagattaaatttattaaactcgagatagaggattaaagctattcaattgagataataagatgatcgaatttagatttcaaactcaaatatgtttgatgatgtctatattgatggctgtta

SEQ ID NO: 469 - DNA, 5036 bp, Gossypium raimondii
gatggaatttgttattgttttatagcaagcccgggttatagaagattctcttgatttcaaggttgggacttattgtggtaactgcagacacttgaagaaccatcatgactgggaaatagagatcaaagaatatgaggttcttgttatgactccccaaatactacttcgtagcttatatcactgcttcatcaggatggacttaatcgctcttctgatatttgatgagtgtcatcatgctcaaataaaaagcaaccatccttatgcagaaatcatgaaagttttttatgataaagctactgcatcaatgcttcctcgtatatttggaatgacagcatctcccgttgttggtaaagatgcttccagtcaagtaaatttacctaaaagcatcaacagcctcgaaaacttgcttgatgctaaggtatattcagttggagataaggaggaattggaaagctttgtagcatctcctgtggttagagtatatgattatggtcctgtcaattttggttcttcttgttccaccattatctattgtagtaaacttgaggagattaagcgccagtgcataccttttgtcaggaagaatggtgatattcaatctgccaggaacacaaaaaagctgctcaacagaatgcatgataatataatcttttgcttggaaaatttgggcatttggggagcattgcaagcttgccgacttcttttaactggtaataactctgagaggaatgaattgatagaagatgaagggattttaagtgacgactctgtatgtgatcgatatcttgttcatgctgctgatgtttttgcttcagattgtacgagagatggatctgcaaacgatttatctgatgtagagattttgaaggaaccatttttctcgaaaaagctgctacgtcttgttggaattctttccaccttcaggttacagccaaatatgaaatgcataatttttgtgaataggattgttactgcaagatccttgtcatacatactgcaaaaccttaagttcctattattttggaagtgccattttcttgtgggagtccactctggacttaaaagtatgtcaagaaagacaatgaaaaacattcttgagaagttcagaacaggagagttgaatcttttgattgcaactaaagtcggtgaagaaggacttgacattcagacatgctgccttgtgatacgttttgaccttccagaaactgttgcgagctttatccaatcaagaggacgtgcaagaatgcctctctctgagtatgcatttctggtgaacagtgggaacgagaaggaactagatttgattaaaaattttaagaaagatgaagatcgtatgaatgtggaaatttctttcagaacatctactgaggtttctattggtcttgaggagagaatctatatggttgattcatctggtgcttccatcagttcaggatatagtatctctctacttcatcattactgctcaaaactgccccatgatgagtactttttccccaagccaagcttttattattttgaagattcaggaggaacaatctgcaatataatattaccttcgaatgctccaataaatcaaattgccagtacacctcaatcttcagttaatgctgccaaaaaagatgcttgtctaaaagcaattgaagaattgcataaattgggagccttgactgaccatctcttgccactgcaaaacagtgttcttgaggaggaaacattgctggtgtcttctgattctgggagctctgaagcagatgaggattcacgaggtgaactacatgagatgcttgttcctgctgtgcttaaagaatcatggactaacttagagaactgtgtcctcctttatgcttactatataaaatttaatccgaatcctaaggacaggagctataaagagtttgctctctttgtcaagtctcctctccctaaggaggctgagagaatggagctggatcttcacctatctcggcgtaggtcggtgatgacaaagcttaccccatctggagttgcagaatttaagagagaagagatcatgcaggcacagcattttcaagaaatgttcttcaaggtcatccttgatagatcagaactcctttctgaatttattactttaggaaatgtctttctttcatcaagctcctcaacattctatttattgcttcctgttattctctccaattgtgagaataaagtgacagtggattgggggattgtccaaagatgtttgtcgtctccactttttaagcctcctgttgcagctgcaaagattgaaaatttcccttcagatgtttgcttgcaccttgtaaatggttgtaggagtataagagacattgagaatagtttggtgtatgccacacacaagagggccttttactttattactagcattgttggtgaaaaaaatggttacagcccatatagagattcaggcactttaaatcacgtggagcacttaaacatgtctggcattcatcttaagtaccctgaacaacctcttctgcatgcaaaaccactttttaagttgcacaatttgctccacaaccgaaagccggaggattcagaagcaaatgaactggaagaatacttcattgatttgcctcctgagctttgtcagctgaaaataataggcttctccaaagagatagggagttcgctttctttgttaccatcaattatgcatcgcctggagaacttgcttgtggctattgaactgaagcatgttttttctgcttcatttgccgagggagctgaagttactgcccttagggtcctagaagcacttactacagagaagtgtcaagagcgtttttctcttgaaaggcttgagacacttggtgattccttcctcaagtttgctgtggcccgccatctttttcttttacatgatgcacttgatgaaggggaattgactaggagaaggtctaatgttgtaaataattctaatttattcaagctggcaacaaggcgaaatttacaggtttacatacgtgatcaaccttttgatccttatcagttctttcccttgggccatccctgcccagtaatttgtacaaaagaaactaaaggaactgttcacccacaatctagttgtcaagtagatcatacaaagagtgaagtcaaatgtagtagaaatcaccattggctacataaggacacaatttctgatgtggttgaggctcttgtaggagcatttatagttgataggggcttccaagcggcaacagcatttcttagatggataggcatacgagtggacttccaaggttctcaacttaatagtatttgcgctgcaagcaagagatttatgccactttcctccctattggatattggagatcttgaaaatttgttgggttaccagtttcttcataagggtctcctccttcaggcgattgtgcatccttcttttaataggcatgggggaggctgctaccagagattggagtttcttggagatgctgtcttagattatttaattacatcatatctgttttcactgtatccaaagttgaaacctggtcagttgactgatttgagatcagtgtcagtgaacaacaagtcctttgccaatgttgcagtggacagacgcttacacaaatttcttatgtgtgactcttgtcacctcaacgaggccatagaaaaatatgttgacttcatcacatcatcatcaccagacaggggattgtttgaagggccaaaatgtccgaaggctcttggtgacttggtagagtcttgtttcggtgctattctccttgatacagggttcaacttgaaccgtgtttggaagataatgctatccattctggatccaatcaagagcctttcaagtgtgcagctcaatcctatcagggaagtacaggagctttcccagtgttataactgggatttgcagtttctagttgcaaaagttggtagaaatttttcagtggatgcaaaggtaaatgcaggagatgtacctctatgtgtttcttacagcaacattaatagaaaagaagctatcagaactactgcacatcaactatatgtaaagttaaaggctctaggatatgcacccaaatcaaagtccttggaagaagttttgaagggaagccccaagaatgaagccaagctgattggatacgatgaaacacccattgatgtcagtgttactgacatagttggatttgaaaacatgaaattgcaagaatctcttgtgaatgatttcaaccccaaaactcgttctattaaaaggacaacttctagcggtgtatcttgcatctcacctggtagcagacctccaccttcttttgaagtaaaagcagcaaggggttcagcctctggtattgaagccaaaggcaaaccccccaattgctccattgtggatcctagttgtgggattgactcgccatccaaaggtgaatcacatggtcgtactgctagatcacagttatacgaaatctgtgctatcaattgctggaaaccccctttgtttgaatgttgcaaagaggaaggaccaagtcatttgagatcattcacttacagggtaatagttgaaatcgaagaagctccagatatgatattggagtgcttcagcagtcctcggaccacaaagaaggcagcagccgagcatgcagcggaaggtgcactctggtatttaaaacatggaggatacttacaataggtcaacttaaccgactgaacctcattgctagacataatggagatcaaggtttgaatttagtcattttgctatctcagttcaatggctctagtctctctcttcatcccctatttaatgaacttaaaaaccagcattttctttaaaagtcgaataaaagatgatttaacaacaaaattaaaattttgcttcgaacttgttaacgtggcatttttggtatgtccatgtatccaacaaggagcccaatttaattcaatccatgtatctggtgctgtgtcatgaaagtgtaaagattaaatttattaaactcgagatagaggattaaagctattcaattgagataataagatgatcgaatttagatttcaaactcaaatat

SEQ ID NO: 470 - DNA, 5194 bp, Gossypium raimondii
cattaatactctattgtcgggaattattagtttataatattgttttggctaagtttgggatttaggaaccaacttggatcatcattcgtcaattgtggattctttgcagcagtggaccatgcatggtttttaatggaatttgttattgttttatagcaagcccgggttatagaagattctcttgatttcaaggttgggacttattgtggtaactgcagacacttgaagaaccatcatgactgggaaatagagatcaaagaatatgaggttcttgttatgactccccaaatactacttcgtagcttatatcactgcttcatcaggatggacttaatcgctcttctgatatttgatgagtgtcatcatgctcaaataaaaagcaaccatccttatgcagaaatcatgaaagttttttatgataaagctactgcatcaatgcttcctcgtatatttggaatgacagcatctcccgttgttggtaaagatgcttccagtcaagtaaatttacctaaaagcatcaacagcctcgaaaacttgcttgatgctaaggtatattcagttggagataaggaggaattggaaagctttgtagcatctcctgtggttagagtatatgattatggtcctgtcaattttggttcttcttgttccaccattatctattgtagtaaacttgaggagattaagcgccagtgcataccttttgtcaggaagaatggtgatattcaatctgccaggaacacaaaaaagctgctcaacagaatgcatgataatataatcttttgcttggaaaatttgggcatttggggagcattgcaagcttgccgacttcttttaactggtaataactctgagaggaatgaattgatagaagatgaagggattttaagtgacgactctgtatgtgatcgatatcttgttcatgctgctgatgtttttgcttcagattgtacgagagatggatctgcaaacgatttatctgatgtagagattttgaaggaaccatttttctcgaaaaagctgctacgtcttgttggaattctttccaccttcaggttacagccaaatatgaaatgcataatttttgtgaataggattgttactgcaagatccttgtcatacatactgcaaaaccttaagttcctattattttggaagtgccattttcttgtgggagtccactctggacttaaaagtatgtcaagaaagacaatgaaaaacattcttgagaagttcagaacaggagagttgaatcttttgattgcaactaaagtcggtgaagaaggacttgacattcagacatgctgccttgtgatacgttttgaccttccagaaactgttgcgagctttatccaatcaagaggacgtgcaagaatgcctctctctgagtatgcatttctggtgaacagtgggaacgagaaggaactagatttgattaaaaattttaagaaagatgaagatcgtatgaatgtggaaatttctttcagaacatctactgaggtttctattggtcttgaggagagaatctatatggttgattcatctggtgcttccatcagttcaggatatagtatctctctacttcatcattactgctcaaaactgccccatgatgagtactttttccccaagccaagcttttattattttgaagattcaggaggaacaatctgcaatataatattaccttcgaatgctccaataaatcaaattgccagtacacctcaatcttcagttaatgctgccaaaaaagatgcttgtctaaaagcaattgaagaattgcataaattgggagccttgactgaccatctcttgccactgcaaaacagtgttcttgaggaggaaacattgctggtgtcttctgattctgggagctctgaagatgaggattcacgaggtgaactacatgagatgcttgttcctgctgtgcttaaagaatcatggactaacttagagaactgtgtcctcctttatgcttactatataaaatttaatccgaatcctaaggacaggagctataaagagtttgctctctttgtcaagtctcctctccctaaggaggctgagagaatggagctggatcttcacctatctcggcgtaggtcggtgatgacaaagcttaccccatctggagttgcagaatttaagagagaagagatcatgcaggcacagcattttcaagaaatgttcttcaaggtcatccttgatagatcagaactcctttctgaatttattactttaggaaatgtctttctttcatcaagctcctcaacattctatttattgcttcctgttattctctccaattgtgagaataaagtgacagtggattgggggattgtccaaagatgtttgtcgtctccactttttaagcctcctgttgcagctgcaaagattgaaaatttcccttcagatgtttgcttgcaccttgtaaatggttgtaggagtataagagacattgagaatagtttggtgtatgccacacacaagagggccttttactttattactagcattgttggtgaaaaaaatggttacagcccatatagagattcaggcactttaaatcacgtggagcacttaaacatgtctggcattcatcttaagtaccctgaacaacctcttctgcatgcaaaaccactttttaagttgcacaatttgctccacaaccgaaagccggaggattcagaagcaaatgaactggaagaatacttcattgatttgcctcctgagctttgtcagctgaaaataataggcttctccaaagagatagggagttcgctttctttgttaccatcaattatgcatcgcctggagaacttgcttgtggctattgaactgaagcatgttttttctgcttcatttgccgagggagctgaagttactgcccttagggtcctagaagcacttactacagagaagtgtcaagagcgtttttctcttgaaaggcttgagacacttggtgattccttcctcaagtttgctgtggcccgccatctttttcttttacatgatgcacttgatgaaggggaattgactaggagaaggtctaatgttgtaaataattctaatttattcaagctggcaacaaggcgaaatttacaggtttacatacgtgatcaaccttttgatccttatcagttctttcccttgggccatccctgcccagtaatttgtacaaaagaaactaaaggaactgttcacccacaatctagttgtcaagtagatcatacaaagagtgaagtcaaatgtagtagaaatcaccattggctacataaggacacaatttctgatgtggttgaggctcttgtaggagcatttatagttgataggggcttccaagcggcaacagcatttcttagatggataggcatacgagtggacttccaaggttctcaacttaatagtatttgcgctgcaagcaagagatttatgccactttcctccctattggatattggagatcttgaaaatttgttgggttaccagtttcttcataagggtctcctccttcaggcgattgtgcatccttcttttaataggcatgggggaggctgctaccagagattggagtttcttggagatgctgtcttagattatttaattacatcatatctgttttcactgtatccaaagttgaaacctggtcagttgactgatttgagatcagtgtcagtgaacaacaagtcctttgccaatgttgcagtggacagacgcttacacaaatttcttatgtgtgactcttgtcacctcaacgaggccatagaaaaatatgttgacttcatcacatcatcatcaccagacaggggattgtttgaagggccaaaatgtccgaaggctcttggtgacttggtagagtcttgtttcggtgctattctccttgatacagggttcaacttgaaccgtgtttggaagataatgctatccattctggatccaatcaagagcctttcaagtgtgcagctcaatcctatcagggaagtacaggagctttcccagtgttataactgggatttgcagtttctagttgcaaaagttggtagaaatttttcagtggatgcaaaggtaaatgcaggagatgtacctctatgtgtttcttacagcaacattaatagaaaagaagctatcagaactactgcacatcaactatatgtaaagttaaaggctctaggatatgcacccaaatcaaagtccttggaagaagttttgaagggaagccccaagaatgaagccaagctgattggatacgatgaaacacccattgatgtcagtgttactgacatagttggatttgaaaacatgaaattgcaagaatctcttgtgaatgatttcaaccccaaaactcgttctattaaaaggacaacttctagcggtgtatcttgcatctcacctggtagcagacctccaccttcttttgaagtaaaagcagcaaggggttcagcctctggtattgaagccaaaggcaaaccccccaattgctccattgtggatcctagttgtgggattgactcgccatccaaaggtgaatcacatggtcgtactgctagatcacagttatacgaaatctgtgctatcaattgctggaaaccccctttgtttgaatgttgcaaagaggaaggaccaagtcatttgagatcattcacttacagggtaatagttgaaatcgaagaagctccagatatgatattggagtgcttcagcagtcctcggaccacaaagaaggcagcagccgagcatgcagcggaaggtgcactctggtatttaaaacatggaggatacttacaataggtcaacttaaccgactgaacctcattgctagacataatggagatcaaggtttgaatttagtcattttgctatctcagttcaatggctctagtctctctcttcatcccctatttaatgaacttaaaaaccagcattttctttaaaagtcgaataaaagatgatttaacaacaaaattaaaattttgcttcgaacttgttaacgtggcatttttggtatgtccatgtatccaacaaggagcccaatttaattcaatccatgtatctggtgctgtgtcatgaaagtgtaaagattaaatttattaaactcgagatagaggattaaagctattcaattgagataataagatgatcgaatttagatttcaaactcaaatatgtttgatgatgtctatattgatggctgtta

SEQ ID NO: 471 - DNA, 1215 bp, Gossypium raimondii
atgggttttcaaatttttggatttcaaaaggttgtttttcaatatgtgaagtgttttgagatacttcttctgaaaagtgtggcacaccgagtctccggcgccgaattcttgctggagttacggactaaagccaagatttttgttcaaaaaggaaggtctatgatgggatgtctggatgaaactagaaccttgaattatggccaagtttttgtgcagttttctggctctagatctaaccaacgtgatattgttcagggtaaggtaattgttgccaaaaacccctacttgcacccaggcgatgtacgtgtattaagggctgtcaatgtgcctgatttgcaccatatggtcgattgtgttgttttccatagaaaggaaccaggtacacctcatcccaatgaatgctctggaactgatctggatggtgatacttactttctctgttgggaccctgaattgattccatataagcaaatcgatgctatggattattcacccgctccaacaaccaaattggatcatgaagttaccattgaggaaattgaagaatacttcacaaactacataaacctgacaaagttgttttctattgcagttgactttccgaaaacgggtgtaccagctgaaataccacaagacttgagggtcaaagaatttccgaatttcatggagaaaccagacaagccaagttatcaatcacacaatgttattggaaagctttttcgagaggtgaagaaccttgcacccaatgaatgctcgattaagttcttaactcgggaaaagatgcagaggttttatgatcccgacatggaagttgaaggctttgaggattatatcgacgatgctttcttctacaaaagtaaatacgattacaaattggggaatttgatggactattgcagggtcaaaacggaggctgaaatactcagtgggggtatcatgaaaatgtcgagatcttttacgaagaaaagagatgcagaagcgatcagcatggcagtgagatcattgagaaaggaagctaggtcatggttcaatgaaaaaagaagtgagttggatgaagaaatagatgatgcatatgcaaaagcctcagcttggtactatgtcacatatcatccaagttattggggtcagtataatgagggaatgaatagggatcatttcttgagctttccttggtgtgtttatgacaagttggtccagatcaagaaagaaaatgca

SEQ ID NO: 472 - DNA, 3928 bp, Gossypium raimondii
aaacaaaatcgctgacgtggccaaaagccattcgctattagatagggaagccaatggaaaattggaaaaatatataataatttaatgttaaacgtgtgacgtggccagccgaagcgatttgcagaacatcctgcaatgtggggtgcgacggaggaaatcacggcatttttcttcgtctatttgagtaaattgactaaaatagttgacaatccaggattctaagtaaagttggagtcttttatgttactctcactctaatatcaatggagtttgggtttagttatcgttatgactgatcattcatcttcttcttctctttgttaattaattgtatgctgtaaggtggtaagagcacagagtgaattgagacaatgggtaagacgattcaggtttatgggttcctctcaaatgtgtctgcaggagaagtaaagacatttttagagggatatacgggcagagaaactgtttatgccctgaagatcaggcagcataaaaagggtggaagagcatatgctattgtgcagtttaccagaagctctgctgcagagctaattataaggttggctaatcaaaggctatactatgggagatcatatcttaaggctcgagaaatggagaccgacatcgtgccaaagccgagagcctttttgcacacaatggaacgtgttacggtgaattttggctgtcaagtctctgtagaaaaattttatgttctctggaaagcagaaaatgttactctaaattttgggactggaatgcggaaattggaatttctagtgtcgtattgtaggtcaaaatacaagcttgagctcttctatgagaacatctggcagattgagctgcgttgtcctgacagtcaaacctcaaagcatcttctgattcagttatttggcgctccccggatatatgagaaagaagtgcgtgcttctgaacttgtatttgatgatcccttgcttaactatttcaaggatgtgcctgatgatcaatgggtaaggacaacggatttcactcgttctaattgtattggacaatcttctgtattatgcttggagcttcctcacaacctccgacttccaaattttcgggagaactttgcttattacaaagaaaatgaaagcagattggttttggaaagtggttcttcttactcctgcaatcttagtctagtcccaattgtatgccctttgcgggtaattgacttgccatttgaaatcttgttcaaggttaatctgttggtgcaaaatgggtgcatcccaggaccagcacttgatgatactttttatcgattggttgatccttgtagaatggacaaagtctacatagaccatgcgctggagaaactttattatctaagagaatgctgctatgaaccttcgaggtggctctttgaggagtacaaaaatttctcaagatcgaggaaatatcaaggttcacctgctatatccttagatgaaggtttggtatatgtaagaagggttcagataacgccttctagggtctacttttgtggtcctgagattaatgtttcaaaccgtgtgctacgccaattccataatgatattgataattttcttcgcatcagttttgttgatgaagagttggagaagatccattcaataaatgtgcaggcaaggggtaggagaactagtatttacgaaaggattctttctactcttagaaatggcgtactgattggggataagagatttgaatttcttgccttttcatcaagtcaattacgggagaactcagcctggatgtttgcttcaagaaaggggctcactgcagcagatataaggtcatggatgggaaattttagtaaaataagaaatgtggcaaaatatgctgctagactgggccaatctttcagttcatcaactgaaactcttagtgtttctaaagatgaaatcaaccttattccagatatagaaattatgaaggatgggattaaatacgtcttttcagatggaattggaaaaatatcagctaaatttgctaagaaggtggcagctaaatgtcggttgaagggttgcactccatctgcctttcagattcggattggtggattcaagggtgttgtggctattgacccgacctcatcttggaaattatccctcagaaagagtatggaaaagtatgaatcagagaacactaaactggatgttttggcttggagtaagtatcagccatgttttctgaaccgccagttgattaccctgttatctactcttggagttccagaccgtgcttttgagaaaaaacaaagagaagtaattgagcaactcaatgctctcctgacggatcctttagaggctcaggaggctctggagttaatgtctccaggagaaaatactaacattctgaaggaaatgctcttgtgtggttataagcctgatgctgaaccattcctttcaatgatgttggaagcttttcgagcttcgaagttgctggagttgcggactaaagccaggatttttgttcaaaaaggaaggtctatgatgggatgtctggatgaaactagaaccttgaattatggccaagtttttgtgcagttttctggctctagatctgagcaacgttgtattgttcagggtaaggtaattgttgccaaaaacccctgcttgcacccaggcgatgtgcgtgtattaagggctgtcaatgtgcctgatttgcaccatatggtcgattgtgttgtttttccacagaaaggaaccagacctcatcccaatgaatgctctggaagtgatctggatggtgatatttactttgtctgttgggaccctgaattgattccatataagcaaatggatcctatggattattcacccgctccaacaaccatattggatcatgaagttaccattgaggaaattgaagaatacttcacaaactacatagtcaatgacagtttgggaataatttcaaatgctcatactgcttttgctgatagagaacctggcaaagcaatgtgccacccgtgcctggagcttgcaaagctgttttcaattgcagttgactttccgaaaacgggtgtaccagctgaaataccacaagaactgagggtcaaagaatatccggatttcatggagaaaccagacaagccaagttatcaatcacacaatgttattggaaagcttttccgagaggtgaagaaccttgcacccaatgaatgctcgattaagttcttaactcgggaaaagatgcagaggttttatgatcccgacatggaagttgaaggctttgaggattatatcgacgatgctttcttccacaaaagtaaatacgattacaaattggggaatttgatggactattacggggtcaaaacggaggctgaaatactcagtgggggtatcttgaaaatgtcgagatcttttacgaagaaaagggatgcagaagcgatcagtatggcagtgagatcattgagaaaggaagctaggtcatggttcaatgaagaaagaagtgagttggatgaagaaatagatgatgcatatgcaaaagcctcagcttggtactatgtcacatatcatccaagttattggggtcagtataatgagggaatgaatagggatcatttcctgagctttccttggtgtgtttatgacaagttgatccagatcaagaaagaaaaagcagctgttcgggaagctttggatttgtcgtctctggaacatcgctttcaacgtagattgcatttgcattgaggtgttctggcttatgtttcctgtttactgtagtaggtaaatgtgggtagctcatgtttcctaacgacactgaatgttatatatataatgtataaacatatccagtttagtttggattgtgcatgttttggacctgttgtaaaaataagagatcggattagtttggttgaatcgaaaacgtgtgatctgcatatttagtgtgtatcatttaaaatcctttgaac

SEQ ID NO: 473 - DNA, 1188 bp, Gossypium raimondii
ttagtttctccgattgcatatttatcttcaacttttcgagcttcgaagttgctgaagttgcggactaaagccaggatttttgttcaaaaaggaaggtctatgatgggatgtctggatgaaactagaaccttgaattatggccaagtttttgtgcagttttctggctctagatctgaccaacgtgatattgttcagggtaaggtaattgttgccaaaaacccctgcttgcacccgggcgatgtgcgtgtattaagggctgtcaatgtgcctgatttgcaccatatggtcgattgtgttaatcaaatttttagacctcatcccaatgaatgctctggaagtgatctggatagtgatacttactttgtctgttgggaccctgaattgattccatataagcaaatcaatgctatggattattcacccgctccaacaaccaaattggatcatgaagttaccattgaggaaattgaagaatacttcacaaactacatagtcaatgacaagaacctgacaaagctattttcaattgcagttgactttccgaaaacgggtgtaccagctgaaataccacaagacttgagggtcaaagaattttcggatttcatggagaaaccagacaagccaagttatcaatcacacaatgttattggaaagcttttccgagaggtgaagaaccttgcacccaatgaatgctcgattaagttcttaactcgggaaaagatgcagaggttttatgatcccgacatggaagttgaaggctttgaggattatattgacgatgctttcttctacaaaagtaaatacgattacaaattggggaatgtgatggactattacagggtcaaaacggaggctgaaatactcagtgggggtatcatgaaaatgtcgagatcttttacgaagaaaagagatgcagaagcgatcagcatagcagtgagatcattgagaaaggaagctgggtcatggttcaatgaaaaaggaagcgagttggatgaagaaatagatgatgcatatgcaaaagcctcagcttggtactatgtcacatatcatccaagttattggggtcactttccttggtgtgtttatgacaagttggtccagataagaaagaaaatgcagctgtttcgggaagctttggatttgtcgtctccggaacatcgctttcaacatggattgcatttgcattga

SEQ ID NO: 474 - DNA, 8393 bp, Gossypium raimondii
atttgaatttttttaaataaaataataacaaaaataagatactttagtataataaacttgaatttagttagatttttaaaattattactttagaaaattttaaaaagtttaactttctttatatatattctttaatttttttaaaaattattataaaaattttaaaatataaaatttgggtttttataaataatttgaattttaaaaatcatttttataatttttattgagagagaccaatttgttcattttcaaaattgagatgaaccaaagaaatatttacaccgatctattattcaaattattcgaactcgaaacttaaattacttattcaagttgaataaaataattcgatttgattgacttaaaattcaaaattttctaatctaatcgaattttactcacccgtacacacaatacctaatgatattctttgttaaaaataggtgttgcatgcagtggaagctggtgctatttgtttttgatataatcatcaataataaatgataaattcaataaaaataaataaatgatgatatagaaaaagatacttttaataatttttggattaatagaattattaaatatttaaaatttaaaaccattaaactcctctaaaaaagctatcgtagttcgtacaggataaatttggaaataaaaaaattcgtgtaggataattacaacgtacctaatttcctaaaatcccagaaattattgattaaaacaaatgtataaaattctaatatcatccgcacgtgtcatccaaattgtgtcacagccatatccactatcacatttaaactcctcaccataactacgtggtccccacactacttttccctttttacccccaagtgatcgtatgcaagcaatctcaccaatcaacaagatcaaatcaaagccgtcaatacttgatctaacgctgtatgttcgtctaaatccacgtctttgatgatacactcactgcaacgaaattcaattttttataaacagaaatcgaaaaaagtcgaaaatattatatcagattttccttctcacattattgagcataaaaaggcaatacattaattaaaaaattatttctgtaacgtttcccctaaaaggttaatgctattttatcttgcattttatattattaaaaaaattaataaagggattttctaatttaggaagattaacatattataaatgcaatgttgataataaatcaataaaatacgagataaaaaagagagatttttgtttgactttccttttaattcatatatttcatgtggtatgattcctattataagatatctaggcatttaataacatataaattgtttttataaattttggttaatgaaattaatatgcgagaaaaatagggaataaaactcattaacaatggtaaacttagtagtctttttctaaaagaaagggcaaagtgtttttttttttttggtataatattgctccgatttaatttatctaaatatagttttaattcttattgatctaaaagtgagagagtggacggtggagatgtggtagagtatggtaatcgtgtaagaccgcgaagcagaggagacggtaaccactaatagagggacagaagaagcgttggtcacttgtgtattttagtctctctcagccttttagtatttagagggagagggagtgagctaaaaaagaagagaaagagggtcgtagaattttgctgtctctttgagttccttagggtttcttgtttcaatttttttttgttttttctctccggatttcaggtatttcctctgaaacctttttattttggattttttttctttgctttttttttcatggttctttgaggttttttttagagtttttttttggagatttttgggctttgttcttcgcaatgctgctacagtgcgtgtgatttttaaaggtttttcttcctttttaagtatgatctgggttccttcttcctgtttttgttcatggatttttttttctgttaaagtttacgttttttttttggttgatgttttttgtttttcttctctatttttttaaaaaactgtagaatgctgtagtttttaggcagcgtaagcatgttttgtcacttcagtagcttttcgttaactttttttatattatttatattttgttttttttatggtttaaaaaagtattttcttgtcactcttcagagttttgaccaaacttctaaaagctgtttagtttttttaggtggttttaaaccatgtttacaagttcttactctctttatttactcttcctttgcaatttctagcctttgctgtctcttggtgtgctaaaggtattagcttttctgcatatctgctttgagtcctacaatgctgatgtatatctggttaaagttatgatttttatgcaaaatcagtatatttgtccactttgttatagccttttatatttgtgcatacattaaaatgccgtcatagtgtacctgagttcaagttcatattaaacgttcccatattgtgtactctgaagaagggaatctttgtccatctataccatttgtgttcatctttctctatttttgactgttgatactcctatatatataaatatataatctttttggtaataggtcctctgatttttcaggtcatgttgtatttgtttatcgtttgtttagtacacatgcctttcctgtgcatgcatgttgtttttccttgttgaacgtttcgtgagaagaaaattttctttatacttgctaatatttattttcatgttggttagggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgtacgtgattggatttcttctctctatgcttttgtttctattttttgtcagttgttgcttggaaaacattcataattggggaagtactttgtattcggttcaacaggtttctctttcatatgaagatggtcgccctgtggatggtaagggtgttggaaggaaagtgattgacagagtgcatgagacctacaaaaatgatttggatggaaagaattttgcctatgatggtgaaaaaagtttatttactataggtccgctaccaaacaacaagcttgagtttactgttgtacttgaggatgttgcacctaccaggtagaaatgcacttttaatttttagtatctatactgccccaagtcattgttatgtcagctctaacttgggagtgctatcatgtatagaaacaatggaaatgcaagccctgatggccaggacagcccaaatgggcgtgaaagaaagagattaagaagaccgtatcattcaaagacctttaaagtggagattagctatgctgcgaagatacccatgcaagcaattcaaaatgctctgcgtgggcaggaatctgaaaactctcaagaagcactgagggtgctggatatcattttaaggcagcatgctgcgaaacagtgagttaaaatatgtgtctgcatgtttactttttttttgaaatattgaattttggtcctaggtatcatgttaatcttgacattacctactctttctcaggggatgcctacttgttcgccaatctttctttcaagataatcagaacaacttcacagacattggaggaggtgtccttggctgtagaggtttccattcaagtttcagagccactcaaggaggcctttcactaaatatcggtttggaatcctctctctctctctctcgctctgtcagtacttctgcattttgtgctgtggttattgattaataactcttatattttatctttgtcagatgtatcaactaccatgataattcaacctggtccggtagttgattttttacttgcaaatcagaatgctagagatccttactctcttgactggaacaaggtaataaataactgttatttttgtaaatgtagtttgatttcctttgtatcaattattaaattttattttgaaattgctggaaaatcctgaataggcaaaacgggtgctgaagaatctgaggattaaagttagtccgtctaatcaagagtacaagattactggcttgagtgaacaactgtgcaaggatcagttgtatggcttccaaattttatttcactcccttttggttgatttatgctaattgactattttattctgagcttgctgcttgcatcttgtgagtaattatttgtttttgatgagttactgttcccatgttgtaggttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgaggttatttcctgcactgatttgttttcaatttgttaaattagaaaagttttgtaactaattcttgtctactgtttgttgttcacctgtggcaataatgcagctttgctctttggtgtctttgcaacgctacactaaggcactatccactttccaaagagcttccctggttgaaaaatcgaggcagaagcctcaagaaaggatgaatgttttgtctaatgtaggtctttttttgaagcttttgaattgcgttgtttcacttatgccaaaatttaagtgacacaagtgttgaaaatttatttgcaggttttacgtaccagtaattatggtgctgaaccaatgctgaaatcttgtggtgttaatataaactctaatttcacccaagtggatggacgtattctgccagcaccaagggtaggtgaataatgtccgtgtattgttccttgatagaacaatcatttgtgttagttgtttagactttctttttatattagatcttcctgctaattgagttctcttgattacagttaagagtcggcaacggtgaagatttctttccaaggaatgggcgttggaattttaacaacaaggtcattgctctttttgatttttcagccttctatcctgtatttgttttatccatttatttctttaagagtttatgtatgctttcatagaaattggtggagccatctaggattgaaagatgggctgttgtgaacttctcggctcctcgttgtgatccaaacaacattgcaagggatttgattcgttgtggagaaatgaaaggaattgtaagtcagcatccacttttttatttctgttatggtttgcttgttggcataggaatagctataaaattcaacttgttggctaaagttctttctgttctctctttttcagcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatggttggcggaatctctcttttcatacattttgtctgcatgtttatcttgaagtgtattacttgcatataaagttcattaaaattttcaagggccatggaagcggaagaatctttctgagtatggcatcgtgactcagtgtatggcaccagctagggtgaatgatcaataccttacaaatcttcttctgaagatcaatgctaaggtttgtttactgttcctatcaaatgggttcttattgctttaagctatttttattgttgcagttctaacttctgtaattatatcagtagctgtatcttcctcttactatgtaaatctggtaatgtcttatctttttattttctcacagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtagagatcttgtttcttattattgaatttcttttgcttccgtctattgaattaataatggaagtcatagaggcttaattgtgcagtctttctgatattcaaattctgcgagttcttttaattgcatttaattgtaggtggttagctccaggcaatggccattgatttcccgctatagggcatcagtccgtacacagtctccgaagcttgaaatggtagattctcttttcaaaccagtttctgacaaagtggatgagggtatcatgaggtgcgtttgaatcatatagttctttggcttctgaagggataaatatttttcaagaaaaacttgaacgactagtttttatttttttgcaaaatatttatgtttttgtatccttttctaatctttaatccttctcttgtttccagttggagtttggtatggattgggttgtaataagaatattgtatatgtttgcatagctaacatgcttttcttttatttcagggaagctctcttagacttctatacaagttcagggaagaggaagcctgatcagatcattattttcaggttttactttttaagattttttgtctcgcacttcaaaaatgacaatatatatgctgaagaatgctttattaggaatatcaagcgtatagattttgctgtttttccggattttctattgcttatctatcttgatttttgtgcactgccatgtctcttgtttgttatttcttgtgagctagtttgtggttaaattgcagtttctgttgagtttcactgatatgcttgtgctgaagtttattacttgctcattacttggtttaaattagggatggggttagcgagtctcagttcaatcaagttttgaacaaagaacttgatcaagttattgaggtatgcagtagttcctttcaatcatttgaactgaaaatttcattgttcttaaatttattcacagcgaagttattttggtagttctaaaatgttacctcaagatctttatcatttggataatacatttctactgtaataggcttgcaagttccttgacgagaattggaaccctaagtttgtggttattgttgcacaaaaaaaccatcataccaagtttttccagcagggatctcctgacaatgtgctacctggttaggcttacccattctttaataaatgtcaggcaggaccactgttgtagtggttaaagcttgtattttttttattgtgcaggtactgtcattgacaacaaagtatgccatccgaagaacaatgatttttacctttgtgctcatgctggaatgatagtaagttcacttatttttgtttctgttaattgatgattgataatacagctgtctcaattttgcagtcattgataacacattatatgatttgtgtttgccgttcaggggaccacaaggccgacccactatcatgttctcttagaccaggttgggttttcagctgatgatctgcaggagcttgttcattctctatcctacgtgtaagtacagaaacaagcgtacagaaacaacttatttttttacaaatagtttaagctgttttcactgtcacaatctttgtattctgtctgttgcaggtatcaaaggagcaccacagccatatctgttggtaagtataagtattgtttctgatctttgctttgggttttccgtttttgatgcataattttgtagtttcatttcttaagtgcattgtttctgatctttgctttgggttttccttttttgatgcagtggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatgctttcaaagtagtatact

SEQ ID NO: 475 - DNA, 8340 bp, Gossypium raimondii
tattctttaatttttttaaaaattattataaaaattttaaaatataaaatttgggtttttataaataatttgaattttaaaaatcatttttataatttttattgagagagaccaatttgttcattttcaaaattgagatgaaccaaagaaatatttacaccgatctattattcaaattattcgaactcgaaacttaaattacttattcaagttgaataaaataattcgatttgattgacttaaaattcaaaattttctaatctaatcgaattttactcacccgtacacacaatacctaatgatattctttgttaaaaataggtgttgcatgcagtggaagctggtgctatttgtttttgatataatcatcaataataaatgataaattcaataaaaataaataaatgatgatatagaaaaagatacttttaataatttttggattaatagaattattaaatatttaaaatttaaaaccattaaactcctctaaaaaagctatcgtagttcgtacaggataaatttggaaataaaaaaattcgtgtaggataattacaacgtacctaatttcctaaaatcccagaaattattgattaaaacaaatgtataaaattctaatatcatccgcacgtgtcatccaaattgtgtcacagccatatccactatcacatttaaactcctcaccataactacgtggtccccacactacttttccctttttacccccaagtgatcgtatgcaagcaatctcaccaatcaacaagatcaaatcaaagccgtcaatacttgatctaacgctgtatgttcgtctaaatccacgtctttgatgatacactcactgcaacgaaattcaattttttataaacagaaatcgaaaaaagtcgaaaatattatatcagattttccttctcacattattgagcataaaaaggcaatacattaattaaaaaattatttctgtaacgtttcccctaaaaggttaatgctattttatcttgcattttatattattaaaaaaattaataaagggattttctaatttaggaagattaacatattataaatgcaatgttgataataaatcaataaaatacgagataaaaaagagagatttttgtttgactttccttttaattcatatatttcatgtggtatgattcctattataagatatctaggcatttaataacatataaattgtttttataaattttggttaatgaaattaatatgcgagaaaaatagggaataaaactcattaacaatggtaaacttagtagtctttttctaaaagaaagggcaaagtgtttttttttttttggtataatattgctccgatttaatttatctaaatatagttttaattcttattgatctaaaagtgagagagtggacggtggagatgtggtagagtatggtaatcgtgtaagaccgcgaagcagaggagacggtaaccactaatagagggacagaagaagcgttggtcacttgtgtattttagtctctctcagccttttagtatttagagggagagggagtgagctaaaaaagaagagaaagagggtcgtagaattttgctgtctctttgagttccttagggtttcttgtttcaatttttttttgttttttctctccggatttcaggtatttcctctgaaacctttttattttggattttttttctttgctttttttttcatggttctttgaggttttttttagagtttttttttggagatttttgggctttgttcttcgcaatgctgctacagtgcgtgtgatttttaaaggtttttcttcctttttaagtatgatctgggttccttcttcctgtttttgttcatggatttttttttctgttaaagtttacgttttttttttggttgatgttttttgtttttcttctctatttttttaaaaaactgtagaatgctgtagtttttaggcagcgtaagcatgttttgtcacttcagtagcttttcgttaactttttttatattatttatattttgttttttttatggtttaaaaaagtattttcttgtcactcttcagagttttgaccaaacttctaaaagctgtttagtttttttaggtggttttaaaccatgtttacaagttcttactctctttatttactcttcctttgcaatttctagcctttgctgtctcttggtgtgctaaaggtattagcttttctgcatatctgctttgagtcctacaatgctgatgtatatctggttaaagttatgatttttatgcaaaatcagtatatttgtccactttgttatagccttttatatttgtgcatacattaaaatgccgtcatagtgtacctgagttcaagttcatattaaacgttcccatattgtgtactctgaagaagggaatctttgtccatctataccatttgtgttcatctttctctatttttgactgttgatactcctatatatataaatatataatctttttggtaataggtcctctgatttttcaggtcatgttgtatttgtttatcgtttgtttagtacacatgcctttcctgtgcatgcatgttgtttttccttgttgaacgtttcgtgagaagaaaattttctttatacttgctaatatttattttcatgttggttagggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgtacgtgattggatttcttctctctatgcttttgtttctattttttgtcagttgttgcttggaaaacattcataattggggaagtactttgtattcggttcaacaggtttctctttcatatgaagatggtcgccctgtggatggtaagggtgttggaaggaaagtgattgacagagtgcatgagacctacaaaaatgatttggatggaaagaattttgcctatgatggtgaaaaaagtttatttactataggtccgctaccaaacaacaagcttgagtttactgttgtacttgaggatgttgcacctaccaggtagaaatgcacttttaatttttagtatctatactgccccaagtcattgttatgtcagctctaacttgggagtgctatcatgtatagaaacaatggaaatgcaagccctgatggccaggacagcccaaatgggcgtgaaagaaagagattaagaagaccgtatcattcaaagacctttaaagtggagattagctatgctgcgaagatacccatgcaagcaattcaaaatgctctgcgtgggcaggaatctgaaaactctcaagaagcactgagggtgctggatatcattttaaggcagcatgctgcgaaacagtgagttaaaatatgtgtctgcatgtttactttttttttgaaatattgaattttggtcctaggtatcatgttaatcttgacattacctactctttctcaggggatgcctacttgttcgccaatctttctttcaagataatcagaacaacttcacagacattggaggaggtgtccttggctgtagaggtttccattcaagtttcagagccactcaaggaggcctttcactaaatatcggtttggaatcctctctctctctctctcgctctgtcagtacttctgcattttgtgctgtggttattgattaataactcttatattttatctttgtcagatgtatcaactaccatgataattcaacctggtccggtagttgattttttacttgcaaatcagaatgctagagatccttactctcttgactggaacaaggtaataaataactgttatttttgtaaatgtagtttgatttcctttgtatcaattattaaattttattttgaaattgctggaaaatcctgaataggcaaaacgggtgctgaagaatctgaggattaaagttagtccgtctaatcaagagtacaagattactggcttgagtgaacaactgtgcaaggatcagttgtatggcttccaaattttatttcactcccttttggttgatttatgctaattgactattttattctgagcttgctgcttgcatcttgtgagtaattatttgtttttgatgagttactgttcccatgttgtaggttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgaggttatttcctgcactgatttgttttcaatttgttaaattagaaaagttttgtaactaattcttgtctactgtttgttgttcacctgtggcaataatgcagctttgctctttggtgtctttgcaacgctacactaaggcactatccactttccaaagagcttccctggttgaaaaatcgaggcagaagcctcaagaaaggatgaatgttttgtctaatgtaggtctttttttgaagcttttgaattgcgttgtttcacttatgccaaaatttaagtgacacaagtgttgaaaatttatttgcaggttttacgtaccagtaattatggtgctgaaccaatgctgaaatcttgtggtgttaatataaactctaatttcacccaagtggatggacgtattctgccagcaccaagggtaggtgaataatgtccgtgtattgttccttgatagaacaatcatttgtgttagttgtttagactttctttttatattagatcttcctgctaattgagttctcttgattacagttaagagtcggcaacggtgaagatttctttccaaggaatgggcgttggaattttaacaacaaggtcattgctctttttgatttttcagccttctatcctgtatttgttttatccatttatttctttaagagtttatgtatgctttcatagaaattggtggagccatctaggattgaaagatgggctgttgtgaacttctcggctcctcgttgtgatccaaacaacattgcaagggatttgattcgttgtggagaaatgaaaggaattgtaagtcagcatccacttttttatttctgttatggtttgcttgttggcataggaatagctataaaattcaacttgttggctaaagttctttctgttctctctttttcagcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatggttggcggaatctctcttttcatacattttgtctgcatgtttatcttgaagtgtattacttgcatataaagttcattaaaattttcaagggccatggaagcggaagaatctttctgagtatggcatcgtgactcagtgtatggcaccagctagggtgaatgatcaataccttacaaatcttcttctgaagatcaatgctaaggtttgtttactgttcctatcaaatgggttcttattgctttaagctatttttattgttgcagttctaacttctgtaattatatcagtagctgtatcttcctcttactatgtaaatctggtaatgtcttatctttttattttctcacagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtagagatcttgtttcttattattgaatttcttttgcttccgtctattgaattaataatggaagtcatagaggcttaattgtgcagtctttctgatattcaaattctgcgagttcttttaattgcatttaattgtaggtggttagctccaggcaatggccattgatttcccgctatagggcatcagtccgtacacagtctccgaagcttgaaatggtagattctcttttcaaaccagtttctgacaaagtggatgagggtatcatgaggtgcgtttgaatcatatagttctttggcttctgaagggataaatatttttcaagaaaaacttgaacgactagtttttatttttttgcaaaatatttatgtttttgtatccttttctaatctttaatccttctcttgtttccagttggagtttggtatggattgggttgtaataagaatattgtatatgtttgcatagctaacatgcttttcttttatttcagggaagctctcttagacttctatacaagttcagggaagaggaagcctgatcagatcattattttcaggttttactttttaagattttttgtctcgcacttcaaaaatgacaatatatatgctgaagaatgctttattaggaatatcaagcgtatagattttgctgtttttccggattttctattgcttatctatcttgatttttgtgcactgccatgtctcttgtttgttatttcttgtgagctagtttgtggttaaattgcagtttctgttgagtttcactgatatgcttgtgctgaagtttattacttgctcattacttggtttaaattagggatggggttagcgagtctcagttcaatcaagttttgaacaaagaacttgatcaagttattgaggtatgcagtagttcctttcaatcatttgaactgaaaatttcattgttcttaaatttattcacagcgaagttattttggtagttctaaaatgttacctcaagatctttatcatttggataatacatttctactgtaataggcttgcaagttccttgacgagaattggaaccctaagtttgtggttattgttgcacaaaaaaaccatcataccaagtttttccagcagggatctcctgacaatgtgctacctggttaggcttacccattctttaataaatgtcaggcaggaccactgttgtagtggttaaagcttgtattttttttattgtgcaggtactgtcattgacaacaaagtatgccatccgaagaacaatgatttttacctttgtgctcatgctggaatgatagtaagttcacttatttttgtttctgttaattgatgattgataatacagctgtctcaattttgcagtcattgataacacattatatgatttgtgtttgccgttcaggggaccacaaggccgacccactatcatgttctcttagaccaggttgggttttcagctgatgatctgcaggagcttgttcattctctatcctacgtgtaagtacagaaacaagcgtacagaaacaacttatttttttacaaatagtttaagctgttttcactgtcacaatctttgtattctgtctgttgcaggtatcaaaggagcaccacagccatatctgttggtaagtataagtattgtttctgatctttgctttgggttttccgtttttgatgcataattttgtagtttcatttcttaagtgcattgtttctgatctttgctttgggttttccttttttgatgcagtggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatgctttcaaagtagtatacttgcaaaattaaaacaaggaggatcaactttgcttgaaaatttgaatctgagctgactttgttgagcagagaa

SEQ ID NO: 476 - DNA, 7993 bp, Gossypium raimondii
taatctaatcgaattttactcacccgtacacacaatacctaatgatattctttgttaaaaataggtgttgcatgcagtggaagctggtgctatttgtttttgatataatcatcaataataaatgataaattcaataaaaataaataaatgatgatatagaaaaagatacttttaataatttttggattaatagaattattaaatatttaaaatttaaaaccattaaactcctctaaaaaagctatcgtagttcgtacaggataaatttggaaataaaaaaattcgtgtaggataattacaacgtacctaatttcctaaaatcccagaaattattgattaaaacaaatgtataaaattctaatatcatccgcacgtgtcatccaaattgtgtcacagccatatccactatcacatttaaactcctcaccataactacgtggtccccacactacttttccctttttacccccaagtgatcgtatgcaagcaatctcaccaatcaacaagatcaaatcaaagccgtcaatacttgatctaacgctgtatgttcgtctaaatccacgtctttgatgatacactcactgcaacgaaattcaattttttataaacagaaatcgaaaaaagtcgaaaatattatatcagattttccttctcacattattgagcataaaaaggcaatacattaattaaaaaattatttctgtaacgtttcccctaaaaggttaatgctattttatcttgcattttatattattaaaaaaattaataaagggattttctaatttaggaagattaacatattataaatgcaatgttgataataaatcaataaaatacgagataaaaaagagagatttttgtttgactttccttttaattcatatatttcatgtggtatgattcctattataagatatctaggcatttaataacatataaattgtttttataaattttggttaatgaaattaatatgcgagaaaaatagggaataaaactcattaacaatggtaaacttagtagtctttttctaaaagaaagggcaaagtgtttttttttttttggtataatattgctccgatttaatttatctaaatatagttttaattcttattgatctaaaagtgagagagtggacggtggagatgtggtagagtatggtaatcgtgtaagaccgcgaagcagaggagacggtaaccactaatagagggacagaagaagcgttggtcacttgtgtattttagtctctctcagccttttagtatttagagggagagggagtgagctaaaaaagaagagaaagagggtcgtagaattttgctgtctctttgagttccttagggtttcttgtttcaatttttttttgttttttctctccggatttcaggtatttcctctgaaacctttttattttggattttttttctttgctttttttttcatggttctttgaggttttttttagagtttttttttggagatttttgggctttgttcttcgcaatgctgctacagtgcgtgtgatttttaaaggtttttcttcctttttaagtatgatctgggttccttcttcctgtttttgttcatggatttttttttctgttaaagtttacgttttttttttggttgatgttttttgtttttcttctctatttttttaaaaaactgtagaatgctgtagtttttaggcagcgtaagcatgttttgtcacttcagtagcttttcgttaactttttttatattatttatattttgttttttttatggtttaaaaaagtattttcttgtcactcttcagagttttgaccaaacttctaaaagctgtttagtttttttaggtggttttaaaccatgtttacaagttcttactctctttatttactcttcctttgcaatttctagcctttgctgtctcttggtgtgctaaaggtattagcttttctgcatatctgctttgagtcctacaatgctgatgtatatctggttaaagttatgatttttatgcaaaatcagtatatttgtccactttgttatagccttttatatttgtgcatacattaaaatgccgtcatagtgtacctgagttcaagttcatattaaacgttcccatattgtgtactctgaagaagggaatctttgtccatctataccatttgtgttcatctttctctatttttgactgttgatactcctatatatataaatatataatctttttggtaataggtcctctgatttttcaggtcatgttgtatttgtttatcgtttgtttagtacacatgcctttcctgtgcatgcatgttgtttttccttgttgaacgtttcgtgagaagaaaattttctttatacttgctaatatttattttcatgttggttagggtatggattcgtttgagcaagagggaaatggggcagcgctggaatccctgcctcctccgccacctgtgcctcctgatgttgttccgatcaaagcagaatcggatgcgaagaagattgtacgacaccctatggcaaggcgtggtgttggaactaaagggcagaaggtaactatactcaccaatcacttcaaagtgagcgtggggagtactgatggacacttctaccattacagcgtacgtgattggatttcttctctctatgcttttgtttctattttttgtcagttgttgcttggaaaacattcataattggggaagtactttgtattcggttcaacaggtttctctttcatatgaagatggtcgccctgtggatggtaagggtgttggaaggaaagtgattgacagagtgcatgagacctacaaaaatgatttggatggaaagaattttgcctatgatggtgaaaaaagtttatttactataggtccgctaccaaacaacaagcttgagtttactgttgtacttgaggatgttgcacctaccaggtagaaatgcacttttaatttttagtatctatactgccccaagtcattgttatgtcagctctaacttgggagtgctatcatgtatagaaacaatggaaatgcaagccctgatggccaggacagcccaaatgggcgtgaaagaaagagattaagaagaccgtatcattcaaagacctttaaagtggagattagctatgctgcgaagatacccatgcaagcaattcaaaatgctctgcgtgggcaggaatctgaaaactctcaagaagcactgagggtgctggatatcattttaaggcagcatgctgcgaaacagtgagttaaaatatgtgtctgcatgtttactttttttttgaaatattgaattttggtcctaggtatcatgttaatcttgacattacctactctttctcaggggatgcctacttgttcgccaatctttctttcaagataatcagaacaacttcacagacattggaggaggtgtccttggctgtagaggtttccattcaagtttcagagccactcaaggaggcctttcactaaatatcggtttggaatcctctctctctctctctcgctctgtcagtacttctgcattttgtgctgtggttattgattaataactcttatattttatctttgtcagatgtatcaactaccatgataattcaacctggtccggtagttgattttttacttgcaaatcagaatgctagagatccttactctcttgactggaacaaggtaataaataactgttatttttgtaaatgtagtttgatttcctttgtatcaattattaaattttattttgaaattgctggaaaatcctgaataggcaaaacgggtgctgaagaatctgaggattaaagttagtccgtctaatcaagagtacaagattactggcttgagtgaacaactgtgcaaggatcagttgtatggcttccaaattttatttcactcccttttggttgatttatgctaattgactattttattctgagcttgctgcttgcatcttgtgagtaattatttgtttttgatgagttactgttcccatgttgtaggttctcaatgaagcagaaaaataccaaaaatgaaaatggtgaagctgagacactggagattactatttatgattattttgttaaccatcgcaacatacagttgcgttattctgctgatttgccatgtattaatgttgggaagcctaagaggccaacatatattcctattgaggttatttcctgcactgatttgttttcaatttgttaaattagaaaagttttgtaactaattcttgtctactgtttgttgttcacctgtggcaataatgcagctttgctctttggtgtctttgcaacgctacactaaggcactatccactttccaaagagcttccctggttgaaaaatcgaggcagaagcctcaagaaaggatgaatgttttgtctaatgtaggtctttttttgaagcttttgaattgcgttgtttcacttatgccaaaatttaagtgacacaagtgttgaaaatttatttgcaggttttacgtaccagtaattatggtgctgaaccaatgctgaaatcttgtggtgttaatataaactctaatttcacccaagtggatggacgtattctgccagcaccaagggtaggtgaataatgtccgtgtattgttccttgatagaacaatcatttgtgttagttgtttagactttctttttatattagatcttcctgctaattgagttctcttgattacagttaagagtcggcaacggtgaagatttctttccaaggaatgggcgttggaattttaacaacaaggtcattgctctttttgatttttcagccttctatcctgtatttgttttatccatttatttctttaagagtttatgtatgctttcatagaaattggtggagccatctaggattgaaagatgggctgttgtgaacttctcggctcctcgttgtgatccaaacaacattgcaagggatttgattcgttgtggagaaatgaaaggaattgtaagtcagcatccacttttttatttctgttatggtttgcttgttggcataggaatagctataaaattcaacttgttggctaaagttctttctgttctctctttttcagcgtattgatcccccatttgatatattcaatgagatgaaccagaatagacgcctttcacccgtggttagagttgaaaaaatgtttgaacagatacaatctaaacttcctggagctccgcagttccttctttgtctgcttcctgataggaaaaactctgatctttatggttggcggaatctctcttttcatacattttgtctgcatgtttatcttgaagtgtattacttgcatataaagttcattaaaattttcaagggccatggaagcggaagaatctttctgagtatggcatcgtgactcagtgtatggcaccagctagggtgaatgatcaataccttacaaatcttcttctgaagatcaatgctaaggtttgtttactgttcctatcaaatgggttcttattgctttaagctatttttattgttgcagttctaacttctgtaattatatcagtagctgtatcttcctcttactatgtaaatctggtaatgtcttatctttttattttctcacagcttggaggtcttaattcaatgctaactattgagcaaacaccttcaatccctatgatttcaaaggttccaactatcatccttggaatggatgtatctcatggctctcctgggcagtctgatgtgccgtcaatagctgcggtagagatcttgtttcttattattgaatttcttttgcttccgtctattgaattaataatggaagtcatagaggcttaattgtgcagtctttctgatattcaaattctgcgagttcttttaattgcatttaattgtaggtggttagctccaggcaatggccattgatttcccgctatagggcatcagtccgtacacagtctccgaagcttgaaatggtagattctcttttcaaaccagtttctgacaaagtggatgagggtatcatgaggtgcgtttgaatcatatagttctttggcttctgaagggataaatatttttcaagaaaaacttgaacgactagtttttatttttttgcaaaatatttatgtttttgtatccttttctaatctttaatccttctcttgtttccagttggagtttggtatggattgggttgtaataagaatattgtatatgtttgcatagctaacatgcttttcttttatttcagggaagctctcttagacttctatacaagttcagggaagaggaagcctgatcagatcattattttcaggttttactttttaagattttttgtctcgcacttcaaaaatgacaatatatatgctgaagaatgctttattaggaatatcaagcgtatagattttgctgtttttccggattttctattgcttatctatcttgatttttgtgcactgccatgtctcttgtttgttatttcttgtgagctagtttgtggttaaattgcagtttctgttgagtttcactgatatgcttgtgctgaagtttattacttgctcattacttggtttaaattagggatggggttagcgagtctcagttcaatcaagttttgaacaaagaacttgatcaagttattgaggtatgcagtagttcctttcaatcatttgaactgaaaatttcattgttcttaaatttattcacagcgaagttattttggtagttctaaaatgttacctcaagatctttatcatttggataatacatttctactgtaataggcttgcaagttccttgacgagaattggaaccctaagtttgtggttattgttgcacaaaaaaaccatcataccaagtttttccagcagggatctcctgacaatgtgctacctggttaggcttacccattctttaataaatgtcaggcaggaccactgttgtagtggttaaagcttgtattttttttattgtgcaggtactgtcattgacaacaaagtatgccatccgaagaacaatgatttttacctttgtgctcatgctggaatgatagtaagttcacttatttttgtttctgttaattgatgattgataatacagctgtctcaattttgcagtcattgataacacattatatgatttgtgtttgccgttcaggggaccacaaggccgacccactatcatgttctcttagaccaggttgggttttcagctgatgatctgcaggagcttgttcattctctatcctacgtgtaagtacagaaacaagcgtacagaaacaacttatttttttacaaatagtttaagctgttttcactgtcacaatctttgtattctgtctgttgcaggtatcaaaggagcaccacagccatatctgttggtaagtataagtattgtttctgatctttgctttgggttttccgtttttgatgcataattttgtagtttcatttcttaagtgcattgtttctgatctttgctttgggttttccttttttgatgcagtggcccctatttgctacgctcatttggcagcttcacagttggggcaatttatgaagtttgaggatgcttcagagacatcatcgagccatggtggggtgactgctccgggagcaatttctgttcctcagcttcccaggttgaaggataatgtcagcagctccatgttcttctgctgaaaaccgttgaaccatctttttgtatagggcttttggattttggctaccaaaaactatttatgctgctttttcaaagtagtctcagacttttgggttgcaacactcttaggtgtttcgtatgttatctgaacttatgaacggttgtctagctaaagctcacttctgcagtggcttttgtggcttttacctgtttggttttatactttgataaatatggttatggtttgctcttttgattataagttttctttttctagtttttttcattagttgagttgaagataaaacgagctctgatttcaaagtaccgtacattttaaattaaaacaggatataaaagaagagaaaagcaatg

SEQ ID NO: 477 - DNA, 9115 bp, Gossypium raimondii
gaaatggatgattgattcaaactccaccctacttcggtggataaatttaataagaagggaaacaaaattcaccgaatcctatggacgtgataaattctaaaatctagttaaatacgcattcaaagctatattttcttttcggtaccacattcaaagcgtctaattcaggatttcccaaaattacctaccaaataaagaaaatcctaatctcacccacgtgttattgaaatatcgtcacagctataatcactgccgcgttccggattcatgataaatctgtgattctcaaatttcaatgcgcgctgtcaagtaaatatacagtgaaaaaataccggatctccatacccgaggtagtgacaaatccgttggtaccccaaagtggagaggtgttcctatgcggatctcactcaccaactggtcacatcagagacgtccatcattgatcttcgaatgtagtgaaaaatatattattttaagattcttttcatttaacacgttattttcatataatatttacattaattaaataggagttaattgtgtcatacatccccaaattatgaaactcattttaaataggtccctaatttcataacattctaattacatctctgaattattggtattatatcaattaggtccttctattaatgaaatagttaatttaatcattaaaagatatataaaatcttacatgacgcaattaaaaacaaaaatattaaaagaaagtaaagtgttggcacataatttttaaaattaaaaactaaaaataaagtaaaatcgaaaaataaagagagtaaagaaagtttctctaaaagctttaaaaacctcaaaaccaaaatttttacaatattttacctttttaagtttttcatttaatttacatcatataagatctaatgtctcattcaacaattaaattaacaatattagtaacagaccttattgatatgacatcaataatttaggaatttaattataatattttataatttgaggaccaatttaaaatagaaatcataatttaagaatatttgatgcaatttttaaaaattaaatttatctaattagttaacttgttcgtaagaataacttgttatatctcctagacaaaaatataataaaaaaactcacaaggatattgttaattatatatatatatgttttttaattaatgtgtttttttttgctagaataattttaaatttcattttgtgttttttaagggtgcaagatgttatacaatttcacaattaattaatttttttgtaaattcaatatttgaaattaaataaatatattttatcaaattaaatataaaatcttagttaaacaaatgttttttttataaaaaacaaatctttagttaaacgaagatttaaaatatttaacacataaattactataattttgtaattaaaattatgtaaaaaaaaaaacttatgaaagaaaactatttaaaaatgagatggacggtagagatatgtaaaatgtagagtaaaaggtgtaaggcgcgatgtagaggagaaaaacattgtacttaacggagagaccaaaaagagtggcccttaaagtttttatattatttcactgtctttaatttttagtttttcgagtgagaggtaagtaaaaagagggagacacagacgggagccttgaacttcacatttctctttcatgttttagggtttctatccttgttttctctgtaaatttcaggtaaattcctctcaaaacctcttcagtttcagttttctgggcttgtatttttctgatttggtggttttctctgggtttttgaggtaatttaaaaaaattctggatttctttttcaacctttttccgtgcaatgcctgcttcacttggtgtgtttttcttccagtggtttttttccttctttttaactactatctgagtacactaattccctgttttttgcttctagttttaagtcaacgttcaagttcatacgtttttagcttttttccccctctgacgtaactattttttggtcttttttagctactttagtaagctttttcagaatcctgttatttttttttatctaggttttttttttgttataaaaaattttcttctcatttttttgagcgagactattaaaaacctgtaacattttggcttcatttgccacttaatgttaactttggtgtgcctgtatgtgcgtcttaagctcatattcttagatgtgctttattttgcactctgaagggtaatctttttccttttttttaccatttatgctcatttccgggatttttcttgttggtgttccagctgtcttcaagaatacgcttattttgctgcagatcgtctaatttctaggtaatatttgtattcattgtaaatatggctttccgatgcttgcatgttggatttcttagcacattgtaagagaaaaacttcatttttgaactgcatgatcatagtgttttgttgtcatgactttgcttctgtttttgggtgtttgaatgtctgactgttcgcctgttccactctacaaatatagtaagatcttttagccattattcagttcactgaattccctgaatgcatgtttacgtttctcttaaagttattggcttgttatatgtcaagtgtaattgcttctcttttttttttttttcccctttttttctctcttttgttaataataatgaccaatgtgtcaactcaaaaatactatactgttttctgcctgaaatgattatatgatactattccttatcttccttcaaagcggttttcgttcaaagcggtcttccttcaaaatgattatatgaccaatcttggtacttcctagtattttctcttcttcgttgcattacatattgttttctttgttttaggacatggactcgtttgagcaggatggaaatggggcggcacctgactctctgcctccacccccacctgtgcctcctgatgtggtgcctatcaaagcagaacctgaacctgcaaagaagaaggttgtgcgagtcccaatggccaggcgtggtcttggatctaaagggcagaagataactcttctcaccaatcacttcaaagtgaatgttggaagctctgatggacacttcttccattactgtgtatgctatttgattccttcactctatgcttttccattaatagtcctcaggtttttgttaatggtagttattgatgcaagcttcttcttttgtatttggttcaacaggtttctctttattatgaagatggccgtccagttgatggcaagggtgttggaagaaaagtgatagagagggtgcaagagacctatggcaatgaattggctggaaaggactttgcttatgatggggagaaaagtttatttactgttggtgctcttccaaataacaagcatgagtttacagttgtacttgaggatgttacatctaacaggtagacatgctcgtaagactggtttttagtataaattctcccatttattgataattaagttctaaatgtggattgtggaccttctcatttatagaaacaacgggaatgcaagccctgatgtccacgatgactcaaatgggcaagacaggaagagaattaaacggccttatcagtcaaagacctttaaagtggagatcagctttgctgcaaagattcccatgcaagcgattcaaaatgctctgcgtggacaggaatcagaaaactcacaagaggccctaagggtgttggatatcattttacggcagcatgctgcaaaacagtgagttaaaaatatcagcctgtatgtcattttttttccacttaaggttttggtcctggatgttaaatttattctgacattaacttgaattttataggggatgtctactcgttcgccaatcattctttcaaaataatcctgataattttacagacattggaggtggtgtcctgggctgcaggggtttccattctagcttcagagcctctcaagggggcctttccctgaatattggttggaacttggaatcttacctctgactcttatgcatttattactttgtgtttttcttttaattactcaatttatttctattttagatgtctcaactaccatgataattcgtcctggtcctgttgtggactttttgcttgccaatcagaatgctagagatccgtactccctggactggaccaaggtaaccaataaccttctctgtctccaagtgaatttgagttaccttgcatcaattattgaacctttattgcttggttccccctgtataggctaaacgaagccttaagaacctgaggataaaggtcagtccatccaatcaggagtacaagatcactggattgagcgagcagttgtgcaaagatcagttgtatggtttcctgatttcagaccattgctttttcttcaatctgttttaaatcagctagtatttgtttttgtctgatggagtcttgtcttatgcttcagttttaagtaattactttttttatttgttgcatgtttgtgtcctttatgtaggttttcattgaagcagaaaagcatgaagaatgataatggtgaagctgagaatctagagattactgtttatgattattttgtcaaccatcgcaacatacagttgcgctattctgcagacctgccatgcattaatgtcggaaagccaaaacggccgacatatattcctttggaggtgaattcatggactgtgattttgtttgtttatggaatctatgttttgtaactaatacttgtctatggtttgttgggcacctgttgcaatagctctgttccctggtgtctttgcaacgttacaccaaagcgctaaccactttccagagagcttctttggttgaaaaatcaagacagaagcctcaggaaagaatgacagtcttatccagtgtaggtcttttctctaagcttttgactcacttcatatttattgtgctgtaaaatacatgtcaatgagtgttgttgcaaattttgtgcaggctttacagaggagcaactatggtgctgagccaatgctgcgttcttgtggtatttctatcagcactaatttcacccaagtcgaaggtcgtgttctgccagcgccaagggtagagtcatatttggctggattaattctttttttcatccattgatatgtcatgcatttatgttgggtgtttagagttatcctaatgattttggttggatctacattctaatttttctttttgacagttaaaagtggggaatggtgaagatttctttcctcggaacgggagatggaattttaataacaaggtttttgctcccttttgtattgaaactttctattttatatatgtttatctattgtttctcaacagtgtatgcttttgtagaaattagtggagccaactaagattgaaagatgggctgttgtcaacttctctgcacgatgtgatacgaatagccttgtccgggatctgattagatgtggagacatgaaaggaattgtaagtttgaccaagtttttttttttaaattttgttgtgacggttgtcacttggcatatacaaggttataaattgaacttgtgggctaaagttgttttccttgtctctattttagcggatagaccctccatttgatgtgttccaagagtccaatcagaacagacgttgctctcctttggttagagtcgagaaaatgtttgaggatatccaatctaaacttcctggagctccacagtttcttctttgtcttttacctgataggaaaaattctgatctttatggtattcaaaatctcacctgtttgtgcgttaactgtgcttttctttctcttgaagtcttccttgcatctaaaatttgactttttgaaggtccatggaagaagaagaatctttctgagtttggcatagtcactcagtgcatggctccaactagggtcaatgatcagtaccttacaaacctgcttctaaaaatcaatgcaaaggtatgctctcatcaaatttattcttctttattttttgaacttgggaagattaaacactaacctgctaattacctctacgcagcttggaggactgaattccatgctagcaattgagcaaacaccttcaattccagttgtttcaaaggttccaaccatcatccttggaatggatgtgtctcatggctctcctgggcagtccgatattccatcaattgctgcggtagggatgatattgttcaatatctttgtgtttcttgggtttccatcaactgctagctacttgtaatggcagttatggatatgtgattctgcattctgtactctacataactatttcctctcgaggtagcttcttgacctgtacttattttagagttccttttgttgaatttctaggtggtcagctccaggcagtggcctttgatttcccgctatagagcatctgttcgtacacaatctcctaagcttgaaatgatagattctctattcaaaaaagtgtctgacaaggaggatgaaggtatcatgaggtgcgccagcaatgaagttcctttcttttcagatttaatttttacatcttttttctttctttttaatttatttctttttagttaaaaaattatgtgttgctcttgttgaacattcatgtctagcatcttaacttttgggtctagtagtgtttatggttgtgttcctaattaatatttttttaatcacagggaggttctcttggacttttatacaagttcaggaaagaggaagcctgatcaaattatcatattcaggttttgctgtttctcatattcaatctctataaaatataacatattccaactcaaatggagtagtacgttttcaagtaacttgcgaagacaaaattttggtgttcctgtttcttaattcgcattgcttctctgcttgcaaactatttgtatggacttcttagcaattatatatttacctatctaatcatcttttatttgctaaacatgtaacagttatttggggaatattgtatattcaagcatcttttatctgcatggtgtttttgtgctgcttacagattatacaagttgaatgtcctttttgagcttctaatcatcctagaatgtttcttgcttcctgcaatttggaatgcttagatctctatcattctttagcctcgtctacattcctaatttatttctcttgctatatagctttgattgttgtgatattccgtctatcatttgcacatctgtgttgtctaattatgttatgggagtataatacctgccatgtaaaagcatttttgcattttagaattttgttttttttctcataaatgtttgtgtttatgctgcttggttaatctatcatatctgctatgtaaaagtgctttttcatttcagaattgtgtattttatcataaaagcttatggtgcttggttaatctatatatcaaacatatcctgtttttaagggttcttcgctgcaagtttttgttttatcttatgattaatcatgtctctcatgcgttttgttattagctggtttgtgattattgtgctgatgtttctgttacattttattgagatgctgatggaatattgcttccttgctcattattcttggttcaactcagggatggagttagcgagtcacagttcaatcaagtattgaacattgaactggatcaagtaattgaggtatgcagtaagattacattgctggtgataaatcattgtcttaaagatgacagtgattgggataaatcatcagttgttaacgtttctactttataggcttgcaaatttcttgatgagagttggaaccccaagtttgtggtcattgtggcacagaaaaaccatcatactaagtttttccagcagggatctcctgacaatgtcccgcctggtgagtctcagtcatgatttggtgcatgtcatttggtaccttggttatagttttcacaatttatcctgttttcctttatgcaggaaccgttatagacaacaaaatctgtcatcctaagaacaatgacttctatctttgtgcccatgctggaatgattgtaagttcttcgagaatttagttttcttgattactgattctgtagttatgcttttttgtccctttatacgaagttgagtctccttttaaaattgaatcaaggctctgatttctattcttttgacttttttcaataagcttgcagttgaataatcagagaaattgctattctgaaccttgatggcctcctgttccttgtaatgttcatttctttatataatttgtgtttgcttttcagggaaccacgaggcctactcattatcatgttctcttagatcagattgggttttcggctgatgatctgcaggaactagtccactctctgtcgtatgtgtaagtgttcaatcatgtatagtaattgctccgctaatgttttgatctctaaccaatgctggattccttataaactgtctattgcaggtatcaaaggagcaccactgccatatctgtaggtgagaattctgatttagctttgacctctgtttgtgaaagcttccagccagttgtttgatttcgtaattcaattttttctgaagcgattgtttgtgatgttttacggattgctaatatgacaacatgacgtgtgttgtagttgctcctatttgctatgcacatttggcagccgcacaggtgggtacattcatgaagtttgaagatgcctcagagacaaactcgagtcatggtggagttaccgcacctggagccatttctgtccctcagctgccgaggttgaaggagaacgtctgcaattccatgttcttctgctgatcccccatgttttgtataggcttttggttgttaccaaaatgactgaaacgtttttaagttatatgaaagttaaaaaaagtagggttatcattgatgtggtggtggttgaaacatcaccccttttgggtgtttggccctgctgtttgtaggatctatgaaggtatgtttgactagcacttgttaaatggctttcgcctctgtaatacccgtaatcctgtttggtgataatcaatgcatagcctcagctatcgttaacttaaaacctgctttgtatgctgtggaacgtgggatatccatcatataagatgggatttgccctgagttgtatgaaaacagttataaatcaatgaaagcagagcc

SEQ ID NO: 478 - DNA, 8393 bp, Gossypium raimondii; identical to SEQ ID NO: 474

SEQ ID NO: 479 - DNA, 8340 bp, Gossypium raimondii; identical to SEQ ID NO: 475

SEQ ID NO: 480 - DNA, 7993 bp, Gossypium raimondii; identical to SEQ ID NO: 476

SEQ ID NO: 481 - DNA, 9115 bp, Gossypium raimondii; identical to SEQ ID NO: 477

SEQ ID NO: 482 - DNA, 9063 bp, Gossypium raimondii
aatctcatggaattcgagtttttttgggtcctactctaataatactttggtatgtttattttcagaaagtaacttacaattttgttttgcattttcctatatttgttttatagaaataatttgatcaatcaaaaaaattaagcctattttttttttagaaaatcactttgtgttttgaaaagtattaagtcatttctaaaaaatagtttcttagtaacttgatttttaataaaaaaaaaacttacatgcagtcaagtattattatattaataatattattttaaatttaaaaatattaaaatattaatatcaaatattataattttcaatattattaaacatacatatttaattatttatactcaaccatataataaattattaatataaataatataaattattattttaataaagttatttaatattacaattttttaataataaaatttaacattaataacaattttaaatttgaagtaatattcttaatattttattgaaaatttttatattaatattttactaataaatatttattgcgatttataagtaattttaaataaatttataaatagttagtaatagatgttttataatataaaatataaatatttgttattaatattgcaatttataaatattttactaagcaggatttaaatatatttttaataatttatatttatttttaagctttcttttaattttttagaagtattgtaaaaattttaaaaaattaaaatgatattttagttatagttcagtgaccaaattaataattaatgatttaaattaacgtgccacatgatcatttaatatataaaatttaacagagagactaatttgtatgttttaaaatgtataaaggttaatttgcctattttttttaatagagagccaaaatgcaacctgctcctaagataggactttccctaatacttttattgaattccaagataacataatcactatatgtttttgtcatgagtcgacggactaaaacccatgacaaatacacacaaattatcccgtaaaggtcaactaatcacatgaggctaatttaatccacttaagctgacctgcttcgtgaaacatatagagaagccttggtattcaatgaaacaatctactaaaactagagatacaagataattatagtagattttaaaggataaagatccataaagtttaaatccaattactttgtagtgtccaaacacattccaaatgcagcagaaaccaagggatctgagccgttgatatttgttcatcgttgaacctttctaaccaatcaaaatcaacgatctgatctttttagctataagggttccacagagattgttctacaaccggaatagccgcccttcgtttactccacggaaaagatctaagcagtcaaatcaagttttgttaaatatcaacggtggagatattccaaatatttaaacctaaagtgttttaacatcatatgctaaaagaacccatctttttattgccgctcctataagaattaagaagcaggaaaattactattttaatatttttcccttacaccctccattgtcgctctcttttacttttagtgccaaagacccgactcttcagtaatcctgccttcttcttctgtttttactttgcgggtatgattttccctgctcttttcttttggttcatccttgaatgttgatcatcgtcctaagtcttctctttttcttgcttgctgccatattttgtggtttatgttttcttcttttgaactttcttttcttttctgccgaattttgaactgcattgttgtctaatactctgatattttgtttttgtatgtgttttattttccattacaattgctatttttctttaagttctacctatgttcttctctgtaagcttttgtgtttgtatgttttgtttcttttctcggctaatctcagacatttgttcttattaaaatttcacgttgtttgttaatctgagacattgtagtcgaggaaaagaaaatttttgaaacttgtcttgtgctggactctactatcagtctctcactgtgtttttttttttttttgcttttgctgcttatttcgaggagtcaacgagaaactgttttgatttttttttttgtattttgaattctatttgatggtcaaactttaactcctttcggaagcaatttcttttgacaatgccgtttgattttcgctatgttaaataatcgtcaaagcgattttgactttttattctaaattatatatttccgtttcttaagattttgattattttgttaatccgtgctaaacaaccctaatcaggaaaaatatttcattgagagaagctttttatttgttgtaattgcataaaataagcagtatttctctgctcttggtttcctttttttttttttcaccccttagtacatgtcctccattgttagagtccagagcaactgatttcgagtactggcttttttttcctattcggaaaaatattatcgcgttttatttttaaagtcgagcctatgttgcttagatttttcttgaagtacccgtttctggtcatgggtatgggatacggccttctaactattctccaaataaatgaaaaacttagaagaaatcaagcatgccatgttgtactcatacccatatttgacactcacaaataagtagtatagagtggagctatttaatatcaaaaagaaaagtgtataattttctgctacaactttagcatttgaatttttgctctctaaggatagttatgtaagttgcctgtttggaattttatctcctcatcctttcaagtttattttgctttgtattaacaatataggattctttttcaaaataaattccaaaatttaataatagccttctccttggaaaattttatgtaagattttatgttggtcatcacctgtgtctaatcttatatgctggttctgataacttgtaatcttggacaactagtaactcatatactgtgtttttcatttattttattctattttattgcagttttttgtctttaattttcctatttgtttttcactgaaggagaaattttttgttgtggatttcttctttgacaattgtacattttagttgtttacatgttcactgtacttgcaattagtggtgatacttaatgctatcaatctagtactaatgtccttactgattgatttcaagatggagaaagcaagtactgaagaggcactagaattaccatctctgcccctaccactgccaacaataccatccaatgtgaagctagagagcttgaagcctcccaagtattctattgtcagtaggagagaagttgggacgagtggacgaaagatatccctgcttgccaaccacttcaaagtttctgtcaatgccccagatgctgtattttaccagtatactgtaggttattttgtctccattctgtttctttctggaagttcactttaaggatgaatatttaccaaaatatgatttgcaggttacagttttgtcagaagatagtagagttgttgaaagcaagaggattgggagaaaacttgttgataaactttatcaaacatactcttcggaacttgctggaaaaagatttgcctatgatggggaaaagagtttgtatacagtgggtcctttgccacagaacaagtttgaatttacaatagtgctagaagactcatttgcaaaatggtatattcttctactccttactggatttagattttgtatatgttagaatctagatgttataacttttttgtcacaatagctcactgtctggttgtgaaaccaggagtcctgatgctgatggaggccctgctgagactggcaagaggacaaagcgttcttttcagtcaaagacttacaaagtggaactaagctattctgctaagatacccttgaagtcaatatctcttgccctcaaaggagttcagtcagatgatagcactcaggatgctttgagagtacttgacatcattctaaggcagcaagctgctgatcggtatttaattttcttattcttttttggttcaagacttaaccattttcacagaaccatatgtgtacccctggatatctgtatgtattgcttgtcccgtcttattttagtgacggtgttggttttcagaggttgccttttggtgagacaatcattctttcaagatgattcaaggaattatgttgatttgggaggaggggtattgggtctgcggggcttccattccagttttcgtcccactcaggggggcttgtctttgaatatgggtatatttttattcattctatcataactttgatcctaaaacttttttattcttttcatcatgttttctctttaaacctttgttgcagatgtatctacaacaatgattttaaggcctggaccagtatttgagtttctaaaacaaaacctgaatctaaatgatgaacgtttctggctgaaagtaaggaactcaaaaaccaaaaatcttaattactttatgtcctgaaaactaaacttataaattctacaggccagacgaatgttgaagaatatgaggattaaaacaagacaccgtaacatggaattcaaaatcactggtctaagtgagaagccctgttgtgagctattgtatgtgctcatttgctggggatttttcctttcataacttctatttgagttctttctccagaaagaattttaattctggttgtatttgtctttaatttcttctagcttcccaatgaaagttaaaaatggtggttgtggtgaagtccggactgttgagatcacagtgtatgagtatttcaccaaacactgtggaattgaactcacatattctgcagacatgccatgccttgatgttggtaaaccaaaacgtcctaactatttacccctagaggtcagtcaatttttttattcttcataagcatagtgttcattacacaatacactgttatcagacatgtctatcctaacatttaattttatggtgttctagctctgttcacttgtttcacttcagcggtacacaaaagcgttaactacaaatcaaagggcgaccctggttgaaagatccaggcaaaagcctcgggaaagaattcaaattctgactgatgtatgtttctttgtccttatggctataaccatatttgttattttgtcttcactactagaattttttgcttctttaacctggcaggctttgaaaaacaacaaattcaatgagaaccctgtactttctgcatgtgaaatttcaataggtaggcaattgacagaagttgagggtcggatcctggagactccaagggtatgtgttgttgcctctttgtcaagagaaagagagagctagagagttttacctcaatttaactgtttagtgggttcatcgtaacacatctctattgtcattaacagttgaaggttgggaatcacgaggattgcatccctcgaaatggtagatggaactataacaacaaggtagtggtgatagagggtttttgttcatcccaatcttttatgttatagtatactgtgttggtcccaatcttaattgattgcaactctttgcttcagagtttgtctcttatctagtttccatctcatagcatttgatacaacagtttattttcacatatatatattccttccatccctttgcagagatttctggatccaaagaaaattgaacgttggattgctgtcaacttctctgctcgctgtgatctcagtcaaatttcaagggatttaatcagttgtgcaagaaacaagggcattgtaggttattccacattttggctgtcgtcatggtgctatatgacttgttggtataactgtcttcttatacaaatgtattcatacatgaaggaaatggaacgtccgcacacattgattgaggaggaacggcatcaagctgctaaagctggccctgctgctagagtggaagcaatgtttgatcagattatagcaaagcttcctggcccccctgagttcattctttgtgtcttgccagtgagaaaaaactctgatatatatggtatggcttttcctgttgatttcttttcttatttggctagtcaactgacattttccatgctctgtcaaggaccttggaagaaaaaatgtctttgcgatatgggaattgccacacaatgcattagccctggaaaaattaatgaccaatacctcacaaatgtcctccttaaaatcaattcaaaggtaaaatcttaaagcaatgcattttccctgaaaaaaaaagaattgttttaacttttatgttgatctacacctcagatgtactatgatattaccttgtctttcttctgtatagcttggaggaatcaactctttattggaaatagagaaaccttcaatcctcccattgctgaaggatactcctacattgattttgggaatggatgtctctcatgggtcccctggtcgatcagatgtcccatcaatagctgcagtaatttctgaatatttgaacgcattataattattcccctaattttgtgaggatacatccaactgtttaaacctactgtatatatcaggttgttggttcgctccattggcctttgatttcaaggtacagagcatctgtgagaacacaatctccaaagatggagatgattgaagctttatataagccatcaccagacggaaaggttgatgatggtattatcaggtagtttagtaaaactatatccagaactccatgtgtgctgattgctctgttttacctttaagggctttgaaattgattatttaagtataatttcatggtatattataatattataattttatttttcacatgatttcaaagaattctgttcttgttctgtcacaaacaagatccagaagaatatttcagtcagtgaaatcaacattttttgccccatatctgaagttatttcctatgtacttttatttaattttgaatgccagaatgggtagtcttacaatgcattaaaatgcatttttcatttgttatgttgtttgatgtgccactgacgtgcataacttctattatgatacgttgagttgatacaaacaagattgcttgtaaccttggctcttttggtgctgtaaaattaaaatgctggatatgatttgagatttattcatatgaaaatttgagtatgttttttgtgttgcaagggaactgcttgttgatttctataaaacgagcggtaatcgcaaaccaaaacaaattatcatcttcaggtatgtacacttgtgtttgtggatttctgcatattttattacattatggctctaataggagttaaatatttcccctcactggttttctgagcttgttcagtggtcagcaatttgctttttaagatgtgaaagaaaaaatggaagtaattatttctgttttcttgtatgaaccaatcatacactctttacaatggttggttgaacaatttaattcatcacttaaataattagttttgatgattttcttagggatggagtaagtgaatcacagtttaaccaagtattaaacattgagctggagcaaatcatcaaggtacattctggactatggtttatctttttcatcacaatataaccatcatctccctgagtaagggctatgggtcagcatattaattgatgtttctagaaggctgttagaagtgcctttctactgctttcttgtccataacatttttatgttacaagatcctgcgaagggttagttgagggcctcatattttcttgataatagtcaattcttagatagttaaacatcctttgcgcagtcatatcagtttctgggcgagtctgatgttcccaagttcacagtagtcgttgctcagaagaatcatcatacaaaattattccaagctaatgcccctgaaaatgttccaccaggtttgcttctgatatttcattttcctctctagtttattaatttgttggttcactctctcgctttcctctgcagggacagtagtggacacaaaaattgtgcatccgagaaactatgatttctacatgtctgctcatgcagggatgatcgtaagtgttttactgttactatcaaaattttttgttcaatcttgagacattatgaagcagcagtgttgttttttgcttctgaataatatatgcatacatgtgaataagatcctccgttgcattgtttcaaatctaacagggaacatctaggccagctcattatcatgtcttgcttgatgagataggtttctctcctaatgacctgcagaatcttatccactgtctttcctatgtgtaagttgtgaataagctccatctgccatctctaacatcgtaggaagtagcaggcatttttaatcaattacattttgccaaatgcagataccaaaggagcacagcagcagtctcaataggtaattttccccttatcctacaccctgttcatgtttagcaagtcatttgtatcagtcgcattaatatttcataaacctgggttgtatttcatatccagtggctcctatttgttatgctcaccttgcggcatatcagatgggccaatttttgaagctggatgaactttcagaaacatcttcaggaaacgtaacatccacaggaagtatccttgtgccagaccttccgaggctgaaaaagaatgtggcaagtacaatgttcttctgttgaggggatcacccatttcagtaaatacatgctaggctaactgtagatagtttgggtaggctaggggtatacaaagcatacaactccaggcttttgcttttgtgattgattattgaggctggctggctttaacaagcaaaagtttttgtttaaaccatgactaggttatgttgaggggttaggagccattataagaaaagcttaggtgtatcttatatttgtttcatattttactttagtcaaaatcctgctattgctcagaagcttcattcagatagaaaaagctttttttccgtttcttctacttttctttgagcttttagaatccatatttaaagtgtgaatacaagaaaatgtttgatttgagctgggggtgttaggagtaagtattcagaagtgaaaaaattgagttgagtctta

SEQ ID NO: 483 - DNA, 7385 bp, Gossypium raimondii
tcatccttgaatgttgatcatcgtcctaagtcttctctttttcttgcttgctgccatattttgtggtttatgttttcttcttttgaactttcttttcttttctgccgaattttgaactgcattgttgtctaatactctgatattttgtttttgtatgtgttttattttccattacaattgctatttttctttaagttctacctatgttcttctctgtaagcttttgtgtttgtatgttttgtttcttttctcggctaatctcagacatttgttcttattaaaatttcacgttgtttgttaatctgagacattgtagtcgaggaaaagaaaatttttgaaacttgtcttgtgctggactctactatcagtctctcactgtgtttttttttttttttgcttttgctgcttatttcgaggagtcaacgagaaactgttttgatttttttttttgtattttgaattctatttgatggtcaaactttaactcctttcggaagcaatttcttttgacaatgccgtttgattttcgctatgttaaataatcgtcaaagcgattttgactttttattctaaattatatatttccgtttcttaagattttgattattttgttaatccgtgctaaacaaccctaatcaggaaaaatatttcattgagagaagctttttatttgttgtaattgcataaaataagcagtatttctctgctcttggtttcctttttttttttttcaccccttagtacatgtcctccattgttagagtccagagcaactgatttcgagtactggcttttttttcctattcggaaaaatattatcgcgttttatttttaaagtcgagcctatgttgcttagatttttcttgaagtacccgtttctggtcatgggtatgggatacggccttctaactattctccaaataaatgaaaaacttagaagaaatcaagcatgccatgttgtactcatacccatatttgacactcacaaataagtagtatagagtggagctatttaatatcaaaaagaaaagtgtataattttctgctacaactttagcatttgaatttttgctctctaaggatagttatgtaagttgcctgtttggaattttatctcctcatcctttcaagtttattttgctttgtattaacaatataggattctttttcaaaataaattccaaaatttaataatagccttctccttggaaaattttatgtaagattttatgttggtcatcacctgtgtctaatcttatatgctggttctgataacttgtaatcttggacaactagtaactcatatactgtgtttttcatttattttattctattttattgcagttttttgtctttaattttcctatttgtttttcactgaaggagaaattttttgttgtggatttcttctttgacaattgtacattttagttgtttacatgttcactgtacttgcaattagtggtgatacttaatgctatcaatctagtactaatgtccttactgattgatttcaagatggagaaagcaagtactgaagaggcactagaattaccatctctgcccctaccactgccaacaataccatccaatgtgaagctagagagcttgaagcctcccaagtattctattgtcagtaggagagaagttgggacgagtggacgaaagatatccctgcttgccaaccacttcaaagtttctgtcaatgccccagatgctgtattttaccagtatactgtaggttattttgtctccattctgtttctttctggaagttcactttaaggatgaatatttaccaaaatatgatttgcaggttacagttttgtcagaagatagtagagttgttgaaagcaagaggattgggagaaaacttgttgataaactttatcaaacatactcttcggaacttgctggaaaaagatttgcctatgatggggaaaagagtttgtatacagtgggtcctttgccacagaacaagtttgaatttacaatagtgctagaagactcatttgcaaaatggtatattcttctactccttactggatttagattttgtatatgttagaatctagatgttataacttttttgtcacaatagctcactgtctggttgtgaaaccaggagtcctgatgctgatggaggccctgctgagactggcaagaggacaaagcgttcttttcagtcaaagacttacaaagtggaactaagctattctgctaagatacccttgaagtcaatatctcttgccctcaaaggagttcagtcagatgatagcactcaggatgctttgagagtacttgacatcattctaaggcagcaagctgctgatcggtatttaattttcttattcttttttggttcaagacttaaccattttcacagaaccatatgtgtacccctggatatctgtatgtattgcttgtcccgtcttattttagtgacggtgttggttttcagaggttgccttttggtgagacaatcattctttcaagatgattcaaggaattatgttgatttgggaggaggggtattgggtctgcggggcttccattccagttttcgtcccactcaggggggcttgtctttgaatatgggtatatttttattcattctatcataactttgatcctaaaacttttttattcttttcatcatgttttctctttaaacctttgttgcagatgtatctacaacaatgattttaaggcctggaccagtatttgagtttctaaaacaaaacctgaatctaaatgatgaacgtttctggctgaaagtaaggaactcaaaaaccaaaaatcttaattactttatgtcctgaaaactaaacttataaattctacaggccagacgaatgttgaagaatatgaggattaaaacaagacaccgtaacatggaattcaaaatcactggtctaagtgagaagccctgttgtgagctattgtatgtgctcatttgctggggatttttcctttcataacttctatttgagttctttctccagaaagaattttaattctggttgtatttgtctttaatttcttctagcttcccaatgaaagttaaaaatggtggttgtggtgaagtccggactgttgagatcacagtgtatgagtatttcaccaaacactgtggaattgaactcacatattctgcagacatgccatgccttgatgttggtaaaccaaaacgtcctaactatttacccctagaggtcagtcaatttttttattcttcataagcatagtgttcattacacaatacactgttatcagacatgtctatcctaacatttaattttatggtgttctagctctgttcacttgtttcacttcagcggtacacaaaagcgttaactacaaatcaaagggcgaccctggttgaaagatccaggcaaaagcctcgggaaagaattcaaattctgactgatgtatgtttctttgtccttatggctataaccatatttgttattttgtcttcactactagaattttttgcttctttaacctggcaggctttgaaaaacaacaaattcaatgagaaccctgtactttctgcatgtgaaatttcaataggtaggcaattgacagaagttgagggtcggatcctggagactccaagggtatgtgttgttgcctctttgtcaagagaaagagagagctagagagttttacctcaatttaactgtttagtgggttcatcgtaacacatctctattgtcattaacagttgaaggttgggaatcacgaggattgcatccctcgaaatggtagatggaactataacaacaaggtagtggtgatagagggtttttgttcatcccaatcttttatgttatagtatactgtgttggtcccaatcttaattgattgcaactctttgcttcagagtttgtctcttatctagtttccatctcatagcatttgatacaacagtttattttcacatatatatattccttccatccctttgcagagatttctggatccaaagaaaattgaacgttggattgctgtcaacttctctgctcgctgtgatctcagtcaaatttcaagggatttaatcagttgtgcaagaaacaagggcattgtaggttattccacattttggctgtcgtcatggtgctatatgacttgttggtataactgtcttcttatacaaatgtattcatacatgaaggaaatggaacgtccgcacacattgattgaggaggaacggcatcaagctgctaaagctggccctgctgctagagtggaagcaatgtttgatcagattatagcaaagcttcctggcccccctgagttcattctttgtgtcttgccagtgagaaaaaactctgatatatatggtatggcttttcctgttgatttcttttcttatttggctagtcaactgacattttccatgctctgtcaaggaccttggaagaaaaaatgtctttgcgatatgggaattgccacacaatgcattagccctggaaaaattaatgaccaatacctcacaaatgtcctccttaaaatcaattcaaaggtaaaatcttaaagcaatgcattttccctgaaaaaaaaagaattgttttaacttttatgttgatctacacctcagatgtactatgatattaccttgtctttcttctgtatagcttggaggaatcaactctttattggaaatagagaaaccttcaatcctcccattgctgaaggatactcctacattgattttgggaatggatgtctctcatgggtcccctggtcgatcagatgtcccatcaatagctgcagtaatttctgaatatttgaacgcattataattattcccctaattttgtgaggatacatccaactgtttaaacctactgtatatatcaggttgttggttcgctccattggcctttgatttcaaggtacagagcatctgtgagaacacaatctccaaagatggagatgattgaagctttatataagccatcaccagacggaaaggttgatgatggtattatcaggtagtttagtaaaactatatccagaactccatgtgtgctgattgctctgttttacctttaagggctttgaaattgattatttaagtataatttcatggtatattataatattataattttatttttcacatgatttcaaagaattctgttcttgttctgtcacaaacaagatccagaagaatatttcagtcagtgaaatcaacattttttgccccatatctgaagttatttcctatgtacttttatttaattttgaatgccagaatgggtagtcttacaatgcattaaaatgcatttttcatttgttatgttgtttgatgtgccactgacgtgcataacttctattatgatacgttgagttgatacaaacaagattgcttgtaaccttggctcttttggtgctgtaaaattaaaatgctggatatgatttgagatttattcatatgaaaatttgagtatgttttttgtgttgcaagggaactgcttgttgatttctataaaacgagcggtaatcgcaaaccaaaacaaattatcatcttcaggtatgtacacttgtgtttgtggatttctgcatattttattacattatggctctaataggagttaaatatttcccctcactggttttctgagcttgttcagtggtcagcaatttgctttttaagatgtgaaagaaaaaatggaagtaattatttctgttttcttgtatgaaccaatcatacactctttacaatggttggttgaacaatttaattcatcacttaaataattagttttgatgattttcttagggatggagtaagtgaatcacagtttaaccaagtattaaacattgagctggagcaaatcatcaaggtacattctggactatggtttatctttttcatcacaatataaccatcatctccctgagtaagggctatgggtcagcatattaattgatgtttctagaaggctgttagaagtgcctttctactgctttcttgtccataacatttttatgttacaagatcctgcgaagggttagttgagggcctcatattttcttgataatagtcaattcttagatagttaaacatcctttgcgcagtcatatcagtttctgggcgagtctgatgttcccaagttcacagtagtcgttgctcagaagaatcatcatacaaaattattccaagctaatgcccctgaaaatgttccaccaggtttgcttctgatatttcattttcctctctagtttattaatttgttggttcactctctcgctttcctctgcagggacagtagtggacacaaaaattgtgcatccgagaaactatgatttctacatgtctgctcatgcagggatgatcgtaagtgttttactgttactatcaaaattttttgttcaatcttgagacattatgaagcagcagtgttgttttttgcttctgaataatatatgcatacatgtgaataagatcctccgttgcattgtttcaaatctaacagggaacatctaggccagctcattatcatgtcttgcttgatgagataggtttctctcctaatgacctgcagaatcttatccactgtctttcctatgtgtaagttgtgaataagctccatctgccatctctaacatcgtaggaagtagcaggcatttttaatcaattacattttgccaaatgcagataccaaaggagcacagcagcagtctcaataggtaattttccccttatcctacaccctgttcatgtttagcaagtcatttgtatcagtcgcattaatatttcataaacctgggttgtatttcatatccagtggctcctatttgttatgctcaccttgcggcatatcagatgggccaatttttgaagctggatgaactttcagaaacatcttcaggaaacgtaacatccacaggaagtatccttgtgccagaccttccgaggctgaaaaagaatgtggcaagtacaatgttcttctgttgaggggatcacccatttcagtaaatacatgctaggctaactgtagatagtttgggtaggctaggggtatacaaagcatacaactccaggcttttgcttttgtgattgattattgaggctggctggctttaacaagcaaaagtttttgtttaaaccatgactaggttatgttgaggggttaggagccattataagaaaagcttaggtgtatcttatatttgtttcatattttactttagtcaaaatcctgctattgctcagaagcttcattcagatagaaaaagctttttttccgtttcttctacttttctttgagcttttagaatccatatttaaagtgtgaatacaagaaaatgtttgatttgagctgggggtgttaggagtaagtattcagaagtgaaaaaattgagttgag

SEQ ID NO: 484 - DNA, 8685 bp, Gossypium raimondii
atatttgttttatagaaataatttgatcaatcaaaaaaattaagcctattttttttttagaaaatcactttgtgttttgaaaagtattaagtcatttctaaaaaatagtttcttagtaacttgatttttaataaaaaaaaaacttacatgcagtcaagtattattatattaataatattattttaaatttaaaaatattaaaatattaatatcaaatattataattttcaatattattaaacatacatatttaattatttatactcaaccatataataaattattaatataaataatataaattattattttaataaagttatttaatattacaattttttaataataaaatttaacattaataacaattttaaatttgaagtaatattcttaatattttattgaaaatttttatattaatattttactaataaatatttattgcgatttataagtaattttaaataaatttataaatagttagtaatagatgttttataatataaaatataaatatttgttattaatattgcaatttataaatattttactaagcaggatttaaatatatttttaataatttatatttatttttaagctttcttttaattttttagaagtattgtaaaaattttaaaaaattaaaatgatattttagttatagttcagtgaccaaattaataattaatgatttaaattaacgtgccacatgatcatttaatatataaaatttaacagagagactaatttgtatgttttaaaatgtataaaggttaatttgcctattttttttaatagagagccaaaatgcaacctgctcctaagataggactttccctaatacttttattgaattccaagataacataatcactatatgtttttgtcatgagtcgacggactaaaacccatgacaaatacacacaaattatcccgtaaaggtcaactaatcacatgaggctaatttaatccacttaagctgacctgcttcgtgaaacatatagagaagccttggtattcaatgaaacaatctactaaaactagagatacaagataattatagtagattttaaaggataaagatccataaagtttaaatccaattactttgtagtgtccaaacacattccaaatgcagcagaaaccaagggatctgagccgttgatatttgttcatcgttgaacctttctaaccaatcaaaatcaacgatctgatctttttagctataagggttccacagagattgttctacaaccggaatagccgcccttcgtttactccacggaaaagatctaagcagtcaaatcaagttttgttaaatatcaacggtggagatattccaaatatttaaacctaaagtgttttaacatcatatgctaaaagaacccatctttttattgccgctcctataagaattaagaagcaggaaaattactattttaatatttttcccttacaccctccattgtcgctctcttttacttttagtgccaaagacccgactcttcagtaatcctgccttcttcttctgtttttactttgcgggtatgattttccctgctcttttcttttggttcatccttgaatgttgatcatcgtcctaagtcttctctttttcttgcttgctgccatattttgtggtttatgttttcttcttttgaactttcttttcttttctgccgaattttgaactgcattgttgtctaatactctgatattttgtttttgtatgtgttttattttccattacaattgctatttttctttaagttctacctatgttcttctctgtaagcttttgtgtttgtatgttttgtttcttttctcggctaatctcagacatttgttcttattaaaatttcacgttgtttgttaatctgagacattgtagtcgaggaaaagaaaatttttgaaacttgtcttgtgctggactctactatcagtctctcactgtgtttttttttttttttgcttttgctgcttatttcgaggagtcaacgagaaactgttttgatttttttttttgtattttgaattctatttgatggtcaaactttaactcctttcggaagcaatttcttttgacaatgccgtttgattttcgctatgttaaataatcgtcaaagcgattttgactttttattctaaattatatatttccgtttcttaagattttgattattttgttaatccgtgctaaacaaccctaatcaggaaaaatatttcattgagagaagctttttatttgttgtaattgcataaaataagcagtatttctctgctcttggtttcctttttttttttttcaccccttagtacatgtcctccattgttagagtccagagcaactgatttcgagtactggcttttttttcctattcggaaaaatattatcgcgttttatttttaaagtcgagcctatgttgcttagatttttcttgaagtacccgtttctggtcatgggtatgggatacggccttctaactattctccaaataaatgaaaaacttagaagaaatcaagcatgccatgttgtactcatacccatatttgacactcacaaataagtagtatagagtggagctatttaatatcaaaaagaaaagtgtataattttctgctacaactttagcatttgaatttttgctctctaaggatagttatgtaagttgcctgtttggaattttatctcctcatcctttcaagtttattttgctttgtattaacaatataggattctttttcaaaataaattccaaaatttaataatagccttctccttggaaaattttatgtaagattttatgttggtcatcacctgtgtctaatcttatatgctggttctgataacttgtaatcttggacaactagtaactcatatactgtgtttttcatttattttattctattttattgcagttttttgtctttaattttcctatttgtttttcactgaaggagaaattttttgttgtggatttcttctttgacaattgtacattttagttgtttacatgttcactgtacttgcaattagtggtgatacttaatgctatcaatctagtactaatgtccttactgattgatttcaagatggagaaagcaagtactgaagaggcactagaattaccatctctgcccctaccactgccaacaataccatccaatgtgaagctagagagcttgaagcctcccaagtattctattgtcagtaggagagaagttgggacgagtggacgaaagatatccctgcttgccaaccacttcaaagtttctgtcaatgccccagatgctgtattttaccagtatactgtaggttattttgtctccattctgtttctttctggaagttcactttaaggatgaatatttaccaaaatatgatttgcaggttacagttttgtcagaagatagtagagttgttgaaagcaagaggattgggagaaaacttgttgataaactttatcaaacatactcttcggaacttgctggaaaaagatttgcctatgatggggaaaagagtttgtatacagtgggtcctttgccacagaacaagtttgaatttacaatagtgctagaagactcatttgcaaaatggtatattcttctactccttactggatttagattttgtatatgttagaatctagatgttataacttttttgtcacaatagctcactgtctggttgtgaaaccaggagtcctgatgctgatggaggccctgctgagactggcaagaggacaaagcgttcttttcagtcaaagacttacaaagtggaactaagctattctgctaagatacccttgaagtcaatatctcttgccctcaaaggagttcagtcagatgatagcactcaggatgctttgagagtacttgacatcattctaaggcagcaagctgctgatcggtatttaattttcttattcttttttggttcaagacttaaccattttcacagaaccatatgtgtacccctggatatctgtatgtattgcttgtcccgtcttattttagtgacggtgttggttttcagaggttgccttttggtgagacaatcattctttcaagatgattcaaggaattatgttgatttgggaggaggggtattgggtctgcggggcttccattccagttttcgtcccactcaggggggcttgtctttgaatatgggtatatttttattcattctatcataactttgatcctaaaacttttttattcttttcatcatgttttctctttaaacctttgttgcagatgtatctacaacaatgattttaaggcctggaccagtatttgagtttctaaaacaaaacctgaatctaaatgatgaacgtttctggctgaaagtaaggaactcaaaaaccaaaaatcttaattactttatgtcctgaaaactaaacttataaattctacaggccagacgaatgttgaagaatatgaggattaaaacaagacaccgtaacatggaattcaaaatcactggtctaagtgagaagccctgttgtgagctattgtatgtgctcatttgctggggatttttcctttcataacttctatttgagttctttctccagaaagaattttaattctggttgtatttgtctttaatttcttctagcttcccaatgaaagttaaaaatggtggttgtggtgaagtccggactgttgagatcacagtgtatgagtatttcaccaaacactgtggaattgaactcacatattctgcagacatgccatgccttgatgttggtaaaccaaaacgtcctaactatttacccctagaggtcagtcaatttttttattcttcataagcatagtgttcattacacaatacactgttatcagacatgtctatcctaacatttaattttatggtgttctagctctgttcacttgtttcacttcagcggtacacaaaagcgttaactacaaatcaaagggcgaccctggttgaaagatccaggcaaaagcctcgggaaagaattcaaattctgactgatgtatgtttctttgtccttatggctataaccatatttgttattttgtcttcactactagaattttttgcttctttaacctggcaggctttgaaaaacaacaaattcaatgagaaccctgtactttctgcatgtgaaatttcaataggtaggcaattgacagaagttgagggtcggatcctggagactccaagggtatgtgttgttgcctctttgtcaagagaaagagagagctagagagttttacctcaatttaactgtttagtgggttcatcgtaacacatctctattgtcattaacagttgaaggttgggaatcacgaggattgcatccctcgaaatggtagatggaactataacaacaaggtagtggtgatagagggtttttgttcatcccaatcttttatgttatagtatactgtgttggtcccaatcttaattgattgcaactctttgcttcagagtttgtctcttatctagtttccatctcatagcatttgatacaacagtttattttcacatatatatattccttccatccctttgcagagatttctggatccaaagaaaattgaacgttggattgctgtcaacttctctgctcgctgtgatctcagtcaaatttcaagggatttaatcagttgtgcaagaaacaagggcattgtaggttattccacattttggctgtcgtcatggtgctatatgacttgttggtataactgtcttcttatacaaatgtattcatacatgaaggaaatggaacgtccgcacacattgattgaggaggaacggcatcaagctgctaaagctggccctgctgctagagtggaagcaatgtttgatcagattatagcaaagcttcctggcccccctgagttcattctttgtgtcttgccagtgagaaaaaactctgatatatatggtatggcttttcctgttgatttcttttcttatttggctagtcaactgacattttccatgctctgtcaaggaccttggaagaaaaaatgtctttgcgatatgggaattgccacacaatgcattagccctggaaaaattaatgaccaatacctcacaaatgtcctccttaaaatcaattcaaaggtaaaatcttaaagcaatgcattttccctgaaaaaaaaagaattgttttaacttttatgttgatctacacctcagatgtactatgatattaccttgtctttcttctgtatagcttggaggaatcaactctttattggaaatagagaaaccttcaatcctcccattgctgaaggatactcctacattgattttgggaatggatgtctctcatgggtcccctggtcgatcagatgtcccatcaatagctgcagtaatttctgaatatttgaacgcattataattattcccctaattttgtgaggatacatccaactgtttaaacctactgtatatatcaggttgttggttcgctccattggcctttgatttcaaggtacagagcatctgtgagaacacaatctccaaagatggagatgattgaagctttatataagccatcaccagacggaaaggttgatgatggtattatcaggtagtttagtaaaactatatccagaactccatgtgtgctgattgctctgttttacctttaagggctttgaaattgattatttaagtataatttcatggtatattataatattataattttatttttcacatgatttcaaagaattctgttcttgttctgtcacaaacaagatccagaagaatatttcagtcagtgaaatcaacattttttgccccatatctgaagttatttcctatgtacttttatttaattttgaatgccagaatgggtagtcttacaatgcattaaaatgcatttttcatttgttatgttgtttgatgtgccactgacgtgcataacttctattatgatacgttgagttgatacaaacaagattgcttgtaaccttggctcttttggtgctgtaaaattaaaatgctggatatgatttgagatttattcatatgaaaatttgagtatgttttttgtgttgcaagggaactgcttgttgatttctataaaacgagcggtaatcgcaaaccaaaacaaattatcatcttcaggtatgtacacttgtgtttgtggatttctgcatattttattacattatggctctaataggagttaaatatttcccctcactggttttctgagcttgttcagtggtcagcaatttgctttttaagatgtgaaagaaaaaatggaagtaattatttctgttttcttgtatgaaccaatcatacactctttacaatggttggttgaacaatttaattcatcacttaaataattagttttgatgattttcttagggatggagtaagtgaatcacagtttaaccaagtattaaacattgagctggagcaaatcatcaaggtacattctggactatggtttatctttttcatcacaatataaccatcatctccctgagtaagggctatgggtcagcatattaattgatgtttctagaaggctgttagaagtgcctttctactgctttcttgtccataacatttttatgttacaagatcctgcgaagggttagttgagggcctcatattttcttgataatagtcaattcttagatagttaaacatcctttgcgcagtcatatcagtttctgggcgagtctgatgttcccaagttcacagtagtcgttgctcagaagaatcatcatacaaaattattccaagctaatgcccctgaaaatgttccaccaggtttgcttctgatatttcattttcctctctagtttattaatttgttggttcactctctcgctttcctctgcagggacagtagtggacacaaaaattgtgcatccgagaaactatgatttctacatgtctgctcatgcagggatgatcgtaagtgttttactgttactatcaaaattttttgttcaatcttgagacattatgaagcagcagtgttgttttttgcttctgaataatatatgcatacatgtgaataagatcctccgttgcattgtttcaaatctaacagggaacatctaggccagctcattatcatgtcttgcttgatgagataggtttctctcctaatgacctgcagaatcttatccactgtctttcctatgtgtaagttgtgaataagctccatctgccatctctaacatcgtaggaagtagcaggcatttttaatcaattacattttgccaaatgcagataccaaaggagcacagcagcagtctcaataggtaattttccccttatcctacaccctgttcatgtttagcaagtcatttgtatcagtcgcattaatatttcataaacctgggttgtatttcatatccagtggctcctatttgttatgctcaccttgcggcatatcagatgggccaatttttgaagctggatgaactttcagaaacatcttcaggaaacgtaacatccacaggaagtatccttgtgccagaccttccgaggctgaaaaagaatgtggcaagtacaatgttcttctgttgaggggatcacccatttcagtaaatacatgctaggctaactgtagatagtttgggtaggctaggggtatacaaagcatacaactccaggcttttgcttttgtgattgattattgaggctggctggctttaacaagcaaa

SEQ ID NO: 485 - DNA, 9001 bp, Gossypium raimondii
acgcccaaaagtgaggattctttaaaactcccccaaaacatcaatttgtatagcggaagcgattgtgccaaaagaaattacaagtgaacaacaaaaagtcaaataaaagaatgcacacaaagtgtttgagtaaatgctcagagaattctattactcttaagaattcagcttacaatggatgagtacaaatgagggggatgctctctatttatagttgagctccccaaaatctatggtcaagatacatttacatcgacagacgagattaaccatatcccttgattttagtgatttacaagatatgtcatatcaaatctaacataatctttacaatatatgattccctctatattctaagattagttaccaaaattagtttaagttgccatgtcttcattatcgggccaaccaggctttaatctgacagacttctccaacaattccttgaatcgggccagttctcgtggattaaatgttccccatctaatcgatagacctccatagggcgcatcttgtgccatggtcacgggctttgcactttggctcgtgacactagcacccccaatttttttttaatattgatataaatatataccagtatgatacgatttgaaaaaaatatatgggtgtcggccatctagtgttcggaatcccaaaaattattttttaacagaaaaaatacataggtgccgaccatctaatcccataacctaattttactgttcatttcagctcatttaggtgattatttttgaataatgatcatttatgtaaataattatttttttgaagtcatttgggtaaaatagccatattgtacacaaataacattttataatattatactattacttacaaaatataatttatttaagtattaattaaattaaatatattatataaattttttaattttataaataaacgcgtatatccatgtgcaatgcatgaggccagaaaaactagttactataataaattagagtaattaatatttttacaagtctttatttcaaccacattttgaatgtgtcaaattaaaaagtttatgggagaaatatttttttataaataaatatattattatttttataatacataacattgacatgtaaataagttatatttatattttttatcataaattttttataaataaataaataataattcttttaatattttacacgtaaattatattttataagatacttttgaccataattttagaaaaaaattaaactttaaataatataatttttgttccaactttacaaaatttacatggattattatttttataatatctttaattttttttccacaaatattccaaacactagtatgtattcatgtatgaaaatctctattcctccttaaaatacaaaaaaaaaagaagaaggaataatgctctgtaaattggttttgggcctcggccattatggtcggcacaaatcccgatatatatatttgttttcccgctttatcaattaatttgaaaatttcattccccctttgattttggagccactccatttattattaaacccttcattttcccccattcctttttatttccctcccacttcccaaaaccctttcctacatttcccgccgtccaaatcagctcaattcctcacttcggattcggcgccagttcggccatcgttgtttatccggctctctgaacaatcatcgccgactggtcagaatccataaaattacctttgtttcggttcaagggtttcttttctcttgtctaaatcgataatgccgagcacgcgaagagcttctaatcctatgaaggacactgattcgaccaagaatccgactcgctcgagccagcgtaatcggaagacagtgttggagcctgaaaatgatgaagtcatcgttgtcagtgaaggagagaacagtgaagtctctcgtggtggtaagcggaaggaaagctctgcctctggagcgggcaacaacgctaagaagtcaaaaccaagtgtagctaaaatgacgcctttggataccgagaatggtgaagctatggtcgttgacggtactgagaacggcagcaaaacgacaccaaaaaattcgaaaaagacgaaaacggatgtagctgttaatgaagacaaggaggaaacaaagtttttaggggaacctgttgatgacgaggaagccagacggcgatggccaaaacgctatcaaggaaaggtgtgcatatcgtatctttttattttctggggaaaaaaagtttaatcttttgaaagttctcttaaagttttaaattttcttaagtcatgcaatagaattttgaatagtccttttcttttacctttttattgatatttactacttttgtcattagggagcaaaaaaggtcatttcaaagagttcgaatgggtaagtaaacatttttttcccataaatcaatttcacttatactatttatttacattgcatttattgtttaattgaattagtgggtgtttgttattgttttcaaagttttttatatttattttttaagctttcaagttttttttcccttttcaatttagcattttttgttaaaatgactgagagctcggttagtatcttaaaaatcgtttttgaaaaatgtaaatgattgttttttaaatccatcatccagcattttagtttggggctaaaaagattttgataacagccttctaattagtattgcttttgctgtggaataaatgtatttagaaagtaaaaagggatgctaaatacatatggtgtaatgagtttaaaggggctaaggtttggattctgagttcaactttacataagatcaacgtagaagcatttgactgttttgggtgaacaataacgaaaaaaaagttttattgggaaaaaacaagtgaataacttttttcccaacattatatatttttgttaaagatcaagtaaaccctttgttgtatttttaaagatgtgcaaccttaattttccaatttatttggtacagtgactctgaagagatcattcaagctcgacggcactatacccaggcaaaagttgatggttgtatgatatttaatctttatgatgatgctcatgttaaagtcagtattactttctcatctattattttgtccttatatgttcttttaccatatttaaaatcatagtagtcttgtttatttgttggtcatattgatcttttgcatttgcttgattggtagttaaactttcagtcatattttattcatttgattgtttacaaaccttctcaaatttatcatcccctgaattggatattgtttagactttgttaggatgaatgtttttctccacatgaaaatatacaatatgcttgatgttattcaataactgatttacagtacatatttaggatttctagcactaattattctggatcctctctgataagcagagaggaattcgagtaaatggtctatggatttagtcatagtggtaactaattatattatttttgttttgcatatatataggctgaagatggagaagattgctatatatgtaaaattgttgagatgtttgaagcagttgatggagatttgtactttacagctcaatggttttacagggctcaagacacagtaagatgattcttttgtactatttccattagttttgaaccttttaatttgacgttaaatatcaatccttttccaggtacttaaaacgttaggccaccttattgacaagaagcgtgtattcttttcacaaattcaagacgacaatcccttggattgtcttgttgcaaagcttaatattgcaaaagtatctttgaacgtacgttttccgtttcttgcacttcattttaatgtctttcactgtttcaccatgctgtataattattatggttttttaggttgatttggaggcaaagaataaagagattccaagttgtgattattattgtgacatgttatacacattggaatattcgtctttcactaacttgcccccaggtagctgttattcctctgatttgctaaccctttttttgagtgtacgtcaatgaacatttaaaatttactaatttgcttcaacgtctaataatttcttttcctaatcaaagaagggaaaacaaatgctagcgaagaagcttcatctacaatttctgatgacagcccagatacagtaaatggagctaacagtggttccgaggatgcttcattgctggacctgtattctggttgtggagcaatgtcaaccggcttgtgccttggggcaaatatggccggactaaggctagtgactgtgagttagtttacaatatttaaataattgtgcgttttaagttttttgtaattggtaaattcttataaatttagttatttattgggtttttgttgaatgagtttagaaatgggctgtggatataaataaatatgcttgtgaaagtctccaatggaatcatccggaaacaacggtaaaatttatttataatttattttgttatttattgttgttgtttaaatcatgtaataaccttggtgcaatactcggtttctcaggtcaggaatgaatctgctgaagattttttagcattattaaaagaatgggaacggctgtgtgcttcattttcatcgtcaaaatctgagaatttggagaggcagtcattcaattcaagtgtaaatgaagataatgtaaatgatgaagaggaagaggaagatgaaaatgaagatggtgatggtgaagtgtttgaagtagagaaatttcttgctatatgttacggtgatccgaaagagaaaggggaacgtgggttgtacttaaaggtatttgagctttataaccttgatgtttgttggcctgtaatagctctatttatctcatgtggccaattcttttttcttctttcatttattctctttagaacgttgttctgaaatcctagctacggaactaattttacaacttcaattctagcactgattttttagctttatgtttcgcgtgttagctttgttctttttactttggggaactccaccatgacttctatccccttttgtaggttcgttggaagaattatgggccagaagaagatacatgggaacctttagatggattggggtatatcaactgtatttatgattgattatttcgtacttaaatatgcaaacttgtctgttaacagtttcttctttttaacagtgattgtcgagaatgcttgaaggattttgttacaagtggcttcaaagcaaaaattctgcccttacctgtaagtttctcttgtactttctaatgttactttttaaaaaagtgtatttctttaaatgatattcatacattatttatgctgtattttttctttattttgtttgaattactcatgtttgacatatttggatacgagtgtatagacatgatctttcattaacttttcaaatacatagaaaaaaattaaaaaaattgtacatacatatgtataaacccaaatctgaattatatataacctataacattagcccttgctttttatcacaacaaagtagcgtctctagggaaggacaagatagttattaaatcatagaatatttcctgaattcacaacataaatttgccttgtttttgttacaatcacaaattcttagtatgttctgtatttttttacattgtcctatagggtgatgttgatgtggtttgtggagggcctccatgccaaggcatcagtggctttaataggtttagaaacaaggataaccccttgcaagatgaaaagaacaaacaacttcaggttttcatggagatagtggagtacttgaagccaaagtttgttttgatggagaatgttgttgacatagtaaagtttgcagagggatatcttggacgatatgctttgagtaagctaattcatttaaattaccaagtccgaatgggaatgatggcagctggtgcttatggtcttccccaatttcgtatgcgtgctttcttttggggtgctcgtcctaatcaagtgagtttttttcctgtgaatacaaaaaattgtaactcttgagtcacttgatgttgtgttaaccttttggaatatgttgatcttgtgttgattaagtttttcactaataaattcttaacactgttctcagaaattgccacaatatccacttcctacgcatgatcttgtcctgagaggtgtcatacctgttgagtttgaggtacaaaaacctttctttgattttaatttttaaatgcttctatattctcacaatacttagtaaattgcagatgaacactgtaggctgggaagaaggtaaaaagatagagttggaaaagaaacttctactagaagatgccatttctgaccttccatcagtatgttttaagagtacttgaagattttccctcttttttttcactgcttggctagttcatttatcagttacatgtacctttatgtaactcaattattcttataggttggaaattatgaggataaagatgaaatggactatgacaaagatcctaaaacagagtttcagagattcatcaggttaagaagagagggtatgtatacttttcatatttgctaattatttatatacattctctgaagtccatgttaatgaaattgttttggatgggcgttattcaagtgtgtccgacatgaatattttatgatcgatttctttatatgtcttgtagagatgccaggtttttcttcactaaatgcaaaaccaacaaaacatttgctctatgatcatcgtccacttcaactcaacaccgatgattaccaacgtgtttgccgggttcccaaaaggaaggtacatcacttctccccatctcaagccaatcggctttgtgttctgctagatgcttcttgacttgctaatttctttcatctcatttctcattttatcaactttagggggcaaattttagagactttccaggtgttatagttaatagtggtaataaagtcgagtgggatcctaacgttgagagggtttatttggaatccggaaaaccattggtactctttttcattttgttattgttgatattcttcttaatctgcttccatgaaggtgcactgcataacatttttataaaaacaattacaggtccctgattatgccatgtcttttgtcggcggctcatcaagcaagtgagtattttgtctgtcacatgtctctgataataagaaagaaactttttgatcacataaccttactgttatgagattttgtagaccatttgctcgtctatggtgggatgaaactgtacccacagtggtcactagggcagaacctcataatcaggttataatttatccacacattatacgttatagtgttttagtttattttcatattttaatttttgtaactatatgtgtttttgtaccatagcattcatgagttgcaatgatctggtatgtctttgataggcgatattgcatcctgtacaagaccgagttctctcaattcgcgagaacgcaaggttgcaaggcttccctgattactacaagctttttggccccgtcaaggaaaggtacttgtataagcgatgcctttttccaattatgttgttttgatcacatccttttgcaattatttggtttcaagcaatgttatttaaatcagatcaatcaataggatttgttgaatgagaaccggttggagttttagttcataaaaaaggctatgttggatgatccatgaaacactgagaatagatttaaccaagtatgtttaaaaaaatgaatttttagtaattaatttaattgaattgattgaatcaagagccaatgatttaaatggttggattattagtttggttttgttaacatttctttcaacttttaggttatgttttaaaaattagaatggttatcaaattgatcatgccattggtttttacctttcagtttgattgttggttcaatgacaattaaataaataattaaaaatttaaatatatatgaattggttcaattgcttttttttttttatatcggttttaggttttttacgagtggtttttttagaaatatgttcaatcttttgtttggatggttccaacaacagtgctttcaagcatgaaaaccaaaattcatggtctttcctccggtttaagtacactctacaattagtgatagagatcagtcttgtatcttggctatttttcatatcatattctagtttaaacaaaatttaataattagtgttgcaaaattgagtcatattatgataatctttttggcgtggcctatgtataataggtacattcaagttggaaatgctgtagcagtgccagtttcaagggcattagggtatgccctggggttagcttaccaaggtgtagtttcaaatgatgaaccattaacgaaacttcctccaagattccctaacatatctgagaaagcatcttcggattcatctcaagataattcttaaacccccccttttttcttcaatctaattaatattagtcaatggaattgtgtattactttttagattttgaaactctaagagtaattaaaacctagtttaatgttcttcattcgatcccttgttgtacgactacgtgttgtcggtgctaatatttttttaattgagttttaatggttaaaacccattaggtaaactagttactaaattgttagtatgtttttattttgttctctaaatgtattgctaataaggtaactgttagtttacattttttgtattgaacttatttgagtagaattgctattactttgagttgaaatgatatatgcatgtattaagtttgtcaaaaaggaatggataaatttgttagtgattataagacttgatattaaagtgtcttatgaaatatttgattaggcacattataatatagtgtcttataatcaccactaaatttatccatttccttttcacaaacttaatacgttcatgtaacatattgtcttgtaatatcgtgtttatatacaatgtgcaatggtatggggattatggaattgatgtttatatacatttattattgcacgatgttcaatatgg

SEQ ID NO: 486 - DNA, 12802 bp, Gossypium raimondii
ttgaaatataaattcacttatagatgttaaaatcataattcaaaagttaatgacattatacaatttataaaagtggaatgaaagcataggccatttgttttgttaaatcgcaagctcatttgaaaaatatttttaaatatagcttttgtaattatagtggtttgactctatgatttaataacgatgtaattaatagacgaaaaattaaaatttaattacatgttattttagtctacattttatatgtctaaatggttttttcgctagctcataaataattggaagttcagtcatgatattatagtgatttgatgttattatagatgtatttatgaaaagaatatcgtcacgacaccattaaatgttggaataaatggatattttggaagctttgaggcatattatcgattagtaaatgtggatatttgaatcataaaactatggttttatattttactccatgagaactttacaatggtatatcatatgctcaaaatagttgagtgatgaatgagaaattgatactcaaagtaagtcacttgtgaattatgttgaggaaagtagaaagcttagtcccacatttgttagatatcaagagtgaaatatatttatatatgtgaaccaacttggtggttattgaatgactaaattaacactatctctcatgcgcaagggggcacaaattcaaacccattagggttgggggcacacccacacgacgtgggtaatgggaaatgtttgtattggttgggcatttttaagcccctatgaatatttaattagtaatctgacacggaagatacacacagtgatagacgaagccatcttattgttgtatcctcgatttttccagcaccaaaggagcggagcggctgaatctatcttccagtataatatttgaatttaatttaattttctattttccaaattatatattattgttcttatatataaatattttataatactgtcattttactaacatttttgtgcaacattaaaagcaaccacagtatcaaatccactctcattaatatttccaaatttttaagctcaccacacaagtaatcgcgggagaagggctcactccaagaagagagaccacactttgcttaagtgtaacctcaactccctcaaattatcacttcgagtatataacttaattattaaacaaagaatatgttaaaaaatgttgcaaaatcacaatatgcaacataacacaagtatgaactacgtcaactgtcgaactgttatcgtttccaactcataagccaaaccctcttaacgcgcattacatgtccaataaaagagggaggtttgcattgcgtgtccaataaacattgggctgtcattgcacattccccataacgcgcgataaccaaacagcttgggttcaaatcatcattgggctgtcattgcacactccccctaacgcgcgttaaccaaaacagcttgggtccaaatcatctgatagtttcaacctgtttcgctctgcagactcagcactgctactgttttcgagtttcaatgagtttaaataaaatctaacaaaaccccatcaccaaatttcattttatactggtatcatacattaagtgcctttagcgagttagtgttcttatagcttctggtagttggctagttaattgcgacccgaggtttcattgtaaaccgttcggtgttggggcagggttcttcctttttctccataaaaatagcaaaatgagttaattggaaaattcccagaacagtacattttatataatccatgtctttgctgaagtcccattcaacaccccaattttctccggttatcttaaccaaactaatcgtacgttagggtttcacatattttgtgttttcactcttttttttttaatacttatcagtcccattcggtaaaggtttagtctttttactcttattacaatctcacaaactacatgcattctccaaaggaggaacagggtgagcctctaaaacgaagtttcagtgaggcgaactcagacccacctgattggatggttctagacgacaatgaaactgctaaggaagaagacccttcttcatcttcaaaacctaaggactttaaccccagagggtttgcccttttctctttttcgtttttgagtgtggttgttatttgtgtcattctgagtttttgattttatttttgtgttttgtaggtatcaattgcaggtatatgaggtggcaaagggaagaaacataatagcagtgttggatacaggtgtagggaagacaatgatagctgtgatgctcataaaagattttgttcaagctatcgagtctactgaaagtaaaaaattgattattttcttggctcccactgttcatctagtcaatcaggtttgctttttgatccgcgaaagtttgaattcctcctggtgaggtaattgtagttaaacattgacattgtgtgtatatatacatatatttgtatttgcagcaatttgaatatgtaaaagatcatactagtttggaagttgaacagtattatggagctaagggggttgatgaatggaccttggattgttgggagaaagaaacaaaggagcatgatgtaagtttgcttattatctagctttgataaggctactttttaagctaatgcactgagtcttataaatgttgagttggattccatttggttctagtactctcactttgagaatcctccgccttaatttttcgtagttcgtactaatgtttttcaatgcacttctagtaaagttggcatttggtgtttacttatctttgaagggcaccttgtaggcattattccttgatattctttgaaggcactatactttgtaaatgggtagcaaagcatgggacatactttttttcttctgcttctagcccctttagatcaacttgttactgatatgtatatctttatcattgatcttgtaggttctggttatgacaccccaaattctattggatgccttaaggaaggcattcttgagtctggagatggtgtccttaatgataatagacgagtgccaccgtgctactggcaaccatccatatgccaaaataatgaaggtcagtaatcctgaaatctttttgctagaatcttgatgactttttgttttttgacactaagaattttgatgactatttaaattatttggtccttttttctgattaaaaatgaaatgttgttgtgttctatattttggtgtaggaattttatcacaaatctaataacaagccaaagatttttggaatgacagcatcacctgtggttagcaaaggtaaggtatttgtattattgttttttcatatgatatttaagtgtttcctattcataaggtttatctagttgtttatatccccattttgctcaagctttgttcctattacagaagagatctaaaagtatggttgttttaaccattaaggatcagttttttaaagaaaatgatcttgaagctccttggtgttgcagaaatacttcaccttttttttcccccacaagcatattttgttgcatatatacagtagttcttatgcttttgactcaactttctgtaggtgtgttgtccagcaataattgcgatggtcaaatgtcagaacttgaatgtgttttggattccttggtatctttgtatttagtttttctggttacctatacgattgatttgctggaaaaatcatatgtcgatatgaacaacatcttgaatatgtgctgctgcagatatacactattgaagacaggacagagatggaagcgtgtgttccttctgctaaagaaagttgtagattttttgatccagcacaattttctagcttggatttgaaagcaaaggtagaagcctcttggttaaaggtatccacggactttcatgagtgattcacttgtgtgggaatgtgttatttactcttttcatatagagttgttgaaggccttttattttattttattttattctgggcagacagatgcgtcattgtcaaatttgcaaagctcactgcaaacttcttataaaggcatggatgataaacttaagaatctacggaagcgattatcaaatgaccatgctaaggttctgcattgccttgataatcttggtctcatatgtgcttatgaggtatgattgtgatgtaaatttcaattagagtaatgatctttaagaggaaaagtgtgttcatctcgtttttacatgccatataaaattcaagctactcttataacatacacagcttttgatttctattatttacttggatgcatttgttgtctaatttaactctaatagttacattaaaaaccaattaactgagtaatgtctgacaaaaaccctgtactttatacaatcaccatagtttaaataacaaataaggtttcgctgggctttatgttgtttctttctgctatgccttcctgtttgctgctgatgcgatgtgctttatgttacttctttcataggctgttaacatttgtctagagaacatccttgacaccacagaggaatctaaagcatatagagaaagtgtgttgcagtataaaaatttccttgaggaagtccaatgtagaattggggagtctcttcccctcggtatgatgtgatgtaccttttattgtagttcttttatctggtttaaaccgtgttttctagatgtttaagtttacatatctgaagatacatttgtctctcactaatattgttcgcttctcacctcttcaggtgataaaaattttctgaatactggatttgactatttgaaggcagtagatcttggctatatttctccaaaactgcatgaactacttcaactgttccaatcatttgggtaataggaaacttcagtggttagtatttggaatatactgacagtgttgacttaagtcttatttctgttgttgcagagaaactagacaagtattgtgcctgatttttgttgaaagaattattactgctaaagtaattgaaagatttgcgaagaaagtaagctgtttatcacatttcatggtttcatatatgactggaagtaatacatctgttgattccctggcaccaaaaatgcaaaaggaaaccttggagtcatttcgatctgggaaggtatctcatcttctatgtaatagcttataagcactgaaatttggatattttacagtcaatgattaaaagcttcgtgtaggtgaatctattgtttactactgatgtggttgaggagggaattcatgtaccaaattgctgttatgtgatacgtttcgacctgccaaagacagtccggagttatgtacaatctcgaggaagagctaggcagaacaattctgaattcattatgatgcttgagaggtagaactgtgttcttgtgtagcatgcatttgttgtttgcctgtagtacttttgtctgtcagaagatatttcgtcatgggtgcctctatttatgatataatggcatagtgtctaactgatgtgttgacaggggaaatgtgaaacaaagaaatcaactatatgatataatcaggagtgagtattcaatgacaaattcggcaattaaaagagatcccgattctgatccatgccttcttaaagatcatacatttgaagaaacaaatgtttttattgtggatgctactggagcttcagttactgcagattctgctgttagcctcatccataaatattgtgggaagctccccggtgataagtatgctgtttcttgttatatttttgttctttaatcttcacttttcactatgtttgggagtttgttgatgacatattaatgcacattttgtcctctgttcaatgtaggtattacacaccaaaaccaaatttccagttcacgtcttctgaaggattatataagtgtaaattaacattacctgttaatgcagccgttcaaacaatagttggtccactgtctaggaattctcatttagcaaagcagcttgtatgcttagaagcatgtaagcagcttcatcaaatgggtgccttggatgatcatctcactccatccattgaagagccttcagaaaatgcttgtatttctaaaggaaaagattcaggtgcaggtgcaggtgcaggtatatgcataaactttctaagtatgaaattcttgtttaatgattgattttgcaactctggtgtgagtgtgtaagaaaattttataacatccctcttcgtggtttttgataagtattgttgacctgagttcaaacttgaactgtattatttactaaatgtatagtactttctttcttgtgctcctggtcatcatctgcaaaaaagtgtgccttgctacttgcatcattaccattcaggctcttggtagcaataaaaaaatgaaaatattaataatagactacattttaatttccaagcatgtgcttctcaagttatggctagtagcgagcactaaaattcggttttgctttatggacatagtgctgctatgttacttgcattactggcacagaatttggccagcatttttgggatgtgaatttttgtttgggatattagttatgtctttgcttgtctttctatctaaaatcattgtttgcattttttagtcttgcagaaaataaaaaatggtttcatattgctgtttttccttctttctttttttgtggtacaaaggaactacaaaacggaaggagcttcatggaacaacttgcatacaggcattatgtggaagctggggagaaaaatctgatgatgctgttttctttgcctataaatttgacttcaaatgcaatatcattactgtggtttattctggatttgttcttctaattgaatcaaagcttgcggatgatgtggggaatactgaaatggatcttttcttgattggtaagatggttaaggctagcgtttcttcctgtgggcaagtgtatttgaatgcagaacaggtataaataaacctaatgttgtataattgttcttttttcctacatgaagtccttaatttcaattgcaatctcatgctcttctcttctctttgttttgtttttattttcttcactatagatggtgaaagcgaagcgctttcaggaatttttctttaatggcttgtttgggaagttatttgttggatctaaatcatctggagcaccaagagaatttctacttcgggataaaacaagctccttgtggagtccatcccacatgtatttgcttttgcccctcgaggataattcaactgatgaattgagaatacactggccagggataacagcttgcacattagctgcggaatttttaaataaaaattctttgttgggcactgagcaatctgatgatgatggaagcaatccatcattgaacagtactggttcacctgtgacatactgcaaagaaaccaatataatccgctttgctaacagttcagttgatgctaatagtcttagaaatacggtagtattggctattcacactggaagaatctactgcatcattgaagctgtgagtgataaaactgctgaaagttctttcgctgaaactgttgatacggtctcatcagagtttgctaccttctatgaatacttctacaaaaagtaagtgataggaatttccagctagtttttatgtatttctgcatcacaaagtggttcaaattacaacgttggctttgatcaggtacaatattgtgctgaaacatccaggacagcctttgatgctgttaaagcagagccataacccgcacaacttgcttgtgaattttaatgatgaaggtttgtaaatgttttagctacattacaattagggattatgtagatgcaatgcccccatcttgtagctctgtgatcattttatccagttcgttattcccaagacatttttctaggtgaaagtatcttacaggtccctcaattatagggacctcatcaaattagttcctttactattaaatggatcaatttagtcctactattgaaatgaatcaaataagcccaaattttaacggtgttaacatttactgtttaaaaaattgtcatttgtcatttactatttaacagagttaacatctttaaagctttacggttcttcaaatgaattattttgtttggagtaaaactgcgaatgaaaaaaaaatcatgtcattttttaaacagaaaatgttaaatatgttaaaatttgggcttatttgattcattttaataggactaaattgatccatttaatagtaaaggaactaatttgatgaggtccctataattgagggacctctcaggtgctttcacccattgttctacctccaatccaacaaaagtagaagttcttgattaccagttattgtggttttgattttcaatttctagctacttaaataaagtcttaaacctgaaataacactatgtaccttatgtccatgtgacttctaaatatttttccaatttctgagcaggtgtatcagctaaggcatcacaagctggcgtggttaatgaaaagcctcggtttcatgtccacatgccccctgagcttttacttgtccttgatgtcccagtgagtgttctaaaatcattgtacttactgccatcattgatgcatcggctggagtccttaatgttggccaaccaactcagagaagagataaacttttgttctagcaacattgatattccaagctcaatggttttttctctaaatctcctctaaactgtctgtttctgaaacgattcattactttaacaataatttgatatcttttttaaactaatagatcctggaagcattaacaacacttagatgctgtgaaagtttttcaatggaaaggctggaattgcttggggattcagttctgaagtatgctgttagctgccacctctttcttagatatcccaacaaacatgagggacaattatctgccaggcgttcgttggcagtttgtaattcaaccctgcataagttgggaactgaccacaaaatacaggtgctatttccttatattggctagaatccttgcgtaggctgagtcactgagatccatttttgatggatatatattctttgaggcaactgtttatgcttgttaataggatataatcattcttgctgttcattgtgcaccaatatctctatgtgtatctcctgtataatctgcctcctctaattgtataatttttaaagagatggtttctggctatgaatgatatgtttgctagtggaatattattgttctagcataacagagaacatgacacttgttgcttcgcaaaattatttaatgtttgtaccatgttgaaggatttataataatatattatgatcctttgtgctcaaaagcgggcaacattggtatttttgctttattgagttacatattgttttcaggttgtgtttaataagctggtttaaataagcagcagcggcaatgcatgggcttttcttttatcctttccaattcttgcattattgaaaactggagtctataatttaggcacagaagctgcccattctgctcgacttcttattgtttatgccagttttggcaaatatacaagtattacgaactgttgattgttacattggttttattttttatataacagggatacattagggacagtgcttttgatccccgtcgttgggtagctccaggacaacgagtgcttcgccctgttccttgcaagtgtggtgtggactctctagaagttcctttagataaaaaatttcagacagaagaccctaaagttaaggttggtaaatcctgtgatagaggccaccgatggttgtgttcaaaaaccatatcagattgtgttgaagctctcataggagcatactacttaagtggtggacttgttgctgcccttcatgtgatgaagtggctcgggattgatgccgaacttgatcccttggtggtagctgaggtcattaatcaggcatccttaagaacttatgtccccaattacgaaatccacatgatagagtcaaaagttggctacaatttttctgtcaagtttttcttgcaggaggcattgacacatgaatctttgcacgagtcctactgttaccaggtagttatggaggttctctatatatattcgagttctttatttttccttctttctctcagaaagtttaagtgatttggagtccaagaaggaaaagctcatacattgtgaataggatattgatgttaatcttttgttcctttttctccatgaagtggaataaaatagttttaatactaattatgaataatataaatacaactgtaaacagttgcttaggtcaatagatcccatgtgagctcacctttttacgtattgaaaattttctacagagacttgaatttcttggtgattctgtgttggacttgctgatcacccagtatctctacaaccatcacactgatatagatccgggtgagttgactgacctgcgctccgcttcggttaataatgaaaattttgctcaagttgccgtgcgccatgaccttcataagcatcttcaacattgttcaactttactatcaaaccaaataagtgaatatgtgcggtccttcactgaatctgataacaccaccagattagatcccagcataaaaggtcccaaggtattattaatcttttttatggtgcataattagaggtcttttatatggttctattgtactccgttactgttttcgatgcactttccatgttaccttatggctcattgaattgaggcgattattggccatggggatcagggatcttgacgatatataatctccactttctttgctacaggctcttggagacctggttgaaagtattgttggggcaattctgattgatacaaacctgaatcttgacaaagtctggagaattgttgaaccgttgttgtctccaattgtaaccccagataagcttgagctgcctccattccgggaactgaatgaattatgcgactctcttggatattttattaaggaaaaatgtaaaaataagggggaagtagtgcacgccgagcttctattgcagctagatcatgatttgttggtaggagaggggtttgatagaagtagaaaagtagcaaaaggaaaagccgcttcttgtctgttgaaggaccttgaggtacgcattcataaaagtttgtcaggacatgagaaaggagtgagtctggtcacatcagccatttaacttcacaattattcttcactccctgccttcctttgaccaatcagaagtttctttcatttcatataatataatattaaggttctacatttatgcttacaattggttatcatatgtgtgtctagtctttgtttctttaggtggatttgttgatttgtttgattcccttaggcttcggtcttttagatatgtagtcatgttcggtttaggctttagtcatttaggcatatagtcataaatccatcactgcatgttgagaactgattgtttgcgctaacattggcaatggtcctgatactccatgtcaacagaacagaggaatctccaggaagaaaaggaaacatgactgtgtggattcaagtcaaaccatggaagatgactcgttagaaccaacaatccctaagaggcaaaggagcgccgaaattcagttgcttgatgaatcaaagaaagcatgcagtgctacgcctgccaccccaggtatgtaaattgttggaggatattgactgcagtttaatgagccaactgaatgagctcaatggtaccatatactgaaccaaggcctggtactagaaataggaaaacatgtaaaatatcatccacagttaaacttgttatttgttttgttcttatagtaaatgagtgtactcatctagttcccttgtctttggatagttacatgatgtctttgtctaaaaaagaaataatatcagaggtaaattaattggctttaaacgtgaatatcttattggttccatcatgttaggaattaaaaccagattatgttttttttctgctttatgcaaacatgtctttgacattttcctctctttggtttctagttattgtaacagtaaaaacgaagaaaggagggccgaggaccactctttttgagctttgcaagaaactgctgtggcctatgcctagtatcaaagcaacagaacacaaatcaaggcatctctctttcatctcttgcaaatatttcatctgctgaagtttcatttcttgatctgctagtacattttcagtgttttgaagcatcactattactttcctttgcagtgctcccatggaaattggtgaaggtcccgagaggaaaaaagggtttatcagctttgtgtcgaaaatcatcttgaatgtcccaggatacgacattattgaatgcactggagatgcaaaagctgacaaaaaaagttcttcagactcagcagcactgtttatgctttatgagcttgaacagcgtgggaagctcatcatcgaggaaaccttataagtctactagcagttgaccatcaatggtgttcattaaaggtgatctgcaatatcctcactgtccagttattaacttttgactcttggtttaaaattgtaagcgatgactgtgagggctcgtaacaaaatatcaacgatatatcatgtatgtatatattgtccataatctaccaacaagccatgttaataaatctgcagttatttctgaattttatctatttgtcaatgttagggtgagtttggattggcgatgcgtttatttgcggttagtataaaaacagcagtagcggtgagattagatactttagcgtgagacaaaaagtaagctaaacataccgcactgcacccaatcgtccatccaaatctacccttattgttgtatatcaattgtagatttccaaagggaatgtcttttctgcaaattac

SEQ ID NO: 487 - DNA, 12386 bp, Gossypium raimondii
gatattttggaagctttgaggcatattatcgattagtaaatgtggatatttgaatcataaaactatggttttatattttactccatgagaactttacaatggtatatcatatgctcaaaatagttgagtgatgaatgagaaattgatactcaaagtaagtcacttgtgaattatgttgaggaaagtagaaagcttagtcccacatttgttagatatcaagagtgaaatatatttatatatgtgaaccaacttggtggttattgaatgactaaattaacactatctctcatgcgcaagggggcacaaattcaaacccattagggttgggggcacacccacacgacgtgggtaatgggaaatgtttgtattggttgggcatttttaagcccctatgaatatttaattagtaatctgacacggaagatacacacagtgatagacgaagccatcttattgttgtatcctcgatttttccagcaccaaaggagcggagcggctgaatctatcttccagtataatatttgaatttaatttaattttctattttccaaattatatattattgttcttatatataaatattttataatactgtcattttactaacatttttgtgcaacattaaaagcaaccacagtatcaaatccactctcattaatatttccaaatttttaagctcaccacacaagtaatcgcgggagaagggctcactccaagaagagagaccacactttgcttaagtgtaacctcaactccctcaaattatcacttcgagtatataacttaattattaaacaaagaatatgttaaaaaatgttgcaaaatcacaatatgcaacataacacaagtatgaactacgtcaactgtcgaactgttatcgtttccaactcataagccaaaccctcttaacgcgcattacatgtccaataaaagagggaggtttgcattgcgtgtccaataaacattgggctgtcattgcacattccccataacgcgcgataaccaaacagcttgggttcaaatcatcattgggctgtcattgcacactccccctaacgcgcgttaaccaaaacagcttgggtccaaatcatctgatagtttcaacctgtttcgctctgcagactcagcactgctactgttttcgagtttcaatgagtttaaataaaatctaacaaaaccccatcaccaaatttcattttatactggtatcatacattaagtgcctttagcgagttagtgttcttatagcttctggtagttggctagttaattgcgacccgaggtttcattgtaaaccgttcggtgttggggcagggttcttcctttttctccataaaaatagcaaaatgagttaattggaaaattcccagaacagtacattttatataatccatgtctttgctgaagtcccattcaacaccccaattttctccggttatcttaaccaaactaatcgtacgttagggtttcacatattttgtgttttcactcttttttttttaatacttatcagtcccattcggtaaaggtttagtctttttactcttattacaatctcacaaactacatgcattctccaaaggaggaacagggtgagcctctaaaacgaagtttcagtgaggcgaactcagacccacctgattggatggttctagacgacaatgaaactgctaaggaagaagacccttcttcatcttcaaaacctaaggactttaaccccagagggtttgcccttttctctttttcgtttttgagtgtggttgttatttgtgtcattctgagtttttgattttatttttgtgttttgtaggtatcaattgcaggtatatgaggtggcaaagggaagaaacataatagcagtgttggatacaggtgtagggaagacaatgatagctgtgatgctcataaaagattttgttcaagctatcgagtctactgaaagtaaaaaattgattattttcttggctcccactgttcatctagtcaatcaggtttgctttttgatccgcgaaagtttgaattcctcctggtgaggtaattgtagttaaacattgacattgtgtgtatatatacatatatttgtatttgcagcaatttgaatatgtaaaagatcatactagtttggaagttgaacagtattatggagctaagggggttgatgaatggaccttggattgttgggagaaagaaacaaaggagcatgatgtaagtttgcttattatctagctttgataaggctactttttaagctaatgcactgagtcttataaatgttgagttggattccatttggttctagtactctcactttgagaatcctccgccttaatttttcgtagttcgtactaatgtttttcaatgcacttctagtaaagttggcatttggtgtttacttatctttgaagggcaccttgtaggcattattccttgatattctttgaaggcactatactttgtaaatgggtagcaaagcatgggacatactttttttcttctgcttctagcccctttagatcaacttgttactgatatgtatatctttatcattgatcttgtaggttctggttatgacaccccaaattctattggatgccttaaggaaggcattcttgagtctggagatggtgtccttaatgataatagacgagtgccaccgtgctactggcaaccatccatatgccaaaataatgaaggtcagtaatcctgaaatctttttgctagaatcttgatgactttttgttttttgacactaagaattttgatgactatttaaattatttggtccttttttctgattaaaaatgaaatgttgttgtgttctatattttggtgtaggaattttatcacaaatctaataacaagccaaagatttttggaatgacagcatcacctgtggttagcaaaggtaaggtatttgtattattgttttttcatatgatatttaagtgtttcctattcataaggtttatctagttgtttatatccccattttgctcaagctttgttcctattacagaagagatctaaaagtatggttgttttaaccattaaggatcagttttttaaagaaaatgatcttgaagctccttggtgttgcagaaatacttcaccttttttttcccccacaagcatattttgttgcatatatacagtagttcttatgcttttgactcaactttctgtaggtgtgttgtccagcaataattgcgatggtcaaatgtcagaacttgaatgtgttttggattccttggtatctttgtatttagtttttctggttacctatacgattgatttgctggaaaaatcatatgtcgatatgaacaacatcttgaatatgtgctgctgcagatatacactattgaagacaggacagagatggaagcgtgtgttccttctgctaaagaaagttgtagattttttgatccagcacaattttctagcttggatttgaaagcaaaggtagaagcctcttggttaaaggtatccacggactttcatgagtgattcacttgtgtgggaatgtgttatttactcttttcatatagagttgttgaaggccttttattttattttattttattctgggcagacagatgcgtcattgtcaaatttgcaaagctcactgcaaacttcttataaaggcatggatgataaacttaagaatctacggaagcgattatcaaatgaccatgctaaggttctgcattgccttgataatcttggtctcatatgtgcttatgaggtatgattgtgatgtaaatttcaattagagtaatgatctttaagaggaaaagtgtgttcatctcgtttttacatgccatataaaattcaagctactcttataacatacacagcttttgatttctattatttacttggatgcatttgttgtctaatttaactctaatagttacattaaaaaccaattaactgagtaatgtctgacaaaaaccctgtactttatacaatcaccatagtttaaataacaaataaggtttcgctgggctttatgttgtttctttctgctatgccttcctgtttgctgctgatgcgatgtgctttatgttacttctttcataggctgttaacatttgtctagagaacatccttgacaccacagaggaatctaaagcatatagagaaagtgtgttgcagtataaaaatttccttgaggaagtccaatgtagaattggggagtctcttcccctcggtatgatgtgatgtaccttttattgtagttcttttatctggtttaaaccgtgttttctagatgtttaagtttacatatctgaagatacatttgtctctcactaatattgttcgcttctcacctcttcaggtgataaaaattttctgaatactggatttgactatttgaaggcagtagatcttggctatatttctccaaaactgcatgaactacttcaactgttccaatcatttgggtaataggaaacttcagtggttagtatttggaatatactgacagtgttgacttaagtcttatttctgttgttgcagagaaactagacaagtattgtgcctgatttttgttgaaagaattattactgctaaagtaattgaaagatttgcgaagaaagtaagctgtttatcacatttcatggtttcatatatgactggaagtaatacatctgttgattccctggcaccaaaaatgcaaaaggaaaccttggagtcatttcgatctgggaaggtatctcatcttctatgtaatagcttataagcactgaaatttggatattttacagtcaatgattaaaagcttcgtgtaggtgaatctattgtttactactgatgtggttgaggagggaattcatgtaccaaattgctgttatgtgatacgtttcgacctgccaaagacagtccggagttatgtacaatctcgaggaagagctaggcagaacaattctgaattcattatgatgcttgagaggtagaactgtgttcttgtgtagcatgcatttgttgtttgcctgtagtacttttgtctgtcagaagatatttcgtcatgggtgcctctatttatgatataatggcatagtgtctaactgatgtgttgacaggggaaatgtgaaacaaagaaatcaactatatgatataatcaggagtgagtattcaatgacaaattcggcaattaaaagagatcccgattctgatccatgccttcttaaagatcatacatttgaagaaacaaatgtttttattgtggatgctactggagcttcagttactgcagattctgctgttagcctcatccataaatattgtgggaagctccccggtgataagtatgctgtttcttgttatatttttgttctttaatcttcacttttcactatgtttgggagtttgttgatgacatattaatgcacattttgtcctctgttcaatgtaggtattacacaccaaaaccaaatttccagttcacgtcttctgaaggattatataagtgtaaattaacattacctgttaatgcagccgttcaaacaatagttggtccactgtctaggaattctcatttagcaaagcagcttgtatgcttagaagcatgtaagcagcttcatcaaatgggtgccttggatgatcatctcactccatccattgaagagccttcagaaaatgcttgtatttctaaaggaaaagattcaggtgcaggtgcaggtgcaggtatatgcataaactttctaagtatgaaattcttgtttaatgattgattttgcaactctggtgtgagtgtgtaagaaaattttataacatccctcttcgtggtttttgataagtattgttgacctgagttcaaacttgaactgtattatttactaaatgtatagtactttctttcttgtgctcctggtcatcatctgcaaaaaagtgtgccttgctacttgcatcattaccattcaggctcttggtagcaataaaaaaatgaaaatattaataatagactacattttaatttccaagcatgtgcttctcaagttatggctagtagcgagcactaaaattcggttttgctttatggacatagtgctgctatgttacttgcattactggcacagaatttggccagcatttttgggatgtgaatttttgtttgggatattagttatgtctttgcttgtctttctatctaaaatcattgtttgcattttttagtcttgcagaaaataaaaaatggtttcatattgctgtttttccttctttctttttttgtggtacaaaggaactacaaaacggaaggagcttcatggaacaacttgcatacaggcattatgtggaagctggggagaaaaatctgatgatgctgttttctttgcctataaatttgacttcaaatgcaatatcattactgtggtttattctggatttgttcttctaattgaatcaaagcttgcggatgatgtggggaatactgaaatggatcttttcttgattggtaagatggttaaggctagcgtttcttcctgtgggcaagtgtatttgaatgcagaacaggtataaataaacctaatgttgtataattgttcttttttcctacatgaagtccttaatttcaattgcaatctcatgctcttctcttctctttgttttgtttttattttcttcactatagatggtgaaagcgaagcgctttcaggaatttttctttaatggcttgtttgggaagttatttgttggatctaaatcatctggagcaccaagagaatttctacttcgggataaaacaagctccttgtggagtccatcccacatgtatttgcttttgcccctcgaggataattcaactgatgaattgagaatacactggccagggataacagcttgcacattagctgcggaatttttaaataaaaattctttgttgggcactgagcaatctgatgatgatggaagcaatccatcattgaacagtactggttcacctgtgacatactgcaaagaaaccaatataatccgctttgctaacagttcagttgatgctaatagtcttagaaatacggtagtattggctattcacactggaagaatctactgcatcattgaagctgtgagtgataaaactgctgaaagttctttcgctgaaactgttgatacggtctcatcagagtttgctaccttctatgaatacttctacaaaaagtaagtgataggaatttccagctagtttttatgtatttctgcatcacaaagtggttcaaattacaacgttggctttgatcaggtacaatattgtgctgaaacatccaggacagcctttgatgctgttaaagcagagccataacccgcacaacttgcttgtgaattttaatgatgaaggtttgtaaatgttttagctacattacaattagggattatgtagatgcaatgcccccatcttgtagctctgtgatcattttatccagttcgttattcccaagacatttttctaggtgaaagtatcttacaggtccctcaattatagggacctcatcaaattagttcctttactattaaatggatcaatttagtcctactattgaaatgaatcaaataagcccaaattttaacggtgttaacatttactgtttaaaaaattgtcatttgtcatttactatttaacagagttaacatctttaaagctttacggttcttcaaatgaattattttgtttggagtaaaactgcgaatgaaaaaaaaatcatgtcattttttaaacagaaaatgttaaatatgttaaaatttgggcttatttgattcattttaataggactaaattgatccatttaatagtaaaggaactaatttgatgaggtccctataattgagggacctctcaggtgctttcacccattgttctacctccaatccaacaaaagtagaagttcttgattaccagttattgtggttttgattttcaatttctagctacttaaataaagtcttaaacctgaaataacactatgtaccttatgtccatgtgacttctaaatatttttccaatttctgagcaggtgtatcagctaaggcatcacaagctggcgtggttaatgaaaagcctcggtttcatgtccacatgccccctgagcttttacttgtccttgatgtcccagtgagtgttctaaaatcattgtacttactgccatcattgatgcatcggctggagtccttaatgttggccaaccaactcagagaagagataaacttttgttctagcaacattgatattccaagctcaatggttttttctctaaatctcctctaaactgtctgtttctgaaacgattcattactttaacaataatttgatatcttttttaaactaatagatcctggaagcattaacaacacttagatgctgtgaaagtttttcaatggaaaggctggaattgcttggggattcagttctgaagtatgctgttagctgccacctctttcttagatatcccaacaaacatgagggacaattatctgccaggcgttcgttggcagtttgtaattcaaccctgcataagttgggaactgaccacaaaatacaggtgctatttccttatattggctagaatccttgcgtaggctgagtcactgagatccatttttgatggatatatattctttgaggcaactgtttatgcttgttaataggatataatcattcttgctgttcattgtgcaccaatatctctatgtgtatctcctgtataatctgcctcctctaattgtataatttttaaagagatggtttctggctatgaatgatatgtttgctagtggaatattattgttctagcataacagagaacatgacacttgttgcttcgcaaaattatttaatgtttgtaccatgttgaaggatttataataatatattatgatcctttgtgctcaaaagcgggcaacattggtatttttgctttattgagttacatattgttttcaggttgtgtttaataagctggtttaaataagcagcagcggcaatgcatgggcttttcttttatcctttccaattcttgcattattgaaaactggagtctataatttaggcacagaagctgcccattctgctcgacttcttattgtttatgccagttttggcaaatatacaagtattacgaactgttgattgttacattggttttattttttatataacagggatacattagggacagtgcttttgatccccgtcgttgggtagctccaggacaacgagtgcttcgccctgttccttgcaagtgtggtgtggactctctagaagttcctttagataaaaaatttcagacagaagaccctaaagttaaggttggtaaatcctgtgatagaggccaccgatggttgtgttcaaaaaccatatcagattgtgttgaagctctcataggagcatactacttaagtggtggacttgttgctgcccttcatgtgatgaagtggctcgggattgatgccgaacttgatcccttggtggtagctgaggtcattaatcaggcatccttaagaacttatgtccccaattacgaaatccacatgatagagtcaaaagttggctacaatttttctgtcaagtttttcttgcaggaggcattgacacatgaatctttgcacgagtcctactgttaccaggtagttatggaggttctctatatatattcgagttctttatttttccttctttctctcagaaagtttaagtgatttggagtccaagaaggaaaagctcatacattgtgaataggatattgatgttaatcttttgttcctttttctccatgaagtggaataaaatagttttaatactaattatgaataatataaatacaactgtaaacagttgcttaggtcaatagatcccatgtgagctcacctttttacgtattgaaaattttctacagagacttgaatttcttggtgattctgtgttggacttgctgatcacccagtatctctacaaccatcacactgatatagatccgggtgagttgactgacctgcgctccgcttcggttaataatgaaaattttgctcaagttgccgtgcgccatgaccttcataagcatcttcaacattgttcaactttactatcaaaccaaataagtgaatatgtgcggtccttcactgaatctgataacaccaccagattagatcccagcataaaaggtcccaaggtattattaatcttttttatggtgcataattagaggtcttttatatggttctattgtactccgttactgttttcgatgcactttccatgttaccttatggctcattgaattgaggcgattattggccatggggatcagggatcttgacgatatataatctccactttctttgctacaggctcttggagacctggttgaaagtattgttggggcaattctgattgatacaaacctgaatcttgacaaagtctggagaattgttgaaccgttgttgtctccaattgtaaccccagataagcttgagctgcctccattccgggaactgaatgaattatgcgactctcttggatattttattaaggaaaaatgtaaaaataagggggaagtagtgcacgccgagcttctattgcagctagatcatgatttgttggtaggagaggggtttgatagaagtagaaaagtagcaaaaggaaaagccgcttcttgtctgttgaaggaccttgaggtacgcattcataaaagtttgtcaggacatgagaaaggagtgagtctggtcacatcagccatttaacttcacaattattcttcactccctgccttcctttgaccaatcagaagtttctttcatttcatataatataatattaaggttctacatttatgcttacaattggttatcatatgtgtgtctagtctttgtttctttaggtggatttgttgatttgtttgattcccttaggcttcggtcttttagatatgtagtcatgttcggtttaggctttagtcatttaggcatatagtcataaatccatcactgcatgttgagaactgattgtttgcgctaacattggcaatggtcctgatactccatgtcaacagaacagaggaatctccaggaagaaaaggaaacatgactgtgtggattcaagtcaaaccatggaagatgactcgttagaaccaacaatccctaagaggcaaaggagcgccgaaattcagttgcttgatgaatcaaagaaagcatgcagtgctacgcctgccaccccaggtatgtaaattgttggaggatattgactgcagtttaatgagccaactgaatgagctcaatggtaccatatactgaaccaaggcctggtactagaaataggaaaacatgtaaaatatcatccacagttaaacttgttatttgttttgttcttatagtaaatgagtgtactcatctagttcccttgtctttggatagttacatgatgtctttgtctaaaaaagaaataatatcagaggtaaattaattggctttaaacgtgaatatcttattggttccatcatgttaggaattaaaaccagattatgttttttttctgctttatgcaaacatgtctttgacattttcctctctttggtttctagttattgtaacagtaaaaacgaagaaaggagggccgaggaccactctttttgagctttgcaagaaactgctgtggcctatgcctagtatcaaagcaacagaacacaaatcaaggcatctctctttcatctcttgcaaatatttcatctgctgaagtttcatttcttgatctgctagtacattttcagtgttttgaagcatcactattactttcctttgcagtgctcccatggaaattggtgaaggtcccgagaggaaaaaagggtttatcagctttgtgtcgaaaatcatcttgaatgtcccaggatacgacattattgaatgcactggagatgcaaaagctgacaaaaaaagttcttcagactcagcagcactgtttatgctttatgagcttgaacagcgtgggaagctcatcatcgaggaaaccttataagtctactagcagttgaccatcaatggtgttcattaaaggtgatctgcaatatcctcactgtccagttattaacttttgactcttggtttaaaattgtaagcgatgactgtgagggctcgtaacaaaatatcaacgatatatcatgtatgtatatattgtccataatctaccaacaagccatgttaataaatctgcagttatttctgaattttatctatttgtcaatgttagggtgagtttggattggcgatgcgtttatttgcggttagtataaaaacagcagtagcggtgagattagatactttagcgtgagacaaaaagtaagctaaacataccgcactgcacccaatcgtccatccaaatctacccttattgttgtatatca

SEQ ID NO: 488 - DNA, 12386 bp, Gossypium raimondii; identical to SEQ ID NO: 487

SEQ ID NO: 489 - DNA, 8894 bp, Gossypium raimondii
tttaaagtccgaaaaaaaaatcgaaaaaaaaagggttggtaaaaaaagaaaaaaagaacagaagtagcagaagtgtatgattaatgtttaaaaaggttagatgagaatagcaaatgcattttggtagagcatcaggggagggcgaggctgagtctagccgataacttgtttttctccgttttgttaattttgtatcttaaatttatactttgttaaattacttcttgaattacatcatgattgtatgattcatgaaaattaaactattgtgctaaatgctgaaaacttttcattattactttttaggtctatatagctgtatagtattcaagttcaagctcaactcgccattcaaagttcatcttgagcttggttgagtttcggttttaaaattcgagtttgatttaagataaaaaattatattacttttgagtctatttatttaatctgcttcatacgggattataaacttggttatttgtgtttgaacttaaattcgatttaaatccatcattagaacacttagaatttaatttatccaatagttcgagtttggcttcaataatagcaggtaaaattacactagaggtctttgtattaagaattagattatattgtattttttttttataaaatgagtaaattagtccttatactttagataaaaaagtaaattggtcattttattaaaaattttatctatttctactattaaaaactagttctcatacatcattttgaagtacatgtggcacactatgagttactgtctgattattttatcaatcatgttagtttttaatagtacaaatagataattttttttacaaaaataattaatttactctttaatctaatatataaaaatttaattatctattttttcagtaaaaaacaaaatgcaaaaccttcgtagttttacgataatagtttaaaatacatctgtttcactctatgcatagggcagtataacgtgtcaactcataattggggcgtttatgtgcttctcccgatggcgggtaaatcaaacaactttcgtccgaatcttttaaacagcttcgtctgaatatggaaattttttctttttatggtagtaaacctggaactttctaatacaacaaaaaataagttattatatttttcataaatttaaaatttaatttttgtatttttattttcaaaattttaatctctttatttttaaaattttaaaattcataaacactaataaaattatttaattaaattcaaagtttattacaagattaattttttaattgaattactactaaataaaaatggtgtgaatttaatggaatcaatgtcgttgcattgcacagtctgcttcgcacccccattttctcatttttctcactgaaatattcgttcttttagaacttcacgtatatggtaattttcatctttatcctttctagtcgttttcatttcaatgataaaattttaatgtttgtctttttgtataaatactcagcatccaacatgcattctcccatggaagaagagcagtgttaccctctaaaaacaaccttcagtgaaacacacttacacccatctcagattatggtttcaatcaatgacgatcatgctaagaaccaccacccttcttcatcttcaaatcctgatcactctagccctagagggtttgcccttttcttcctctttttctttctttttttcctttattttttcagtttttgttaatttttcctttttctgtgtgtgttgtaggcatcagctgcaggtgtatgaagttgcaaagagaagaaatatcatagcagtgttagatacaaaatgatagctgtaatgcttatcaaagattttgttcaacctatcaactccattgataaaaaaaagttgattattttcttggcccccactgttcatcttgttaatcaggtttacttctctttatttttcctggaaagtttaaaaatttcttctggtaatgcaaaaaaaaatgatcattttaagttatatatctatgtatatattgttcatattgtgtgttttgcagcaatttgaatatataaagttccatacaagtttggatgttgaacaatattatggagataaaggggttaatgaatggaactcagggtattgggagaaagacataaaggagcatgatgtaagttctctttttaagttatgctaattcacgaaatctcttatttatttgtttgctatgttaatccgaatccgaatctttatttttctcgaaatacatatatttaacagccgtatctaacatatatccggacattaaaatcttgaaaaggaaaaaaattgaacgtactcatgcccgactctcacatccaagtccgagtaacatgtttttacttaattgttcatatcaatgattttattatgttcttgatcttgtaggttcttgttatgacaccccaaattctgttggatgccttgtggaaagcattcttgagtttagagatggtgtccttaatgataatcgacgagtgccaccatgctaccggtaaccatccgtatgcgaaaataatgaaggtcgggaatccgaaccctgtttttgctagaacttgatgactattactttatttttgatattttcatctgtttgttttctgattaatagtggtgacattgttctgttcttatttcgggttaggaattctatcacaaatcgaacaacaaaccgaagattttcgggatgacggcatcgcccttagttagcaaaggtaagtttttgttgttacttttttctttccatcttatattgaattgatcttatgcttttaagggtttttggtaactcaactttgtgtaggtgcattatccaacaatgattgtgaggatcaactttcagaacttgaaaatgttatggattgcatggtattcattatttctgttcctttaaaatctttttcgttagatttaatcggtttgctcaaaaaatcgtatgttaatatgtgttgctacagatatatgcaattgaagacatgacagagatggaaacatatgttcctacagcaaaagaaagttgtaggtttttcgatccaacacgattttgtagttcgggtttgaaagcaatgatcgaagcctcgtggttaaaggtatcttttcacttaatataagtgatgcaaatgcaagtaggaatatactttgttaatgtgaatgtatcttgcaaatgtatatagatagatgcttcattatcaacgttgcaaggctcgattcaaacttcttatacagacatggatgataagtttaaggccctccataaacggtcatccaatgaccatgctaagattctgcattgtctcgacgatcttggtctcatatgtgcttatgaggtatgatcatgttatgctcttgtaacacaaacacggtttgttcaggctttacattgtttgtttcgtgttacttctttcataggctgttaaagtctgtcttgagaacatccctgatacaaaagaggagtgtgaagcatataaagaaggtgtattgcagtgcaaaaggttcctcaacgaagtgctacagataatcagggaatcccttcccctgggtatactatgctgtaactcttatcctacttcatttggttcgcaccgtatttagagaagttaactcatctcatctcttcaggtgatgaaaattttctgaattccgggtttgactacttaaaggcggtagattcgggctatatatctccgaaactgcatgaactaattgaatttttcttatcactcgggtaataggaagccttaatggttagtttctttgaatataataacaatgttggcttaatcttacttttcgaggttgcagagaacctagtcaagtattgtgcctcgtttttgttgaaagaattgttaccgctaaagtaattgaaagatttgtgaagaaagtaagttgtttatcgtgttttgtggtttcgtgtttgactggaagtaatacgtcagttgattccatggcaccaaagattcaaaaggaaactttggagtaatgtcaatccgggaaggtatgtgatctatatgatagcttacttgtatgcactgatgattagatattttatggtcaatgattgtggagtttgctcaggtgaatctactttttgctaccgatgtggtcgaggagggaattcatataccaaactgctcatatgtgatacgttttgacttgccgaaaacagtgttgagttatgtacaatctcgaggaagagctaggcagagtggttcccaattcatcatgattctagagaggtaaaatcgtgttcgttgctatgcatgcacgcatgcaatgctcgtccattataattccgactctatttagggtactacagcgtagaatctaactgatgcattgacaggggaaatgagaaacaaagagatcaactatacgatctaattcggagtgaacattcaatgacgaatacagctatgaatagagatcctgatctatctcttccggaaaaccgtacattggaagaaacaaatgtttctatcgtggctgctactggagcttccattgaagaaacttccaaaaatcgttgcgcttctaaaggaaaagatcccattttcgattcaggtgcatgtatatatatagataaactttcaaagtctaaaacttgtgtttaacgatagaatatggcatgaaataagtattgttgtcttgagttcaaaccggaaccatatggctcattactatgatcgatctccgtgttcgcttgcttaaattccgtatgtaaaactgtgtccaggtcgccttagttattgcttttgcttttcatagtaaattagcttcatattcctttcttttgtgtggttcaaaggaactacaagatggaaggagctgcacggaacaactcagattcgtgcattttccgggagctggggagaaaaagccgatgcttcagttttctttgcctataaaattgacttttcatgcaatgttgttagcgttgtttactctggatttgttcttctaattgaatcgaagtttactttggatttgttcttctaattgaatcgaagcttactgatgatgtggggaacatcgaagtagatctttacttgatcggaaagatagctaaggctcgtgtttctttttatgggaaagtacatttggatgctgtacaggtataaccatagtgttaacattgttcatgtttttaacccctgatgaagtacttacagttaatcttgttatatgtttttaattttcttcactctagattaccgcagcaaagcgttttcaggaaattttctttaatggcttgttcgggaggctgtttgttggatcatccagaacatcgagggaacttttatttcatagtaaaacgagcttgttgtggcatccatttaacatgtatttgcttctgcccctagaggatagtttgagtaatgaactgagaataaactggcctgggataacagcttgtacattagctgtagagtttttaactgctgacggtaacagaggtaatccgtcattgaaccaaactgattcatccgtgacagaacacaaggagaccaatgtaatccactttgctaacagatctatagatgttaacaatatcagtaacatcgtagtattggcaattcataccggaagaatctattccaccattgaattagttcatgatacatccgccaaaagttctttcaatgacattgttgatatgaactcattgaagttcgcgaccttctccgaatactacaacagaaagtaagtcattggtgattttagcaagtgttgttttatccacatggtttttacggttccactgacaacaatagctttgatcaggtactgcatcgtgctgaaacatccaggacaacctttattgctgttaaagcagagtcataacccgcacaacttgctggttgattttaacgatgaaggttggttcatttgctacctgtaatctgtcgaaaaatagtactaacttattataccttatgttctaatgatttctaatattttccctttactaagcagattttcagcacaagcattacaagcaagctcggttaatgaaaagtcatggaatactatccacatgccacccaagcttttgctcatccttgatgtcccggtctatgttctaaaagccttttacttactaccatcactgatgcaccggctcgagtccttaatgttggctagccaacttagggaagagatcgattttcgttcaagcaacttcgatataccgagctcaatggtttgctttattgctttcataactttgattgttttggaaacaagtctttcctttaataataatttgatatctttctatgctatagatcctggaagcgttaacaacgcttagatgttgtgaaagcttttcgatggagaggctggaatttctcggtgattcagttctgaagtatgctgtcagctaccacctctttcttagagatcccgagaaacacgaaggataattatcaatgatacgttcattggcactgagaaactcgacgctgcataagctgggaactgaccgcaaattacaggttcgtattttgttgtatctgtttgaacccttcttgctcattaccgggatatcatggtttttaatgctcattgtgcgtctaatatctcgacatattgtcgcctgtacaatatgtttacttcccgttgctattatcgaatattggagtctataactaggcaatgaagtatctgctaattggctacattgctttgatttcctatataatagggttacattagagacagtgctttcgacccccgacgttgggtagctccaggacaactacgtcttcggtcttttccttgtaactgcagggtggactctcgagaagttcctttagataaaaagtttcagactgaagatctggaaattaaggtcagtatatcttgtgatagaggccaccgatggatgtgttcgaaaaccatatcggattgtgttgaagctctcataggagcatactatgtaagtggtggactcattgctgctcttcatatgatgaaatggcttgggatcgatgccgaacttgatccctctttggtagctgaagccattaatcgtgcatccctacaatcttatgtccctaatgatgaaatccagattatagaatcgaaaattggatagaaattttctatgaagtttttcttacaggaggccttgacacatgcatcggcaaacgagttttactgttaccaggtagttatggaacttctctacttgtctttaaattgtcaaattggccgaataatataaatgcaagtgcatggttcgtatgtgaactcaccttcttttacttgtttaaaattatctatagaggcttgaatttcttggtgattccgtgttggacttgctgataacccgatatctctactgcaatcacaccgatatagattcaggagaactgactgacctccgatcggcttcagttagtaatgaaacttttgctcaagttgctgtccgtaatgaccttcataagcatcttcgacattgttcaactttactattggaccaaataagtgaatatgcacagtccctccctgaatcttgggacactacacgatcagtacccggcataaaaggtccaaagatatgttcaagtatcatcttttttatactaaagaattagagatagagtttccattttttatgcaacttccatgtctaccatgtggctactagaacatttatcagccattcgagattgtactttacggtctctactttctttgcaacaggctcttggagaccttattgaaagtatcgtcgcggcaatcttgatcgatacaaacctgaaccttgacgaagtttggagaattgttgagccattgttatctctgatcgtgactcccgataagctcgagttgcctccactttgagaactgaatgaattatgtgactctctcgggtatttcataagggaaaagtgcgttaatacgggagaaatggtgcatgccaagctttggttacagctggatgatattttgttggtcggagaggcattcaatcgaagcaaaaaggtagcaaaaggaaaagcagctttatatctattgaaggaactcgaggtatgtgcctattacgatttaaagctttccaagatacggaaaatgagtgagggtagtcatgttgagatcaacaattgatccataagtatttttcaggatagagggatctcccgaaagagaacgaaacaggatcatgccggttcgagtggaaccactgatgatgatttgttagagccaaaaatgtgcaagaagcagaggatagctgagattccttctccgactaacgactcttcaaggacagcatatggagctgagattccttctccggctaacgcttcttcaaggacagcatatggtttcagctccgacgccctagggatgcaacattaagttcagaatttggtattgaaaccgtatgattttctacttttcgtcatctcgaggatctgcattatgcaatctaccatcgtgaatttagaacataacgagtacatttctctctttccgtttttatagttattgcaaggataaacacaaataaaggacgaccgagggccactctttacgagatttgtcggaaacagttatggcctaggcctacattcgaaacaacagaaggaagatcacggtatgtccttttcgtttctttattttaaggttttggtttttgatttgctacagctttcccttgcagttctcctatggaaatcggcaaaggtgcagaccgaaaaatcgggtttaacagctttgtaacgaagatcaccttgaatggaccgagttcaggcattattgaatgcagcggagatgtaagagccgacaaaaagagctcttgtgactctgcagcaatccttatgctttacaggcttaaagagctagggaagctcatcatccgcgaatcctag

SEQ ID NO: 490 - DNA, 5957 bp, Gossypium raimondii
ttatattaaaaatgaaaaataattataaaatgtgcattcaccattataaaccttggttctcttttttctttaatggttttaagtttttggaaaatgttaaataactgcttaataatttttgtcttaaataaaaaaatcaaattaaatatttttttcctcaaataaataaacgctgatatcataagtattcaaaaaaaaattgttaaggtaatatttatatataaaaacattgaattactgacaagcagcggcggagtcaagatcttaaaatgaattttttttcatttagactatttataatttattaaaatttaaattagtaaaggtaaaaatacactttagccccttaaaaataataaaaatttgattgaattctttaaaaattataaagatatacattattaaaatgataaaatcgtactttttctatcgtaaaaatatacaatttaatttatataaaaacacaaattgatggaactcattttagatgcccaaacacggccaaattccattgacctttcttttattgcacgtctgatcaagttgttaatagaataagggctaagctaatctcacatgacatgaatatatacatattaattaatataatataattagtaaaaaataaaaaaatctttaaaagtaataaatactttttagaagatacatttatatatatttatataaaatttataaaataatttaaatctaaaaaagtgtcttaagagaaaccaactcattagttaaagatttaaaaattgttctcttgtaaaaggaacaaattttatcataattgtgatttttttccttttatcttttcataaattttataaaaataatttatgcccataccaattttattaacttatttttagtgattttattttattttattgattgttatattgataattttattgacataacataaagttgataatttatacctacaataaacgacttattaggtaaacgattaatatatatggagatatccaaacttattaatttataactagcttgatacatatgttttatttttttacttaattggtacctaaatttagaaaccaacttggtaaccgtgatagtcaaatatctttaaaaaaatactaaattgatttataattttcagatttaagtaccaattaagtctgaaaaatttaaatacaaagtaagtacaaattacgaaatttaatttagttaacttttaatatattaataaatttctaattttttttttgttttgcccatcaaaaagtctttctgcttaaatttcataatgattaatttaataaaaaccacaacgacagtagcagtagcacaaacggtccgtacaaccggctcagcgaaacgacaacaaaagatgcaaaattttactgcgtaaaagagttaacgtcaaaactcaaacaagaaaaaaccctcatcgaaccgacgcgtggcgggagatcttagtttaacctttttttttactcattatttattaagaaaagattcaaaaaaaaaaaaaaatccacggccatagccaaaaccttctactttgattcctccattttcgttccttgcatgcatcagcttttctcttcttcttctttttctgcaccgactattgtgaactgcactatcgacttaacggatttctttgagataatttcaggatcagattaacaattttgtctttgattcgttgatgtaaatttcccatcactgaacaaattgataaaatcattaattactgtttgttcccttgatttcgatagtttcaatgatggtttctcttttgctctttctgtttgtttccgagaaacgattttctttttcagctgtttagtcgttcgttttaattttacttgctcggcctcagtttattcagttaggaaatataagcgtcgaaaatttgcattgaatttttgcaatcagtttatctgtatttatatactaatcttgtttattctaatttttattttatttttttataaacgacttgatattgaataaaaattatttataactgcaatttatatttcctttttgtgaatctttattctttttcctaattttcctttgtttttttgacaggttgagaagcttttcttggcccatactacaagtcaaaagaatggtattattatttttgttgatttagttgtattattcgactgaccaaaagataagagaattgttatagcttaatataatgcatgctaacgctcatgtaatttctgtaggttgacaataattcgggtggagaagctgataattttgactgggatactgaagatgatctggaaatcgataattatgccatctcggccccttcgggtttgtctactccctgtggagaagctgttttgggttcggcagaggtacatgctcatgtgtaattagtttaaatagcattttggaaaggtacatgctcattgttaacttttactgcctcaaggcgggctcatctggaaattctcccaattccaagataattgatcattttgtcggaatggggttctcaagagaaatggttgccaaagtgattgaagaaaaaggttaagcttataggtttcttttacttagagcagaagtttccacctgagaattcgcttatagttctgctttgaatggtgtccaggagaggaaaactcagacttgatacttgaaaccctccttgagtactcggtgagttattgtgttgtgtatgctcttctaagatgcttctagttgcatgcgtcatgatgctagaaagttgcttcacatgctcttgtcagaattttactgctgactttttggtttttttagattacagatatcattactttattaattattgattcccctttttggtatgaaggcaagcacattacctagttcttccaattccaagttgatcgatcattttgtagggatgggattttctgaagaaatggttgtcaaagtggttcaggaaaatggtaatgaccctttctcatttccttggcagtcagttttcacctcaacaactttatatctgatcttgttctttatgtttccaggagagggaaatacagattccatattggagactctattgacatattcagtaagctatacacctgaaccttgtttcccttaatagtaatcttgataacgatgcaattgcaaaactacttgtttagtggcttaggtgatatttgccaatcctcctcaactagatttgtctgtgcaagttgttggagtacctcacaaagaattgtttattgtttctgtactttgatgaatgacctacttaaaatttgcaggcacttgaaacaactgctcccgttcagcaaaatcctgactctggtaactgctcatcagattatgaagggagtttgctgaatgatttctctgattttgatagtttttctgagaccgaggtatctaaacttgctttgattattttgtttgctcaattttctgacatttaaaaaaaaaattatcttttaccaatgaaaattttattcttgaggtggttttgcctttcttctttgtatctgcttggacaatataatgtgacctttagccatttgatttgtatttatgtagatgctacagttcggctactgatgattatgtatgttaacttgcagatgatttgagtatgtttttacatttatatttctttgttccaggaaattattagtcctagttctgaggaggggagaaaattgttacacttgacaaaaatggggtactcagaagcggaggcttcagtagccatggagagatgtggtttgtgttatcttattcatatttgcaatatattcttgttgatggttggtaggatgtcaaagtttcatttggacagtataaaggatcctagactcttcaattgttgtattgaaaatggtaaactttcatatctgtcatatatgattggcaatcaattttatcctaccgtagaagaatgttaagatcaattctcatttttactattctgtttataaaatactcaagttgcaagtctcagtagtccatagttgctttgggctttacagactaaaattgccccaacttccttttaaagaattctgagtgttcaactatgaaccttttaggtggcacccttgggcttctgtctttatagaaggtttttgcgatacttaggttttatccttggccatttttaagttgtaagagagtggtcttagttaagaattcaggttatatcttaacttcaaatgttgcaggtccagactccacaattgaggagttaacggactttatatgtgctgcacaaattgcaaaggctgctgatgcactttttccacttgaagacaaggtagtttcctttccttttttcgaacactccagacttgcaatactgtttctatatctttcatagtttgttcttttctatttactttttcaacttgttgcagatttcttcttactatttctgtaaaactttcaccaatgattttcaatctaattttgtagaagccattcagcaatggctctagtcacaagaagaggcgaaactggggttatgatttgttgttaaggaagaagaagcttaagcttgaaaagaggtttgatgaagatgatgatgtagttcatcttcctaatcctatgattggttttggggtccccaatgaaccagatcagatcactcatagagtacttccagaagcagctttagggcctccatacttctactacgagaatgtagcacttgctccaaaaggtgtttggaccaccatttcgcgcttcttatatgatgtggagcctgagtttgttgattcaaagttcttttgtgctgctgcaaggaagaggggctatgttcataatctgccaattgacaatagatttccccttcttccatttcctccacgaactattcatgaagcttttccactaacaaggaaatggtggccatcctgggacacgcgaacgaaattgaactgcttgcaaacctgtatagcaagtgcaagattgacggataagattcgcaaggcattagaagattctgatggtgaaccgctgttgggcatccaaaagtttgttctcgaacaatgcagaaagtggaatctggtttgggttggaaggaacaaggttgctccacttgaacctgatgaagtggaaatgcttttgggattccctagaaaccacacaagaggagggggaatcagtcggacagatagatacaaatcacttggtaactcatttcaggtgcgtgattcttcctatctttttcatgttctgttacttttttttttttacaaatactgattataacacaggaatgcaatgcaaagtatttagactatttcaagtgattacccaagttttgaaataattctttcatattgctgtccgatgtgcacaaattctcatggttgagatattgtgcttatagaagaattgatttcagattgacacagtggcgtatcacttttcggttttaaaagataagttccccggtggtatcaatctgttgtctcttttctctgggattggaggtgcggaggttgctctccaccgactcggtatccctttgaaaaatgtggtagcggtggaaatagctgaagtgaaccgaaatattcttaggagttggtgggaacaaacaaaccagagaggtactttgactgacatccaagatgttcaagaactaaacggggaccgtttggagcaactgattaaaaattttggaggatttgaccttgtggtgggagggagtccttgcaacaacctcactggcagcaatagatatcatcgagacggactcgaaggtaaagattctgccctcttctttgatttctgtcgaatactggatttggtgaaatgtattatgaatggcacgaaatcaatgattgtctgaagaagattgcatttgaaataatttccgaaactcctcttaatatcaaattaaaagggaaatgaagtgctgtttaagcaaatatatatttatcattccggcttactcgtcgtattagacactgttt

SEQ ID NO: 491 - DNA, 5957 bp, Gossypium raimondii; identical to SEQ ID NO: 490

SEQ ID NO: 492 - DNA, 5324 bp, Gossypium raimondii
tgacatgaatatatacatattaattaatataatataattagtaaaaaataaaaaaatctttaaaagtaataaatactttttagaagatacatttatatatatttatataaaatttataaaataatttaaatctaaaaaagtgtcttaagagaaaccaactcattagttaaagatttaaaaattgttctcttgtaaaaggaacaaattttatcataattgtgatttttttccttttatcttttcataaattttataaaaataatttatgcccataccaattttattaacttatttttagtgattttattttattttattgattgttatattgataattttattgacataacataaagttgataatttatacctacaataaacgacttattaggtaaacgattaatatatatggagatatccaaacttattaatttataactagcttgatacatatgttttatttttttacttaattggtacctaaatttagaaaccaacttggtaaccgtgatagtcaaatatctttaaaaaaatactaaattgatttataattttcagatttaagtaccaattaagtctgaaaaatttaaatacaaagtaagtacaaattacgaaatttaatttagttaacttttaatatattaataaatttctaattttttttttgttttgcccatcaaaaagtctttctgcttaaatttcataatgattaatttaataaaaaccacaacgacagtagcagtagcacaaacggtccgtacaaccggctcagcgaaacgacaacaaaagatgcaaaattttactgcgtaaaagagttaacgtcaaaactcaaacaagaaaaaaccctcatcgaaccgacgcgtggcgggagatcttagtttaacctttttttttactcattatttattaagaaaagattcaaaaaaaaaaaaaaatccacggccatagccaaaaccttctactttgattcctccattttcgttccttgcatgcatcagcttttctcttcttcttctttttctgcaccgactattgtgaactgcactatcgacttaacggatttctttgagataatttcaggatcagattaacaattttgtctttgattcgttgatgtaaatttcccatcactgaacaaattgataaaatcattaattactgtttgttcccttgatttcgatagtttcaatgatggtttctcttttgctctttctgtttgtttccgagaaacgattttctttttcagctgtttagtcgttcgttttaattttacttgctcggcctcagtttattcagttaggaaatataagcgtcgaaaatttgcattgaatttttgcaatcagtttatctgtatttatatactaatcttgtttattctaatttttattttatttttttataaacgacttgatattgaataaaaattatttataactgcaatttatatttcctttttgtgaatctttattctttttcctaattttcctttgtttttttgacaggttgagaagcttttcttggcccatactacaagtcaaaagaatggtattattatttttgttgatttagttgtattattcgactgaccaaaagataagagaattgttatagcttaatataatgcatgctaacgctcatgtaatttctgtaggttgacaataattcgggtggagaagctgataattttgactgggatactgaagatgatctggaaatcgataattatgccatctcggccccttcgggtttgtctactccctgtggagaagctgttttgggttcggcagaggtacatgctcatgtgtaattagtttaaatagcattttggaaaggtacatgctcattgttaacttttactgcctcaaggcgggctcatctggaaattctcccaattccaagataattgatcattttgtcggaatggggttctcaagagaaatggttgccaaagtgattgaagaaaaaggttaagcttataggtttcttttacttagagcagaagtttccacctgagaattcgcttatagttctgctttgaatggtgtccaggagaggaaaactcagacttgatacttgaaaccctccttgagtactcggtgagttattgtgttgtgtatgctcttctaagatgcttctagttgcatgcgtcatgatgctagaaagttgcttcacatgctcttgtcagaattttactgctgactttttggtttttttagattacagatatcattactttattaattattgattcccctttttggtatgaaggcaagcacattacctagttcttccaattccaagttgatcgatcattttgtagggatgggattttctgaagaaatggttgtcaaagtggttcaggaaaatggtaatgaccctttctcatttccttggcagtcagttttcacctcaacaactttatatctgatcttgttctttatgtttccaggagagggaaatacagattccatattggagactctattgacatattcagtaagctatacacctgaaccttgtttcccttaatagtaatcttgataacgatgcaattgcaaaactacttgtttagtggcttaggtgatatttgccaatcctcctcaactagatttgtctgtgcaagttgttggagtacctcacaaagaattgtttattgtttctgtactttgatgaatgacctacttaaaatttgcaggcacttgaaacaactgctcccgttcagcaaaatcctgactctggtaactgctcatcagattatgaagggagtttgctgaatgatttctctgattttgatagtttttctgagaccgaggtatctaaacttgctttgattattttgtttgctcaattttctgacatttaaaaaaaaaattatcttttaccaatgaaaattttattcttgaggtggttttgcctttcttctttgtatctgcttggacaatataatgtgacctttagccatttgatttgtatttatgtagatgctacagttcggctactgatgattatgtatgttaacttgcagatgatttgagtatgtttttacatttatatttctttgttccaggaaattattagtcctagttctgaggaggggagaaaattgttacacttgacaaaaatggggtactcagaagcggaggcttcagtagccatggagagatgtggtttgtgttatcttattcatatttgcaatatattcttgttgatggttggtaggatgtcaaagtttcatttggacagtataaaggatcctagactcttcaattgttgtattgaaaatggtaaactttcatatctgtcatatatgattggcaatcaattttatcctaccgtagaagaatgttaagatcaattctcatttttactattctgtttataaaatactcaagttgcaagtctcagtagtccatagttgctttgggctttacagactaaaattgccccaacttccttttaaagaattctgagtgttcaactatgaaccttttaggtggcacccttgggcttctgtctttatagaaggtttttgcgatacttaggttttatccttggccatttttaagttgtaagagagtggtcttagttaagaattcaggttatatcttaacttcaaatgttgcaggtccagactccacaattgaggagttaacggactttatatgtgctgcacaaattgcaaaggctgctgatgcactttttccacttgaagacaaggtagtttcctttccttttttcgaacactccagacttgcaatactgtttctatatctttcatagtttgttcttttctatttactttttcaacttgttgcagatttcttcttactatttctgtaaaactttcaccaatgattttcaatctaattttgtagaagccattcagcaatggctctagtcacaagaagaggcgaaactggggttatgatttgttgttaaggaagaagaagcttaagcttgaaaagaggtttgatgaagatgatgatgtagttcatcttcctaatcctatgattggttttggggtccccaatgaaccagatcagatcactcatagagtacttccagaagcagctttagggcctccatacttctactacgagaatgtagcacttgctccaaaaggtgtttggaccaccatttcgcgcttcttatatgatgtggagcctgagtttgttgattcaaagttcttttgtgctgctgcaaggaagaggggctatgttcataatctgccaattgacaatagatttccccttcttccatttcctccacgaactattcatgaagcttttccactaacaaggaaatggtggccatcctgggacacgcgaacgaaattgaactgcttgcaaacctgtatagcaagtgcaagattgacggataagattcgcaaggcattagaagattctgatggtgaaccgctgttgggcatccaaaagtttgttctcgaacaatgcagaaagtggaatctggtttgggttggaaggaacaaggttgctccacttgaacctgatgaagtggaaatgcttttgggattccctagaaaccacacaagaggagggggaatcagtcggacagatagatacaaatcacttggtaactcatttcaggtgcgtgattcttcctatctttttcatgttctgttacttttttttttttacaaatactgattataacacaggaatgcaatgcaaagtatttagactatttcaagtgattacccaagttttgaaataattctttcatattgctgtccgatgtgcacaaattctcatggttgagatattgtgcttatagaagaattgatttcagattgacacagtggcgtatcacttttcggttttaaaagataagttccccggtggtatcaatctgttgtctcttttctctgggattggaggtgcggaggttgctctccaccgactcggtatccctttgaaaaatgtggtagcggtggaaatagctgaagtgaaccgaaatattcttaggagttggtgggaacaaacaaaccagagaggtactttgactgacatccaagatgttcaagaactaaacggggaccgtttggagcaactgattaaaaattttggaggatttgaccttgtggtgggagggagtccttgcaacaacctcactggcagcaatagatatcatcgagacggactcgaaggtaaagattctgccctcttctttgatttctgtcgaatactggatttggtgaaatgtattatgaatggcacgaaatcaatgattgtctgaagaagattgcatttgaaataatttccgaaactcctcttaatatcaaattaaaagggaaatgaagtgct

SEQ ID NO: 493 - DNA, 6344 bp, Gossypium raimondii
tcaagttaaaattgtactttaatcctccctaaaaatgataaaaattctatttaatcattttaaaaatataaagatgtaatgtattcaaaagataaaattatatttttactatcgtaaaaattaaaatataatttcgacttccctataattttttttatgtctttgtctcccactaagggcttgtttagtagtacttaaaaaaaaacacttttagcttgaaaaacatttttgaaaaaaaaaaactatgctaaacaagttacctttgattgaaatttttgactttttaaaaaacacatttgaaaaacacttttgaagatgaaaagtatttttggtgcttaattattttttcacccctccaacaacatattacttttcctcctccttttttttcttggtacttaatttcacatatgttaaattcattaattaaaataaattctttttttaaaataatacaattgtgttaatattaaatggttttatttaaatattcacaatataatttatatattataattaaattttataaataattaatatttattgcttaaaaatatttaaaatttatatttcatatattaaaatattaaccacaagttataataaattattttttatattcttattaaaatataataatactaactaatttaaacattatttaaatgcatatctgctactcgataataccatatctaaaatagatattttatttctgaaaagtattttttaataacaatactaaaccaaaattttcaaaccatttctcaaaaacattttttaaaagcattattaaactagcattaaattaggacagttgtggaaaatttttatgtaaaacataaacaaataataagttttaagttaaaaaattggagtttttaaaaatcaaatagcgtccatggcgtccaataatttcaattcaacagccaaacaggcccgagattcgatactttcacttccatctatacggtctcgtcaactctcaactaaagtggggaaaagataatctcacatgcgtgtggatgaaaattaatatatattagataatttaattaatttgaattagaattagaattatcaatacaatttataaaaataaacttaaattttaatttattgattgggtgttcgcttttttaaaaaaaatttgaatttaaattgctataaaaaatttaaaacaacttaatttaattagaaggataaccagtttataactgaactccaacgacctcgcagtggcacgattattccatgctacctacagaggaaaacggaaaactgctgcaaattttaactgcgttagattttatttatttattaatctactttacttttcactgcccctcaagaattccgattccctttttatttataatataaaaagaaataatataatatttttataaataaagaattataacacttttttttctaattaaatatattatttttaacacgtaaataaattatgtcatattttttcaataaattattataaatatttataaataattacataggtgactttccaaacacaatcatagttatagaaaaaaattgaaaaaccctgtgaaaactgaacccacagctcctcgtttcctcttcttctccgttaccgccgttggggcttcccctatgtatattttatttctttttctccaccggtaacttctgtgtcagaactcgtcgacgatcgccgctgctgccgtgtatccttcttctttctttgtcctttcctccattctctttccttttcctccttctgttttttttcttctcttctcagttctcccgctgccgtgtccgtcggtttccgccggatctgatctcgtattcagtgtcggaaatccgtgtcggatcgtgtcgacactggtacggcacccctaattgccgagtccgggtaacggagttctgataagttttcattgtttcttttacaggttaagaaactgttcttgggctgtactatagctcaaggaaaatggtactctcaagttctattacttttttattccttaatgttatgtgtcgtcgtaatattcttcctgtatttttctaaaaattctcatttgtgcactaggctgtcagttggctaaaagaaatgaaaattctttagttatttaatcttatatatattgtatttgatattatgaatttgtgtgtggttttgtaatttttgtaggatcaaaatggttctggtggtgatgctgataattttgactgggataccgaagatgagctggaaattgataattatgcaatcgcctctcgctcaggagtgtcacttaccaatggggaagctgttttaggcacagcagaggtacttgcccatgcataattgcatcacatggcattctggaaattttaacatgcaaatcgttttaatgattatgaaaattatctacgatgaagttttctttcatttttaatttccaaagaaacattatagatattaattgatgagttcctatgggaattttctctggaggtcactgtagtttcgcatctccttttcatgcactgctttatttagttgatgacattactaatgtccctggcttaaatttcattgattagcctccatagcaatgaatatgtatgccaaaacgaactcacggttaacttttattgtctcaaggtgagctcgtctgcagattctccgaattccaagttaattgatcattttgttgggatggggttctcccaggaacttgttacgaaagcaattgaggaaaatggtaaagcttctaggtctttactacttagagcacaagtttccatcttaactcatttataatcctgctttcctattgtccaggagaggagaattcaaatttgatacttgaagctctccttcggtactctgtgagttgtacatcctatttaaagatgcttattagttacacaccccttgatgatagagagctgctgcggcttttgtggtggaactgttactgttaaattactgacgttttagtgtgcagatttcataataagttcttgatttctctttttcgcatgcaggcaagctcgttggctagttcttccaattccaagttgattgatcattttgttgggatgggattctctgaagaaatggttctcaaagcggttcaagaaaatggtaatagtcctttctcattttattagacatcacttttgacctctattgctttatctgtggtcatgtctatattttcaggagaggggaatacagataccatattggagactctattgacatattcggtaagctgtacacctgaaacctttgtttagttatttctgaagcatttattatttgtttgggaaagaaacctattgacgttacttggaatcttgatattgatgcaataacaagtcaacatattcagtggttcaggtcatattgacaatcctccccaaatagaatcatctttccgttgttgaactatctagcaaattagttgtttgctctctctgttatatcatgaatgattaatttaagattgcaggctcttgaaaagtctgctcctgtgcaacaacatgctgattctgatgacttctcgtcagattgtgaagggaattttttggatgatttcacagatattgatagttcttctgataccgaggtatctatcctttaatgttacatttgcacaatttgcggaaatttctaaaagttaccttttgtgaatacaatgagaaaatttaattttaaaagctgttgtgctttagttttctagccacatggataataaaatgtggcctatagtcattgatttgcctttttctttttatagattttataatttagttactgaatagttatgtattttatcgcattttacttgtagattatttatgtatgttgtttctttttgtatttctgtgctctaggaaataattaatactggttctgatgaggagagtaaactgttgtacttgacaaaaatggggtactcagaggctgaggcttcagtagccatggagagatgcggtgagtgtttttatttttttcagaggaagaacaacaaaacacaactttagatttggtgccatgttaagcatcctacacaacagattgattacatgcgaaggacatgacttgaatacaggaccacacgaaagcgaataattaatagatgtggaataacaccacttaacataaagtatcaaaattggaattcccaataacccattgcagacatgataaatttgctccaagggtctgtacttgtagggaaacccaagtgttttctttaacccaaggtttcagtaattaactttctctctctttggcttccatctttataggagaagattgtgatactttggaggttttatcctaagtcttttatgttgcaagaggggaatgtatttcttgcactaacattagctcttcaaatattgcaggtccagactcatcaattgcagagctgacagactttatatgtgctgctcaaatggctaaggctgctgatgcacttttccctgttgaagacagggtagtctcttccccctttccaagaattcacttattatacgctttctgaatattttgtactttattgtttcatgtttacattttaattaagagaatatgccaatttgctgtagtttctgtgtatgattttcggtaaaacttactcttgccatccaatctaacagaagccattctgcaatggctctaattacaataaaaggcgaaacttgggctatgatttgtggaaaaggaagaagcagatgaagcttgaaaagaagcttcttaatgaagatgatgatgcccttcatcttcctaatcctatgattggttttggggtcccaactgaaccagatctgataactcaaagaacacttccagaagctgctgttgggcctccttatttctactatgagaatgtggcacttgctccaaaaggcgtttggagcaccatttcacggttcttatatgatgtggaaccagagtttgttgattccaagtttttttgtgctgctgctcggaaaaggggctatattcataatctgccaattgagaacagatttccccttcttccatttcctccacgcaccatacatgaagcttttccgttgacaaggaaatggtggccttcctgggacccaagaacaaaattgaactgcatacaaacatgtacagcgagtgcgagattgacagaaaggatccgcaaggctcttgaagcttatgatggtgagccacctttgaatgtccagaaatacgttcttgatgagtgcagaaagtggaatctagtatgggttggaaggaataaggttgcgccacttgaagctgatgaggtggaaatgcttctgggtttccctaaaaaccatacacgaggaggaggaatgagtcggacagataggtataagtcacttggcaattcattccaggtgtgtgacttttactctttttctttcccataattgcttcattcctatattaatggttatgattcatgaatgtggactatgtttctgctattatttgattccttttgagtaattctttggtttcgagatacatgatccatgcttgcagtattgtgccttaaagaaaaagcttatttcaggtcgacacagtggcttatcatctttcagttttaaaagacatgttccctggtgggatcaatcttctgtctcttttctctgggattggtggtgccgaggttgccctccaccggcttgggatacccctgaagaatgttgtatcggtggaaatatcggaggtgaatagaaacatagtaaggggttggtgggagcaaacgaatcagcgggggactttgattgatatagcagatgtgcaagaactgaatggtgatcgattggagcaattgatgagtagatttggtggatttgaccttgttgtgggtggcagcccatgtaacaaccttgcgggtagcaacagacatcatcgagatggactcgagggtaaagaatcttctctcttcttcgattattgtcgtatattagacttggttagatgcatgcaaaggaaccaatgatttgatgtaaagggggctgatttgtggatacttgctccaaactgtatttatcttgcatcttcattattgcctgagcataacattgaaataatgactgacattctttgcaacttatgacaacttcaaattcttagggaaatgaaaattgatggaaaagttgttggttactgttttccccaagtttgtttgtcactgggaatctttccattttgcttgagtattaaacttatattatccgggtttaggagtgagtggtgtacattggatattttaaaataacaatgtacagattggatgatgaaattgataaggatatggatgaagttgatctgttacttcaatttt

SEQ ID NO: 494 - DNA, 6071 bp, Gossypium raimondii
aaatttttgactttttaaaaaacacatttgaaaaacacttttgaagatgaaaagtatttttggtgcttaattattttttcacccctccaacaacatattacttttcctcctccttttttttcttggtacttaatttcacatatgttaaattcattaattaaaataaattctttttttaaaataatacaattgtgttaatattaaatggttttatttaaatattcacaatataatttatatattataattaaattttataaataattaatatttattgcttaaaaatatttaaaatttatatttcatatattaaaatattaaccacaagttataataaattattttttatattcttattaaaatataataatactaactaatttaaacattatttaaatgcatatctgctactcgataataccatatctaaaatagatattttatttctgaaaagtattttttaataacaatactaaaccaaaattttcaaaccatttctcaaaaacattttttaaaagcattattaaactagcattaaattaggacagttgtggaaaatttttatgtaaaacataaacaaataataagttttaagttaaaaaattggagtttttaaaaatcaaatagcgtccatggcgtccaataatttcaattcaacagccaaacaggcccgagattcgatactttcacttccatctatacggtctcgtcaactctcaactaaagtggggaaaagataatctcacatgcgtgtggatgaaaattaatatatattagataatttaattaatttgaattagaattagaattatcaatacaatttataaaaataaacttaaattttaatttattgattgggtgttcgcttttttaaaaaaaatttgaatttaaattgctataaaaaatttaaaacaacttaatttaattagaaggataaccagtttataactgaactccaacgacctcgcagtggcacgattattccatgctacctacagaggaaaacggaaaactgctgcaaattttaactgcgttagattttatttatttattaatctactttacttttcactgcccctcaagaattccgattccctttttatttataatataaaaagaaataatataatatttttataaataaagaattataacacttttttttctaattaaatatattatttttaacacgtaaataaattatgtcatattttttcaataaattattataaatatttataaataattacataggtgactttccaaacacaatcatagttatagaaaaaaattgaaaaaccctgtgaaaactgaacccacagctcctcgtttcctcttcttctccgttaccgccgttggggcttcccctatgtatattttatttctttttctccaccggtaacttctgtgtcagaactcgtcgacgatcgccgctgctgccgtgtatccttcttctttctttgtcctttcctccattctctttccttttcctccttctgttttttttcttctcttctcagttctcccgctgccgtgtccgtcggtttccgccggatctgatctcgtattcagtgtcggaaatccgtgtcggatcgtgtcgacactggtacggcacccctaattgccgagtccgggtaacggagttctgataagttttcattgtttcttttacaggttaagaaactgttcttgggctgtactatagctcaaggaaaatggtactctcaagttctattacttttttattccttaatgttatgtgtcgtcgtaatattcttcctgtatttttctaaaaattctcatttgtgcactaggctgtcagttggctaaaagaaatgaaaattctttagttatttaatcttatatatattgtatttgatattatgaatttgtgtgtggttttgtaatttttgtaggatcaaaatggttctggtggtgatgctgataattttgactgggataccgaagatgagctggaaattgataattatgcaatcgcctctcgctcaggagtgtcacttaccaatggggaagctgttttaggcacagcagaggtacttgcccatgcataattgcatcacatggcattctggaaattttaacatgcaaatcgttttaatgattatgaaaattatctacgatgaagttttctttcatttttaatttccaaagaaacattatagatattaattgatgagttcctatgggaattttctctggaggtcactgtagtttcgcatctccttttcatgcactgctttatttagttgatgacattactaatgtccctggcttaaatttcattgattagcctccatagcaatgaatatgtatgccaaaacgaactcacggttaacttttattgtctcaaggtgagctcgtctgcagattctccgaattccaagttaattgatcattttgttgggatggggttctcccaggaacttgttacgaaagcaattgaggaaaatggtaaagcttctaggtctttactacttagagcacaagtttccatcttaactcatttataatcctgctttcctattgtccaggagaggagaattcaaatttgatacttgaagctctccttcggtactctgtgagttgtacatcctatttaaagatgcttattagttacacaccccttgatgatagagagctgctgcggcttttgtggtggaactgttactgttaaattactgacgttttagtgtgcagatttcataataagttcttgatttctctttttcgcatgcaggcaagctcgttggctagttcttccaattccaagttgattgatcattttgttgggatgggattctctgaagaaatggttctcaaagcggttcaagaaaatggtaatagtcctttctcattttattagacatcacttttgacctctattgctttatctgtggtcatgtctatattttcaggagaggggaatacagataccatattggagactctattgacatattcggtaagctgtacacctgaaacctttgtttagttatttctgaagcatttattatttgtttgggaaagaaacctattgacgttacttggaatcttgatattgatgcaataacaagtcaacatattcagtggttcaggtcatattgacaatcctccccaaatagaatcatctttccgttgttgaactatctagcaaattagttgtttgctctctctgttatatcatgaatgattaatttaagattgcaggctcttgaaaagtctgctcctgtgcaacaacatgctgattctgatgacttctcgtcagattgtgaagggaattttttggatgatttcacagatattgatagttcttctgataccgaggtatctatcctttaatgttacatttgcacaatttgcggaaatttctaaaagttaccttttgtgaatacaatgagaaaatttaattttaaaagctgttgtgctttagttttctagccacatggataataaaatgtggcctatagtcattgatttgcctttttctttttatagattttataatttagttactgaatagttatgtattttatcgcattttacttgtagattatttatgtatgttgtttctttttgtatttctgtgctctaggaaataattaatactggttctgatgaggagagtaaactgttgtacttgacaaaaatggggtactcagaggctgaggcttcagtagccatggagagatgcggtgagtgtttttatttttttcagaggaagaacaacaaaacacaactttagatttggtgccatgttaagcatcctacacaacagattgattacatgcgaaggacatgacttgaatacaggaccacacgaaagcgaataattaatagatgtggaataacaccacttaacataaagtatcaaaattggaattcccaataacccattgcagacatgataaatttgctccaagggtctgtacttgtagggaaacccaagtgttttctttaacccaaggtttcagtaattaactttctctctctttggcttccatctttataggagaagattgtgatactttggaggttttatcctaagtcttttatgttgcaagaggggaatgtatttcttgcactaacattagctcttcaaatattgcaggtccagactcatcaattgcagagctgacagactttatatgtgctgctcaaatggctaaggctgctgatgcacttttccctgttgaagacagggtagtctcttccccctttccaagaattcacttattatacgctttctgaatattttgtactttattgtttcatgtttacattttaattaagagaatatgccaatttgctgtagtttctgtgtatgattttcggtaaaacttactcttgccatccaatctaacagaagccattctgcaatggctctaattacaataaaaggcgaaacttgggctatgatttgtggaaaaggaagaagcagatgaagcttgaaaagaagcttcttaatgaagatgatgatgcccttcatcttcctaatcctatgattggttttggggtcccaactgaaccagatctgataactcaaagaacacttccagaagctgctgttgggcctccttatttctactatgagaatgtggcacttgctccaaaaggcgtttggagcaccatttcacggttcttatatgatgtggaaccagagtttgttgattccaagtttttttgtgctgctgctcggaaaaggggctatattcataatctgccaattgagaacagatttccccttcttccatttcctccacgcaccatacatgaagcttttccgttgacaaggaaatggtggccttcctgggacccaagaacaaaattgaactgcatacaaacatgtacagcgagtgcgagattgacagaaaggatccgcaaggctcttgaagcttatgatggtgagccacctttgaatgtccagaaatacgttcttgatgagtgcagaaagtggaatctagtatgggttggaaggaataaggttgcgccacttgaagctgatgaggtggaaatgcttctgggtttccctaaaaaccatacacgaggaggaggaatgagtcggacagataggtataagtcacttggcaattcattccaggtgtgtgacttttactctttttctttcccataattgcttcattcctatattaatggttatgattcatgaatgtggactatgtttctgctattatttgattccttttgagtaattctttggtttcgagatacatgatccatgcttgcagtattgtgccttaaagaaaaagcttatttcaggtcgacacagtggcttatcatctttcagttttaaaagacatgttccctggtgggatcaatcttctgtctcttttctctgggattggtggtgccgaggttgccctccaccggcttgggatacccctgaagaatgttgtatcggtggaaatatcggaggtgaatagaaacatagtaaggggttggtgggagcaaacgaatcagcgggggactttgattgatatagcagatgtgcaagaactgaatggtgatcgattggagcaattgatgagtagatttggtggatttgaccttgttgtgggtggcagcccatgtaacaaccttgcgggtagcaacagacatcatcgagatggactcgagggtaaagaatcttctctcttcttcgattattgtcgtatattagacttggttagatgcatgcaaaggaaccaatgatttgatgtaaagggggctgatttgtggatacttgctccaaactgtatttatcttgcatcttcattattgcctgagcataacattgaaataatgactgacattctttgcaacttatgacaacttcaaattcttagggaaatgaaaattgatggaaaagttgttggttactgttttccccaagtttgtttgtcactgggaatctttccattttgcttgagtattaaacttatattatccgggtttaggagtgagtggtgtacattggatattttaaaataacaatgtacagattggatgatgaaattgataaggatatggatgaagttgatctgttacttcaa

SEQ ID NO: 495 - DNA, 6168 bp, Gossypium raimondii
gaatagaaaacaacatcacaagcaataaatttatgtagaaaagaaaatggaagaccaaaatgtaaatttaaacaaaaattatcaatttttttttataatctatattaatagtagtattacatgaggataaaagggtttatgggtcgagccaaggctagattagaaaaaaaagaagaagctcaaacatgacttaattcaatcttagaattttaaattgaaacctgatttatatatttcaatttagataattttctttgtatttgattgggtggaaaagtggagagacagaaagggaaagtgaaaagtggaaataaaataaaatttgagtgtaaaaaaagaagaagagatagtcgttttctattctaatgtataaaaataatatttttgaattgaattgatgagaagagagaaaatgtcaaagggggataggagcatctgtcgacaaaagaatcaccctaagatgatcatctcatggctatcgagaatgaatcaaattagttggttctatttctcaatctttctgacttgctcctacggaaccaaggccgaaaagattaagaaaaatcatgcattcacaaccattgatgaaggattccacaaaaagttaaagattagtaatccgttttagaatcgagtgggttcgatcttatacgtacacaaggaaggtaataaaaaaatagaaagaatataagttattatttacttttataacttaggagctgtgcaatatgaaagtctcatgcatggctttgaatgggagaaagaaatggcagtcagagaccgattctcattagagcgtagggcccttggcctcccaaattttttttaaaaaattttagttataccctcaaaatttttgaagattttaattaaaccctctaaagtttttgaaatatattattaaacctttgaaaatttttaaaaatttcaattaggctcttcaaaattttttttttgttgtaaatattcacaaaacctctaaaatttttgtaaggaaacaaaaaatcctccacattgatgatttcacgaaatacctcccaatctccatattccacgctttcgtacggatcccgccgtaccatcccaactaaccaaccgcattacactcgcccttaaagccacttgattaaaaatcaaagcccttatttgtatctaaatcgcgagtacatggttttaacatactctcgagaagccgtcggacccaggagaaattgaaacgaccaatttgttgccaaccgcatattggcatttgaaagtcgtactgttcttcacttattctggtaagcaaagcgcagacaattttttctcaattaaaaaaaaaaagattttcatcgcattgttttttttgttgtaactctaggtttttcaaggttttcagtgttccacggcggtgattttgcgacgacggtgatctgttttcaagcttcttgccaaagtttcgtcaacgaatcatcgtctttgtaaggtaagtcattactgtttgttgcgttttttttttttgaatagtgcctttttgcttaacgtattgtatatctgtgtgtgtgtgtgtttactctgtttggctttaacgagatagtgaaggaaaaggagaaggaaaatgtcgatacatgatatatatgtgcttgctctgtttggctttgacgaaagtgaaggaaaatgttaatgtataacttcatttttttgttatgaacactgacgtttctgtttaccataggttggattcacttgctatttagtttagcaatttaatcattgagtttatcaattatcatgttattcatcatatatgtgaagtttcaaatggatgcaatatttctattatattaatggacaatcgaaaatcacatattcaccgaatgaaagttttttttatatcaaaccaataattagacatttttaatctatttaaaattctacatgtgtcttccactttaggaagatgaagtttgacactagtgaaagtttaccctcttgtatatatttgctctgttcattgaaaagtcctctagtttacttaatttggctgttgaatgcttgttagaaatgaaatgacaattgaatttaagtttgtagctgcttcatatgtctcaatttttgcattttctttactatgctctgcttgtatatgattttatttgctgaagatgtggctttttgtcatgtatatatatagtttctaagaagctgaggcctcgtaatggtttcaaaagtttcttttatgctttgcttttattataatcagacacttcactttcttcagaagggtaaacttttgaaatctgttaatgcatttaaggaattttcaaaagtttactaaagatgtgtaatgctttaattttgaatataggatttcatggaattattagactttgagctaggtacttgtgttttgaataaggactatctttagtgaatggtcattggttcgtgcacttatgggtggcaaattttgagatgctatggaatccacttgtcacatttagtcattatactgcatcatatctgcatatactttctagttgtttacaaacttaaagatgtgtctatttttatttcgtgatgaccagatgtttgttcatccatggaagggcatcattgccaatattccaacaacattgcaagatggaaaacatgtaggggaaagtggaaggaaactgagggaggatttggcaaaaaagggattcaatccattgaaggttcaacctctttggaaccgacacggtcactcaggatacgccatagtagagttcaataaagaatgggatggttttaacaatgccatcatgtttgaaaagagttttgaattggaccattatggaaagaaggattactactcatctcggaggaaaaaagacaaattgtatgcatgggttgctcgtgaagacgactactactctggtggactgattggtgaatatcttcgtaggaacggagacttgaagaccgtttcgagcaaagaagccgaagatcgaaggaagacctcaaagctattgacaacactaaacaataccttggagaccaagaatcaacgccttcaggaaatgcagaacaaattcaatgaagtgagtagctcaatgagtacattgatgtggcaaaaagatgacatgatcagagcttataatgaaggtatgctacaatcctagtttctaaaagggatttaaattcaatttatactattctaattgttaacgggttatagtttataatgtgtagagtgtaaaaagatgcaggagaatgctcataatcatttcaagcagatttctttagaacatgagaggaatgcaaaatgtattctagaccagaaaagagaattagagcagcgtgagaaggaattgttgcaacgggaggcccaaaatgaaaatgagaccaaaaaacttcagcacgagaagatgatagtatgttgaacatatttaaaatagtgtatcaaaattttaaacacatgtaccgatattttttgataccttagatacaagttgtccaatatagtaggtatagcaattagcccttttatctaaaccataataacaaaaattgatttagtgaacctatcatattacttcctatctatacaaatcaaaatattcataaattgttttggcagaacgagagagcagccttggaacaaaagaaggctgatgaaactatgttcaaactggctgaagagcacaaggtatatctttggtcttcatattgtgtgctattttcaatttctagaatctcttcatttaccatttatttattttcctatgtcagagagataaagagaaacttcacagagaaatcattaagctagaaaagcaacttgatactagacaaggattagaacttgagatacagcgtttgagaggggctttacaagtgatggagcacatgaatggtgatggggatgcagacacaaagaaaaggatggaggtaattcaagatgaactgaaagaaaaggaagaagaactggaagacttggaagatcttaatcaagctcttatcatcaaggaacgcaaaagcaatgatgagttgcaagatgcccgaaaagagctaatcactgtaagtatatgttatattccccttttttcttttcttagaaaacgtgtataagagctaaccactggcatgttatattacttgagatacgacctttcacatacatgtctgtgtctaacagtgacgttcaagcctctcgtaatataacttgcatgcaatacttaatttcaaaaataatagtaatgttgaacatcaaaaaatttctgagtttgtgttttgaagcgatggaaaaagggttagctatttaatatttattgtcctttaaaaaattctgaattttggttttgtcttttttgtttcagtcactttaaaacacgacaagttaatttttaacgttcaatctcactatagtgtttaaaattttaccttttttgcttcaaaatcacttttatagtaatggaattagtttagttagatgaagaacttacatgcatcaacttgcctttgcatattttgaagaaagatagaagcttaacaagtgctttctatatatatatatatatacggtgtccatgaattttgcaagagatttttgtgttacttgatttttgtttcacaggcatttaaagatgtttccaccagagctcatattggtgtcaagaaaatgggagaagtggacattaaacccttcttagttgctgccaaaagaaaatactcagctaaagaagctgatgtgaaatcagcagagctatgtacactgtggcaagactatcttagagatcctagctggcatccttttaaaatcctcaaagacaaggaaggaaattgcaaggtaattttttctctctatattttacacccattcaatttccccctctttaataactgttattgcttgactatctttatccttatttgtccttaaggtgtaacaatagggaaatgatcagtttatcctatctttcttattcggattcagataagtgtcaagacaggggcaaagttagaaattttattttgtgggtgtgagataaaattataaaattttggaggagccaaggttaacttttatgttaaaatgttcaaattacattattaatttttttgaggggctaaaaatgcaaaaaattcatttagtcaaaaacaaaaggacttaatttgcataatttatattatgggaggagctaaatgaatatttccccatttaacaaaagggtgtcagttgcgaatatgcttatttttcaaataaattcttatatattcgaaggataatatctttatacttgtatctaagtaacatactgaatttgttgccgtatgacgttggcttgtctttagacttgtttagtggccggattactttcttgagaggtctaacttgcttgggccgtgtttggagaaggtgtcagagtttgggcaattccctactcatactgccccgaatattaatataaaaatatgatctaaaaaattttcggacatccattatttaacttatcaagttgtcttgctcttatgacttaactttattctctctataggctaaaaaatagtgatttttcttttacaggaaatacttgatgaggaagatgaaaaattggtcgaactcaagacagagctcggcgacgaagcatacaatgctgtgacgatggcattgaaacagatgaacgagtacaatccgagcggcagatacgtagtaccggaactttggaatttcaatgaaggaaggaaggcaacattaactgatggagtgcaacatttactgaacaaatggaaactgcataagcgtaggagatactaaaatttcttcatcaattttctttcactgaaggatcattttgcaaatcttcgaaaaaaaggtaaacttatactgcaagacagagaaaatgtgttaattcttcccccaagtaaaccaagttgaacgtacttttttgttttaagaagtttgattaggtttttactagttcgagctccaacttaatatacttgaattagtcaatgattgagcttggattaaatttcaaactcttttttcgagtggaactgtatttagcttatttgaattttttttggagttgaatggtattagaggtaaaagttaggagtgtaaaagaattgttctcaagcaaacaaagctttgtttgcatttgtttgtttatttttaaagttgtttatgttcggttcgtattc

SEQ ID NO: 496 - DNA, 6318 bp, Gossypium raimondii
ttataaatttaacatgtattatttataattatataattttaaaaaataataattttgaagtcaatttttaatttttatatatcaaggctgctaagagatcctcatatattaaaataacttacactaattttttatttgaaaaataatttagaatagaaaacaacatcacaagcaataaatttatgtagaaaagaaaatggaagaccaaaatgtaaatttaaacaaaaattatcaatttttttttataatctatattaatagtagtattacatgaggataaaagggtttatgggtcgagccaaggctagattagaaaaaaaagaagaagctcaaacatgacttaattcaatcttagaattttaaattgaaacctgatttatatatttcaatttagataattttctttgtatttgattgggtggaaaagtggagagacagaaagggaaagtgaaaagtggaaataaaataaaatttgagtgtaaaaaaagaagaagagatagtcgttttctattctaatgtataaaaataatatttttgaattgaattgatgagaagagagaaaatgtcaaagggggataggagcatctgtcgacaaaagaatcaccctaagatgatcatctcatggctatcgagaatgaatcaaattagttggttctatttctcaatctttctgacttgctcctacggaaccaaggccgaaaagattaagaaaaatcatgcattcacaaccattgatgaaggattccacaaaaagttaaagattagtaatccgttttagaatcgagtgggttcgatcttatacgtacacaaggaaggtaataaaaaaatagaaagaatataagttattatttacttttataacttaggagctgtgcaatatgaaagtctcatgcatggctttgaatgggagaaagaaatggcagtcagagaccgattctcattagagcgtagggcccttggcctcccaaattttttttaaaaaattttagttataccctcaaaatttttgaagattttaattaaaccctctaaagtttttgaaatatattattaaacctttgaaaatttttaaaaatttcaattaggctcttcaaaattttttttttgttgtaaatattcacaaaacctctaaaatttttgtaaggaaacaaaaaatcctccacattgatgatttcacgaaatacctcccaatctccatattccacgctttcgtacggatcccgccgtaccatcccaactaaccaaccgcattacactcgcccttaaagccacttgattaaaaatcaaagcccttatttgtatctaaatcgcgagtacatggttttaacatactctcgagaagccgtcggacccaggagaaattgaaacgaccaatttgttgccaaccgcatattggcatttgaaagtcgtactgttcttcacttattctggtaagcaaagcgcagacaattttttctcaattaaaaaaaaaaagattttcatcgcattgttttttttgttgtaactctaggtttttcaaggttttcagtgttccacggcggtgattttgcgacgacggtgatctgttttcaagcttcttgccaaagtttcgtcaacgaatcatcgtctttgtaaggtaagtcattactgtttgttgcgttttttttttttgaatagtgcctttttgcttaacgtattgtatatctgtgtgtgtgtgtgtttactctgtttggctttaacgagatagtgaaggaaaaggagaaggaaaatgtcgatacatgatatatatgtgcttgctctgtttggctttgacgaaagtgaaggaaaatgttaatgtataacttcatttttttgttatgaacactgacgtttctgtttaccataggttggattcacttgctatttagtttagcaatttaatcattgagtttatcaattatcatgttattcatcatatatgtgaagtttcaaatggatgcaatatttctattatattaatggacaatcgaaaatcacatattcaccgaatgaaagttttttttatatcaaaccaataattagacatttttaatctatttaaaattctacatgtgtcttccactttaggaagatgaagtttgacactagtgaaagtttaccctcttgtatatatttgctctgttcattgaaaagtcctctagtttacttaatttggctgttgaatgcttgttagaaatgaaatgacaattgaatttaagtttgtagctgcttcatatgtctcaatttttgcattttctttactatgctctgcttgtatatgattttatttgctgaagatgtggctttttgtcatgtatatatatagtttctaagaagctgaggcctcgtaatggtttcaaaagtttcttttatgctttgcttttattataatcagacacttcactttcttcagaagggtaaacttttgaaatctgttaatgcatttaaggaattttcaaaagtttactaaagatgtgtaatgctttaattttgaatataggatttcatggaattattagactttgagctaggtacttgtgttttgaataaggactatctttagtgaatggtcattggttcgtgcacttatgggtggcaaattttgagatgctatggaatccacttgtcacatttagtcattatactgcatcatatctgcatatactttctagttgtttacaaacttaaagatgtgtctatttttatttcgtgatgaccagatgtttgttcatccatggaagggcatcattgccaatattccaacaacattgcaagatggaaaacatgtaggggaaagtggaaggaaactgagggaggatttggcaaaaaagggattcaatccattgaaggttcaacctctttggaaccgacacggtcactcaggatacgccatagtagagttcaataaagaatgggatggttttaacaatgccatcatgtttgaaaagagttttgaattggaccattatggaaagaaggattactactcatctcggaggaaaaaagacaaattgtatgcatgggttgctcgtgaagacgactactactctggtggactgattggtgaatatcttcgtaggaacggagacttgaagaccgtttcgagcaaagaagccgaagatcgaaggaagacctcaaagctattgacaacactaaacaataccttggagaccaagaatcaacgccttcaggaaatgcagaacaaattcaatgaagtgagtagctcaatgagtacattgatgtggcaaaaagatgacatgatcagagcttataatgaaggtatgctacaatcctagtttctaaaagggatttaaattcaatttatactattctaattgttaacgggttatagtttataatgtgtagagtgtaaaaagatgcaggagaatgctcataatcatttcaagcagatttctttagaacatgagaggaatgcaaaatgtattctagaccagaaaagagaattagagcagcgtgagaaggaattgttgcaacgggaggcccaaaatgaaaatgagaccaaaaaacttcagcacgagaagatgatagtatgttgaacatatttaaaatagtgtatcaaaattttaaacacatgtaccgatattttttgataccttagatacaagttgtccaatatagtaggtatagcaattagcccttttatctaaaccataataacaaaaattgatttagtgaacctatcatattacttcctatctatacaaatcaaaatattcataaattgttttggcagaacgagagagcagccttggaacaaaagaaggctgatgaaactatgttcaaactggctgaagagcacaaggtatatctttggtcttcatattgtgtgctattttcaatttctagaatctcttcatttaccatttatttattttcctatgtcagagagataaagagaaacttcacagagaaatcattaagctagaaaagcaacttgatactagacaaggattagaacttgagatacagcgtttgagaggggctttacaagtgatggagcacatgaatggtgatggggatgcagacacaaagaaaaggatggaggtaattcaagatgaactgaaagaaaaggaagaagaactggaagacttggaagatcttaatcaagctcttatcatcaaggaacgcaaaagcaatgatgagttgcaagatgcccgaaaagagctaatcactgtaagtatatgttatattccccttttttcttttcttagaaaacgtgtataagagctaaccactggcatgttatattacttgagatacgacctttcacatacatgtctgtgtctaacagtgacgttcaagcctctcgtaatataacttgcatgcaatacttaatttcaaaaataatagtaatgttgaacatcaaaaaatttctgagtttgtgttttgaagcgatggaaaaagggttagctatttaatatttattgtcctttaaaaaattctgaattttggttttgtcttttttgtttcagtcactttaaaacacgacaagttaatttttaacgttcaatctcactatagtgtttaaaattttaccttttttgcttcaaaatcacttttatagtaatggaattagtttagttagatgaagaacttacatgcatcaacttgcctttgcatattttgaagaaagatagaagcttaacaagtgctttctatatatatatatatatacggtgtccatgaattttgcaagagatttttgtgttacttgatttttgtttcacaggcatttaaagatgtttccaccagagctcatattggtgtcaagaaaatgggagaagtggacattaaacccttcttagttgctgccaaaagaaaatactcagctaaagaagctgatgtgaaatcagcagagctatgtacactgtggcaagactatcttagagatcctagctggcatccttttaaaatcctcaaagacaaggaaggaaattgcaaggtaattttttctctctatattttacacccattcaatttccccctctttaataactgttattgcttgactatctttatccttatttgtccttaaggtgtaacaatagggaaatgatcagtttatcctatctttcttattcggattcagataagtgtcaagacaggggcaaagttagaaattttattttgtgggtgtgagataaaattataaaattttggaggagccaaggttaacttttatgttaaaatgttcaaattacattattaatttttttgaggggctaaaaatgcaaaaaattcatttagtcaaaaacaaaaggacttaatttgcataatttatattatgggaggagctaaatgaatatttccccatttaacaaaagggtgtcagttgcgaatatgcttatttttcaaataaattcttatatattcgaaggataatatctttatacttgtatctaagtaacatactgaatttgttgccgtatgacgttggcttgtctttagacttgtttagtggccggattactttcttgagaggtctaacttgcttgggccgtgtttggagaaggtgtcagagtttgggcaattccctactcatactgccccgaatattaatataaaaatatgatctaaaaaattttcggacatccattatttaacttatcaagttgtcttgctcttatgacttaactttattctctctataggctaaaaaatagtgatttttcttttacaggaaatacttgatgaggaagatgaaaaattggtcgaactcaagacagagctcggcgacgaagcatacaatgctgtgacgatggcattgaaacagatgaacgagtacaatccgagcggcagatacgtagtaccggaactttggaatttcaatgaaggaaggaaggcaacattaactgatggagtgcaacatttactgaacaaatggaaactgcataagcgtaggagatactaaaatttcttcatcaattttctttcactgaaggatcattttgcaaatcttcgaaaaaaaggtaaacttatactgcaagacagagaaaatgtgttaattcttcccccaagtaaaccaagttgaacgtacttttttgttttaagaagtttgattaggtttttactagttcgagctccaacttaatatacttgaattagtcaatgattgagcttggattaaatttcaaactcttttttcgagtggaactgtatttagcttatttgaattttttttggagttgaatggtattagaggtaaaagttaggagtgtaaaagaattgttctcaagcaaacaaagctttgtttgcatttgtttgtttatttttaaagttgtttatgttcggttcgtattc

SEQ ID NO: 497 - DNA, 9056 bp, Gossypium raimondii
tatttttttcgttttgagcaatttaatttttcttttatgttcttttaactttttttttcattctcccttttttttttcctttgttaaaatttttttatatttatgaaaaaagagaagcagaaagctgaaaccaaaataaaacttcgcatattctcaccccacaattacaaaccctcatcgtctatcatcgctttaacaaaccaatttggatctttcaatgacctagtttgcaagcttgcctcactcgaagacctcgccagtcgtgacttttggtagtccaccctcaacaaagtttctcgagcccgttcctttaacctcctaaccaacccctacaaccaccttatctatgttacctacaacattctcgccctctcaaaactacgttgtttcacggattcctcaaatgagctctacattctcaaagactaaaacgaccatcattcgaaacttatcgtcaactttatccaaaccagtttggatccatactctctttctttcttcagtttatccatgctcagttttcaatcaagcttgtttgggaatatccaaaaaagtttagatcaattttatagtttcttaattttacttgttagaaaataaaataaaagagaatgaataatatacacaattccgtagaagtttgaaatggaaaaaaaaatattttggatataaagatttcaatttatctttagatttgattaattatatgatttttttatattaattagttagatccagttttactttcaaaattaggttataatcaaattgagatttgattaagaatgattgatattcgattttgagtgaaattcaaattaagaatcatgtgaaaaaaacaaggacttggtttatttggtgggcaaagattatatttttgtagtggagaatacgagaagagagaaaaataaaggagaaggagaaaagggaaataaataaataaaaagaaaaagttaaattgctcaaaacgaaaaaaaatatagggaccaattgtataatttaacctaaaatttttatttgaaatgatgatttaacatgccatgtcagcttaccgttacaccattaatgaaaattaacacttagtgattgaaatgttacaacacgatatcgtaaatgactaaatcgtaacatttcaaacataagtgactaaaatgtaacttgatacaaataaaagtgactatttagtagtttagcctaacaaatacaactaactttttttatcttccgcaagccggagcgcgcagtgatgtcagattccacgcttttaccattttcctgtttttgaaagacggttacacttgtaagtgaggtttccattgtagttgtttttggtcaatgtaaatgacaaaataacattgcttctttattctacttatagattgctttgattatcagctgctatctttctgggtgggtttttcaaatgttttacaagtgaatgatgagcgcttttttagtggtagtttcatttgtgtggattcttgttcatgggttatgcagagccaaagcttcaagtcaaagtgagaagctgcattttactaacattacgcacatgctcaatcttgctctacattgtgtgttcctcacattttaaatttttttcttctggcgtcattgttaatgcaattttgattgcttttctttcttctgcggcagtggaaataaagatgctaaaatcatgaatattgatagaatcaatggaatgggcttaaggagatctccaagattgagttcagccccgcctgaaaccaaagattgctcttcaaaaactatctttaaatcctctgagaatggttcctactctgaaacaagaccttctggaacggataaagaagctgttctttcaaagcgcaatgacccaaacttttctgatgaaaagcagaggagaaagtctcctagatttgttgcagggactgaacattgtggcggtaatgggtctttgagaaaatttcaagatcttaactcaggctttccattgaagcagttaagaagatctctgaaaattagccaggctactaaaaatgtttgccctgatgtctctattacaagattggatatggatgaaaggggctcttctggagagaagcggttgggaatatctcccagttccgtgcacgcaacagaaaatggtgacagtaatgcatcttttagagaacataggagggaaatgtctgttgaaaagcagttgaaaacaccttcctcactttctacattattggctgaaggtgatagtgctgaagtaaactcttcttccaatagattatccaattcatgtgatgaacagccttccaagaaatttaagatctcatcagcagaatcagatatgtgaacctcagatgaaacattctcaaagaaagccaagggctcgtctctttcaggaaagaagaagagtcaatccaagactgatgccatatttataggcaatccaatccctgatggtaaagctcaagaaaggtggcgatggcgatatgaaatgaaggtgattgatatgagctaaactggcaaatgctaattctttgattgattaggctgattgaaacagtgaccaatgaccattcttctaccaatcgtttccaatgttgattgatatccctttattttgcttgaactttaactggcaagcattatgacatcttttagttttcaacattgatacaatggttagtaactacacatttaagttttgctcctttggagtctggactatcagtgcatgtaattttctgttataatgtttgtaagcagttagttttactgagaatggttggggaatgaactggaaataatagtaaatggcacccactttatatttttcaatgctgattgcgaatatcttgtacttttgcagaatataaaatctaacagaaaagacatatcattggagtaagtaacctttatgagatccctctgtttagtggtttttgttatcttgatttagcattgatctcaaattctttcttgggcttctaaccccagttcctattgtgatagtgatgatgatgatgatgaagacaagatagtttggaatgtggaatgccattatgctcaagctgaaattgatggatgtaccataaatcttggggattgtgtttatattaaggtaaatgtgatcaacacatggtgtgttttaaaatttgtatatatacatttaggttctcttaattaatgttgggcaaatcaagtttacgtggtctctcttctaatccttttcttcttgtctgcctatggcacttctacatttcaataatatggcaattgaagcaagcaaattctcatgggataaggattttttgcagggtgaagaagcaaaacaccacattggcaggatattagaattttttagaacaacagatggagaaaattattttagagtccagtggttttatagagctgaagatacagtaagtacggaaagtaatatttattttaggccatccaatatttcttatcctgacctttgttgcttctgttctgcgcatcatgcaaaggttatgaaacaagaggctactcttcatggcgaaagtcgtctattttattcaaccatagtgaatgataatctcatagattgcattatttcaaaagttagtgttactcaaatatcacctaaggtatgcttcttgcaatcttaatttactcctgtttttttttcctttttactattctaactgtttatgaatagcgtttataaattttctttatattttttccggttcatttgatctttatcagaactatgttgttggaaattttggatttatttattgttattctataattcgttgaagtttggttcaaagtcaaattctcttccccaatctgatttctattttgacatggagtattgtgtggattattcaacattctgcaccttgccaactggtaagcttctttttgtgatggtaatggagtttaacttccggattaactctgtttgtgtttcttgagagaggaaagggtggtgatcgtggaaacataatctggttagagaaaggttaaatattctgataaatgataatcataatgccagtaactctctctttatatatatatagatatattttcagataattctttcaagagccacagttcctcaaagtgctacgaggaggttttccctacgactcctgccttttcagcaaatattcctagttttggaacttacaaggcacaactcacaaaactagatctttactctggttgtggtggaatgtcaactggtttatgccttggtgcaaaagcttcgtgcaatgatctagtggcggtatttcatccagtcactggtaacctcgtatttgatgattcattcagtaataaaattattttatcatgtaccttacattctgcattttagaaatgggcagttgacagcgataagtcgccatgtgaaagcttgaaattaaatcatccagagacacatgtgagcatcgttgccttacaacttcatttggcatgcccccaaatctttagtggcagataatactatctttttgctttcgttatataggtcaggaatgaagctgctgatgattttcttcaactactgaaggaatgggaaaagctttgcaaacaatatagagttaaaaatttagaaagaacatatccatcaagatcgagaatctccgaaactgtctggaataatgccagttctgcaaaagattctggtactcctgatgaacatgaagtttccagtctcgttgatatttgttatggagatccctgcgacacaggcaaccgtggtctaaagtttaaggtggtctatttgatctatatgatgtgatggtagttcctttcatgccttttgtgagtttttgtttgtaatctaattgatttttgtttgtgtcaatctattctactggtattcagtcattttttgtttcatgtcatagtttagtggagattggctcgtgctaatatctcttttgttaggtctgctggaagggttattctgcaagtgatgatacatgggaaccaattgaaagcttaaggtatagtaattgctgccatcattccattcttgaattaggctattatttacttattcaaatctctcaggaattgccaagaatgtattcaggaatttgtaacaaatggattcaggtccaaaatcttgcccctccgtgtaagttttctttaatcagatgtgctggtggatgcttaatctagagtattgtaatagttggaatatttgttatgaatgattcctctttattgaattaatttaatcagggggatgttgatgttatttgtggtggccctccatgccaagggataagtggttataatcgccatagaaatgttgattctccactggatgatgaaaaaaatcgtcaaattgtggtcttcgtggacatagtggaatatttaaaacctaagtttgttttaatggaaaatgtggttgatattatgagacttgtcaaggcttcacttggaagatatgctttaagtcggttggtacttatgaaataccaagcaaggcttggaatagttgcagctggttgttatggtcttcctcaatttcggttgcgtgtttttttgtttggagcacattctagtgaggttactactctcaagtttttgcataaaattgaattacagcactccttgactgtccctgactttggagtagtgctattatcacctgtagatttaatgattttggtcttgctggtgatctaactgcccctggtttactcttttttccccctatttgggtgggggggtgtttgtggtaatttggtgtctgcagaaacttccacagtttccacttcctactcatgatgttattatcagatatgggtatcctgctgagtttgaggttgctgttttctcccttagaatgcttgaaccagtaatgttccatccatataattctgtttgtcttgtgcagcgtaatacagttgcatatgatgaaggccaaccacgtcagctggaagatgctcttgttcttcgtgattccttttctgatcttccacctgtagtaatcatatttttgttttactgattcaacctcttcttagatttagcagtattctgttctacttaataagttaactgctttgcaggttgcaaataatgaagcccgcgaaaaaatgacatatgaaaagcctcctgaaactgactttcaaagatatataagatcaagtgaatatagtaattgttttttttttaaatttcatttacccttgggatcatctcatatttcaatgactaaatttcttgttgtataactggcttttttttcctcgtatgtatatctgagtattttgtggcagttctctaaggccaaaataattggccatttgatggagtcttaaaagattttatgcccgatgatctctcttatatgtctgttctagattaataaatgtgtactttatttctttttctttttctttcttttggtaaaagtgaagggtcttttgatggaaatttttattggtaatataactgatttgggccttaatgtctgcttctgaatgtggtgcctaatatgaagttgccaagaaatgtggtataatatgtaggaaatccagtgtgttacaggtttttgcttgtttattggaataattctgatccatgtctatcagaacgaaatgaaataattatggtatagttgcttatattgtggaaaaatctgataataggtacttaggttctcaagtgttcctttttctgtatatggagatgtaagcttgcatcaactggtaggcgaagtggttggatgttgtaggatcaacaactggtggccattaagttgcattctttgccagttaagttgaaaatagcagctcataatttcaatgtgaaacaaggaccttttactgtcagtgggctgtaatcaaactgctttctgaccaaaactcaattttggcaagaagaactaacagaacaagcataggaaaagtcattggattgtggaactaggttaggtataattttcaccaataaccatcccaaaacaagtgtctgtaattgtaagacacaaggaagttgcaaaagtagagaggaaaactttattggagcctagaactaaaagcaagtaaattttgctacttatgtgcagtctcatgtctggtaatctataggttttagtaggtatgctggttagttaatttcttgacaacctgtacaatatttgttggtgggagtgaaaaattttgcactgaagtctcaggatgaaaaattatgtacaagcatgcatcatggatcttgggtctagaatttggaatgcttcgaacatatgcaaattcatgatgtagcattttggtcagcatctcaaatgctaattcaagtaagcatggccatagagttggacatatgcagcatatctagtaaaccggtatttgtttctgtttaaatgttgctcctgttcttcctgttgtgaaccaaagaatattagtcacatcacccatttgttgtatatcacagaagagagggaggacagagcccagcacagatcctctttattgttacctctaattgtcattcatttacatttttccttttttcctggctttgcagagatgactggttctgaattaaatggtgccaaaagaataacgaacctgttgtatgaccatcggccttctccgttatctgaggatgattatattagagtttgtctgaatccaaagagaaaggttttgtaactccaattgacattgccacttttttcccttctgatctttttcccctaatttagatgtgtttatagggggcaaattttcgagatctccctggtgtaattgttggaacagacaatgtggcttggaggggtcgaacacaggaacagcagtttttaccatctggaaagccattggtgagtgtcttcttttcccatccgagcaacagagcttccacttctttgttcatcaatgtactggatattcatatgtaagcacatgcttctttgggttttgcctggatggcttttttatctttgttctttgtgaatgcatctcaacgcttgggacattttctttagtggcgtttctttatcatctttcattgtctctttgcaaacttgatgaaacagctatttattctaggttctctctttactaggaaagcacaaaaatgaatctagtgcagaaagggaatgaaacaagaattcattttcccaacactgtaatatactatgcctaaatggaaaaacagattgctgatgttggttctctttcatttgtgtaggtaccagattatgtctttaccttgaaacaaggaaaatctaaaaggttaggcttttttggcagcctgtctcatttcaacaacccctcatcctccaaaatagatacatacatatatatatatatatatatagagagagagagagagagagagagagagaggaaactagaggaactaatgttgttgatatatgtgcagaccatttgcaagattatggtgggatgagacaatgccgactgttctaactgcacctttttgtcacagccaggtttcactttgcactagtttagtatgtaagattacacatttactagtcctttggatttgcttgtgagttttaggagttgtgtaggcaatattacatccagagcaagactggcttctcacagcccgggaatgggcaagactgcaaggttttcctgactattatagattccgcgggacaattaaagagaggtatgatagctttgttctaaatattattttggtaagctttttacatttgctgaaatcggaaaaaattaactgtaatgatcttttaagattatacagctatttgaaaagaagagaataagctcttatagctgcgtattgaacagagaaattcggccttaaaaaagcaagggaactttatgaacattttgatttagcaagttatacaaatataatctttgtttctatgtttctatattgataggtattgtcaaattgggaatgctgttgctgttccagttggtcgagccttaggatacacaatggggatggcatttcagaaagggagcgggaatgaaccactgatgatcctccctcctaaagttttctctttccaccaatatccagttagcaaaatcattgtcccaaaacactga

SEQ ID NO: 498 - DNA, 8971 bp, Gossypium raimondii
acgtgtattaactccacagtatggctgatactatcattttatatagagattggatttttgtgagtgttttttggcaagagctctttaggagggcatgaaccaaactcctactgtccatagcctatcaccctcaaaatgatggccaaattaaagttttaaactactgcattgacagttacctcaggtgtataataggggaaaggcttgttgattgggtgagttgattacctttggctaaatggtggtacaatttgacattctattcagccattcaacttacctcctataaggccttatatgggtagacaccattacaacatttgtcgtaccttgctgggatttcacttgtggccagtgtggattgaagcttgcaggctcaagaagctacaaggaaaatattgtaatttcatctaaaacaagcacaatcgaggatgaagcagttagctgacagacacaggattgatagataattccaaatgggagaattactttacttgaagttgcagccatataggaaataatcaattagcatggctcttaaccataaattatctcccaaatattttagcccttttcctatcatggccaaggttggacaagtggcttataggctatagttacctccaggatcacacatccattctacattacatgtttctcagctgaagaaacatgttggagcagcaccagtctaatcttaattgccattattggatgcacatgaggccttgcttaaggagccagtcagaatttgtgagcacaaaaatggttaagaaaaattaatcaactggtcattgaggtgcttgtggaatgggcagacactttcccttaagatgctacctaagaaccactgcaacagctgtgtgtcacctttcctcattttaatcatcgaggacaaggatctgttttggcaggtagtacttgttacgaggtaaaacttgaattagaaaaataaagataagttaagtaaacagggtgtaaaacaaggtgttttgttttagttaaacggtgcagataagaatttaatgaaagcggtacgcataaagggaagacaacggcctgagctattaataggccaactaacttttcaaacggctaattactttccttttaagcataccattatcgttgagcagtttcaatatttcttccttctcgattttcttctcttcctttttacttatgaattttctttcttgaattttctaattgcgtcataaaaatatataattttttttaagttaaacaatgaggactcaatacatttgaagtaaagttggagtttaagccttgtaaaaaataaaataatactaagagaatttatattagctcgaatttaaattttattaagagcaaatgtaattaaaggggcgaaaaatatccaatctcacttataaacgaaatagcaacgggtagggtatttgacttggtccatatggttgatgtgactttatacaatacaagtggacagcattgtcatagtttagggcggaaaacgggaaagaagtttcgattttttttgtgtgtttttggcgtttggggaaaaaaacttgtaaaaaagttaaaaatggtagaaaattttcttttttggaggaatggcgccaacatttttttccaaaatcagtgttcccgcctttctttgcttttccccttcatttatttataatgttcagtgtttcttccctttctattcatcttcactaaacactgttctcactgaacgaagccaaacatcaaagaaacagtgagtttagagctaaggttttcgtctcttctccaagtcatgggatctgtcgcgcttttggattctaattccccttcaggttttcctttttttattttattttaatctcttaaactgaattattgattccatatattcattcccgattgttgatttttgatttgctgctcaccgaagaaaagaaaaaaaggggggggggggctgggcccatgtctatattaatgtatattatcattttttacgcatttaattttatgtataagagagacgaaactgtagacttactgtttaagacaggtcatctagtctgagctaagccaatcaggtgatggcagtttgttttaattacatgttcaacaaaaatccctttttgttttggttttgtgattttcattgcaattatcgaaggttgcagcttgaatatgaaaatccaagtttagttgttattcagatggggtcttttgattattttctaggattttcttgtttctgcatgttgatcccttgtgctttaaccttcatgcactttgttttattttaatggggctagtcccgtttgagtttcttctgtgtccttttttttctggtggatttgatctttgggacctgttctttttttctataaaacctttggtttgataaacttgttacactagatttgcatttgtatttccctgtgagtttatgctaaacatctctaggttctacttacatttggctttgcaaaatgttttagcaaaacaagattgtgtgtgtctgtgtgtggacttgatctttgggacctgttctttttttttctataaaacctttggtttgatcaacttgtttgattagatttgcatttgtatttccctgtgagtttgtgctaaacatttcaaggttctgcttacatttgacttatcaaaatgttttagcaaaacaagattgcgtgtgtgcgtgaagaatcttgttaatacatttctttacaaagtaaaaattacctagtcttatgctttactgcaagatcttttttgtcttttcttttttttgcttagccgtttcagttatctgtgtgatcgtgctagcatattattttcttatatttttgtttatttatttttcatcatgcagtgatatagaagaggcatgttgtgtttatgctataccatttatttatatttttgtttctgatggttttttaaagtgcctaaactcaagttcacaagatctttttttggcatttaggaatgaagaagaataagaaaggcaagaataaatctgctaaatcttccaccaagaaagagatggaaactgataaaaaagtacagaagcgtaatagtgctcaggaaaatggggagccagtcccttcaaaaaggccaaagagagctgctgcctgcactgattttaaggagaaagcagtttgcatatctgaaaaggattcagttgttgagacaaagaaggatatggtagtagaagatgaaatcctagctgtagcgctgacttgtgaaaaagatgatggccggcctaataggaggctaactgattttgtattgcataattcagaaggtcttccacaaccctttgagatgttggaagtcattgacatgttcataactggtttgatattgccgcttgaagaaaatactgacaaggaaaaagtaaaggagaagagtgttagatgtgaaggatttggacatgttgagtcttgggacatctctggttatgaagatggttgtccagtgatatggctttcaactgatgtagctgattacacctgctgtaagccaagtggcagctataaaaaatattatgaacatttctttgaaaaagctcgagcttgtgtagaggtttataaaaaactttcaaagccttctggtggaaatcctgacttaagtcttgatgaattgcttgctggtgttgttcggtccatgagtggaagcaagagcttctctcgtggggcatcaattcgggattttgttatttcccagggagaatttatttataatcaactgattggtttggatgcaacttcgagggtaaatgaccaggtatttgctggattgcctgttcttactgccctcaaagatgagagcaggaagcgtgaaaatatagggctagacatagcactgttttctggtggtgctctgactattggtaaaaaaggagagggggaaagtaaattggatgagacatattcatctacttttacagctgaggaagatgaggatgcaaagttggcaaaactgttgcaagaggaagaatactggaaatctatgaaacagaagaggaaccaaggctcagcttctatgtcaaacaaattctatatcaaaatcaatgaagatgagattgcaaatgattatcctcttccagcatactacaagaattctaatgaagaaactgatgaacttgtagtttttgaaagtgactttgatgtgtgtgatcctgaggaactccctcgaagcgtgctccacaactggtcattttacaattcagactcaaggctgatttccttggagctgcttcctatgaaaccatgtgctgacattgatgttaccatttttggttctggggttatgactgctgatgatggaatcggattctgtcttgacaatgaccttagtcagtctacttcaggttcttcgagtgtgctgaatgctgatggaattccaatttttttgagtgctattaaggaatggatgattgaatttggatcatcaatgatattcatctcaatcaggacagacatggcctggtattgtctcatgtttcttgattaggattctgttgctataatatttttgctaactcatgtttgatctacaatgcctgcagaaaagtttctaaaaagtaaaaaaaaaaaaaaaaccatagttctttgcaattatctactaatatgcaaaacaaccagattttcctattcattaaataattagttttaactgtgacaagtttttattttctctccatttttcaggtatagacttggcaaaccatcaaagcaatatcttccatggtatgaaccagtactcaaaacagcaagggttgcaataagcattattacattgttgaaggagcaaacacgagtatcacgcctctctttcaatgatgtaattaagagggtgtctgagttcaagaaggataatcgtgcttttatatcttctgatccagcagctgttgagagatatattgttgtgcatggacagataatactacaactctttgcagagtttcctgatgaaaagattaaaaagtgtgcatttgtggttggccttgcaaataaaatggaagagagacaccatacaaaatggttagtcaagaagaagaaagttgtacacaagaatgaaccaaatttaaatcctcgagcagcaatgatgcctatagcttctataagaaaggctatgcaggcgaccacaacaaggctaatcaataggatttggggggaatactattcaaactactctccagaagattcaaaggaggaaactaattgtgaggtgaaagatgaagatgaaaatgaggaacaagaagaaaatgaagatgatgatggtgatgctaatgctgaagctgaagctgaagctgaagctgaagctgaagctgaagctgatgctaatgctaatgctgaagataaaccgattccaatggagactcagaagtctccttcagtatcaaagcaacctagacagtgttctactgaggaagtaagctgggatggagagcctgtaagccaaacaagctctgataagcctctttataaacgagccattgtacatggagaagtagttgtggtcggaagtgctgtttctgttgaagttgatttgtatgaacttcctgcaatctattttgtggagtacatgtttgaaacttcaaagggaagaaaaatgtttcatggacgaatgatgcagagaggatctgaaactgtacttggcaatgcagctaatgagagagaggtgttcctaacaaataactgtggagattttgaattggaggatgtgaaacagactgtggtggtagatattcgattaagaccttggggatatcagcataggaaagataatgccaacatggacaaacttgatagagcagaagcagaggagaggaagagaaaaggacttccaatggagtattattgtaaaagcttgtattggcctgagaggggtgccttctatacgctccccattgattctttgggtttgggttctggttgctgccattcttgccaagttaaggatgctgggagggccaaagaagtgttcaaagtgaattcatcaaatacaggctttgtatacaagggaactgagtactctctccatgattatgtctatgtcagtccacatcaatttacagtagaaagggctgagactgaaaactttaaagctgggaggaatataggcttgaagccttatgttgtgtgccaagtgctagagattattatcccaaaggggcagaaaaaagtttgtgaagagtccacccaagttaaagtcaggagatttttccgaccagaggacatttcagctgaaaaggcttacagttctgatataagagaggtaggtgctatcctaaaatacgatgacagttataaacttcatattgtcatagttttagttatacttttctatggtaaatttatatgtttttttttaaatttaaattttcaggtctattatagtgaagaaacagacattttgtttgttgaggcaatagaaggcaaatgtgaagtcagaaagaagaacgaccttccagcatgcaattctccagtaatatttcatcatgtcttcttttgcgatcgcatatatgacccttccaatggatctctcaagcaggtgattcccttttgcttcctttgctgtagtgcttgttgggaatgatacttccataatcattttcatggtaatttttgtttgcatttataatttgtcctttggaggataactaacttcccccttttttggttggcaaacagttaccagctcaagtaaaactaaggtactcaactggaattgtggataatgaaattgcataccaaaagaaaaagggtaagggtaaacaggaagaaagtgaattagaagttgagaaacagcaagaagcatatcaggagaaccgcttggctacgttagacatatttgcaggttgtggaggtctgtcagaggggttgcaccaatctggtactgtctacctttctgtctatttcatcaatttttatgtgcttagccatatttatttcttaggcactttatgtccaaccatcttttgttattactggtgtaggtgtatcattaactaaatgggcaattgaatatgaagagcctgctggagatgcattcaaactcaatcatcctgagtcattggtcttcattaaaaactgcaatgtcattcttaggtccgtatgacaagtttgctctcctctattcctgtttaaattgctaataactaaaagcaagttataatacagggctattatggagaagtgtggggatgtagatgactgcatctccacttctgaggcagctgaattagcggcatcacttgatgagaaagagattaatgatttgccattaccggggcaagtagatttcatcaatggaggccctccatgccaggtattatatattatagttttcctttgttatctaatctctggagtaattaataaatgattcattaagacaaagctgttttactttgcagggtttctctggaatgaatagatttaaccatagtacatggagtaaagtacaatgtgagatgattttagctttcttatcatttgctgattacttccggccaaggtatttcctcttagagaatgtgaggaacttcgtgtctttcaataaaggacagacgtttaagttaactctggcttcacttcttgaaatgggttatcaggtagatattcctttcacctaactgcaatttctgtaatatacttgttataagaatacaaatataagtacatgtgtggttgtgtatgatattctggttttgcccgtttaggtgaggtttggtattttggaagctggagcctatggagtttctcagtcaagaaaacgagcattcatatgggcagcctcccctgaagagactcttcctgaatggccagagccaatgcatgtctttgctgttccagagttgaaagttacattatcacataatttgcagtatgcagctgtgaggagtactgcaagtggagcccctttccgtgcaattactgtgcgagatacaattggtgatctaccagctgtaggaaatggggcctcaaagacgaatctggaggtaactacattgaaattatttccaaaattgcttcattctataaaaggttgtaagagcatattcaatttacaatgatttgtttccacagtatcaaagtgaagccgtctcatggtttcagaagaaaattcgaggaaacatggctgtccttactgatcatatatcaaaggaaatgaatgagcttaacctgattcggtgtcaaaagattccaaagcgaccaggcgcagattggcatgatcttccagacgagaaggtacataattggcttctgttctttgcatctgtttttaaatctgatcagaatgaaattgttgagctgctgggttgtttgtttccttaaaaattgcaggttaaactctctactggacaattggtagatttaataccctggtgtctgccaaatacagccaaaaggcacaatcaatggaaagggctatttggaaggctggattgggaagggaacttcccaacttccatcactgaccctcaaccaatgggcaaggttggaatgtgctttcatccagaacaggacaggattctgacggttcgggaatgtgctcggtctcaagtaagtcgttaaacttactgaacattcattgctatttggtttgtgaaagcttgggtagaatgaagtagaaaacattggtataagctcaatggatattgtttgtctgccaaaacagggtttcccagacatctacaagtttgctggtaacattcaacacaagcaccggcagataggaaatgcggttccacctccattggcatttgcattgggaaggaaactaaaggaagcattagacagtaaaaagtgaatgtaatttgaatttttagttgatgggattttgttaaagactcctccattttaccttagacaaaaggcccttaattcatttataaaaatttgttgtctggcttttttaaaaaaatctttttttgcgctctctcccttcctatatatatattgattacaattgatca

SEQ ID NO: 499 - DNA, 8874 bp, Gossypium raimondii
ttatatagagattggatttttgtgagtgttttttggcaagagctctttaggagggcatgaaccaaactcctactgtccatagcctatcaccctcaaaatgatggccaaattaaagttttaaactactgcattgacagttacctcaggtgtataataggggaaaggcttgttgattgggtgagttgattacctttggctaaatggtggtacaatttgacattctattcagccattcaacttacctcctataaggccttatatgggtagacaccattacaacatttgtcgtaccttgctgggatttcacttgtggccagtgtggattgaagcttgcaggctcaagaagctacaaggaaaatattgtaatttcatctaaaacaagcacaatcgaggatgaagcagttagctgacagacacaggattgatagataattccaaatgggagaattactttacttgaagttgcagccatataggaaataatcaattagcatggctcttaaccataaattatctcccaaatattttagcccttttcctatcatggccaaggttggacaagtggcttataggctatagttacctccaggatcacacatccattctacattacatgtttctcagctgaagaaacatgttggagcagcaccagtctaatcttaattgccattattggatgcacatgaggccttgcttaaggagccagtcagaatttgtgagcacaaaaatggttaagaaaaattaatcaactggtcattgaggtgcttgtggaatgggcagacactttcccttaagatgctacctaagaaccactgcaacagctgtgtgtcacctttcctcattttaatcatcgaggacaaggatctgttttggcaggtagtacttgttacgaggtaaaacttgaattagaaaaataaagataagttaagtaaacagggtgtaaaacaaggtgttttgttttagttaaacggtgcagataagaatttaatgaaagcggtacgcataaagggaagacaacggcctgagctattaataggccaactaacttttcaaacggctaattactttccttttaagcataccattatcgttgagcagtttcaatatttcttccttctcgattttcttctcttcctttttacttatgaattttctttcttgaattttctaattgcgtcataaaaatatataattttttttaagttaaacaatgaggactcaatacatttgaagtaaagttggagtttaagccttgtaaaaaataaaataatactaagagaatttatattagctcgaatttaaattttattaagagcaaatgtaattaaaggggcgaaaaatatccaatctcacttataaacgaaatagcaacgggtagggtatttgacttggtccatatggttgatgtgactttatacaatacaagtggacagcattgtcatagtttagggcggaaaacgggaaagaagtttcgattttttttgtgtgtttttggcgtttggggaaaaaaacttgtaaaaaagttaaaaatggtagaaaattttcttttttggaggaatggcgccaacatttttttccaaaatcagtgttcccgcctttctttgcttttccccttcatttatttataatgttcagtgtttcttccctttctattcatcttcactaaacactgttctcactgaacgaagccaaacatcaaagaaacagtgagtttagagctaaggttttcgtctcttctccaagtcatgggatctgtcgcgcttttggattctaattccccttcaggttttcctttttttattttattttaatctcttaaactgaattattgattccatatattcattcccgattgttgatttttgatttgctgctcaccgaagaaaagaaaaaaaggggggggggggctgggcccatgtctatattaatgtatattatcattttttacgcatttaattttatgtataagagagacgaaactgtagacttactgtttaagacaggtcatctagtctgagctaagccaatcaggtgatggcagtttgttttaattacatgttcaacaaaaatccctttttgttttggttttgtgattttcattgcaattatcgaaggttgcagcttgaatatgaaaatccaagtttagttgttattcagatggggtcttttgattattttctaggattttcttgtttctgcatgttgatcccttgtgctttaaccttcatgcactttgttttattttaatggggctagtcccgtttgagtttcttctgtgtccttttttttctggtggatttgatctttgggacctgttctttttttctataaaacctttggtttgataaacttgttacactagatttgcatttgtatttccctgtgagtttatgctaaacatctctaggttctacttacatttggctttgcaaaatgttttagcaaaacaagattgtgtgtgtctgtgtgtggacttgatctttgggacctgttctttttttttctataaaacctttggtttgatcaacttgtttgattagatttgcatttgtatttccctgtgagtttgtgctaaacatttcaaggttctgcttacatttgacttatcaaaatgttttagcaaaacaagattgcgtgtgtgcgtgaagaatcttgttaatacatttctttacaaagtaaaaattacctagtcttatgctttactgcaagatcttttttgtcttttcttttttttgcttagccgtttcagttatctgtgtgatcgtgctagcatattattttcttatatttttgtttatttatttttcatcatgcagtgatatagaagaggcatgttgtgtttatgctataccatttatttatatttttgtttctgatggttttttaaagtgcctaaactcaagttcacaagatctttttttggcatttaggaatgaagaagaataagaaaggcaagaataaatctgctaaatcttccaccaagaaagagatggaaactgataaaaaagtacagaagcgtaatagtgctcaggaaaatggggagccagtcccttcaaaaaggccaaagagagctgctgcctgcactgattttaaggagaaagcagtttgcatatctgaaaaggattcagttgttgagacaaagaaggatatggtagtagaagatgaaatcctagctgtagcgctgacttgtgaaaaagatgatggccggcctaataggaggctaactgattttgtattgcataattcagaaggtcttccacaaccctttgagatgttggaagtcattgacatgttcataactggtttgatattgccgcttgaagaaaatactgacaaggaaaaagtaaaggagaagagtgttagatgtgaaggatttggacatgttgagtcttgggacatctctggttatgaagatggttgtccagtgatatggctttcaactgatgtagctgattacacctgctgtaagccaagtggcagctataaaaaatattatgaacatttctttgaaaaagctcgagcttgtgtagaggtttataaaaaactttcaaagccttctggtggaaatcctgacttaagtcttgatgaattgcttgctggtgttgttcggtccatgagtggaagcaagagcttctctcgtggggcatcaattcgggattttgttatttcccagggagaatttatttataatcaactgattggtttggatgcaacttcgagggtaaatgaccaggtatttgctggattgcctgttcttactgccctcaaagatgagagcaggaagcgtgaaaatatagggctagacatagcactgttttctggtggtgctctgactattggtaaaaaaggagagggggaaagtaaattggatgagacatattcatctacttttacagctgaggaagatgaggatgcaaagttggcaaaactgttgcaagaggaagaatactggaaatctatgaaacagaagaggaaccaaggctcagcttctatgtcaaacaaattctatatcaaaatcaatgaagatgagattgcaaatgattatcctcttccagcatactacaagaattctaatgaagaaactgatgaacttgtagtttttgaaagtgactttgatgtgtgtgatcctgaggaactccctcgaagcgtgctccacaactggtcattttacaattcagactcaaggctgatttccttggagctgcttcctatgaaaccatgtgctgacattgatgttaccatttttggttctggggttatgactgctgatgatggaatcggattctgtcttgacaatgaccttagtcagtctacttcaggttcttcgagtgtgctgaatgctgatggaattccaatttttttgagtgctattaaggaatggatgattgaatttggatcatcaatgatattcatctcaatcaggacagacatggcctggtattgtctcatgtttcttgattaggattctgttgctataatatttttgctaactcatgtttgatctacaatgcctgcagaaaagtttctaaaaagtaaaaaaaaaaaaaaaaccatagttctttgcaattatctactaatatgcaaaacaaccagattttcctattcattaaataattagttttaactgtgacaagtttttattttctctccatttttcaggtatagacttggcaaaccatcaaagcaatatcttccatggtatgaaccagtactcaaaacagcaagggttgcaataagcattattacattgttgaaggagcaaacacgagtatcacgcctctctttcaatgatgtaattaagagggtgtctgagttcaagaaggataatcgtgcttttatatcttctgatccagcagctgttgagagatatattgttgtgcatggacagataatactacaactctttgcagagtttcctgatgaaaagattaaaaagtgtgcatttgtggttggccttgcaaataaaatggaagagagacaccatacaaaatggttagtcaagaagaagaaagttgtacacaagaatgaaccaaatttaaatcctcgagcagcaatgatgcctatagcttctataagaaaggctatgcaggcgaccacaacaaggctaatcaataggatttggggggaatactattcaaactactctccagaagattcaaaggaggaaactaattgtgaggtgaaagatgaagatgaaaatgaggaacaagaagaaaatgaagatgatgatggtgatgctaatgctgaagctgaagctgaagctgaagctgaagctgaagctgaagctgatgctaatgctaatgctgaagataaaccgattccaatggagactcagaagtctccttcagtatcaaagcaacctagacagtgttctactgaggaagtaagctgggatggagagcctgtaagccaaacaagctctgataagcctctttataaacgagccattgtacatggagaagtagttgtggtcggaagtgctgtttctgttgaagttgatttgtatgaacttcctgcaatctattttgtggagtacatgtttgaaacttcaaagggaagaaaaatgtttcatggacgaatgatgcagagaggatctgaaactgtacttggcaatgcagctaatgagagagaggtgttcctaacaaataactgtggagattttgaattggaggatgtgaaacagactgtggtggtagatattcgattaagaccttggggatatcagcataggaaagataatgccaacatggacaaacttgatagagcagaagcagaggagaggaagagaaaaggacttccaatggagtattattgtaaaagcttgtattggcctgagaggggtgccttctatacgctccccattgattctttgggtttgggttctggttgctgccattcttgccaagttaaggatgctgggagggccaaagaagtgttcaaagtgaattcatcaaatacaggctttgtatacaagggaactgagtactctctccatgattatgtctatgtcagtccacatcaatttacagtagaaagggctgagactgaaaactttaaagctgggaggaatataggcttgaagccttatgttgtgtgccaagtgctagagattattatcccaaaggggcagaaaaaagtttgtgaagagtccacccaagttaaagtcaggagatttttccgaccagaggacatttcagctgaaaaggcttacagttctgatataagagaggtaggtgctatcctaaaatacgatgacagttataaacttcatattgtcatagttttagttatacttttctatggtaaatttatatgtttttttttaaatttaaattttcaggtctattatagtgaagaaacagacattttgtttgttgaggcaatagaaggcaaatgtgaagtcagaaagaagaacgaccttccagcatgcaattctccagtaatatttcatcatgtcttcttttgcgatcgcatatatgacccttccaatggatctctcaagcaggtgattcccttttgcttcctttgctgtagtgcttgttgggaatgatacttccataatcattttcatggtaatttttgtttgcatttataatttgtcctttggaggataactaacttcccccttttttggttggcaaacagttaccagctcaagtaaaactaaggtactcaactggaattgtggataatgaaattgcataccaaaagaaaaagggtaagggtaaacaggaagaaagtgaattagaagttgagaaacagcaagaagcatatcaggagaaccgcttggctacgttagacatatttgcaggttgtggaggtctgtcagaggggttgcaccaatctggtactgtctacctttctgtctatttcatcaatttttatgtgcttagccatatttatttcttaggcactttatgtccaaccatcttttgttattactggtgtaggtgtatcattaactaaatgggcaattgaatatgaagagcctgctggagatgcattcaaactcaatcatcctgagtcattggtcttcattaaaaactgcaatgtcattcttaggtccgtatgacaagtttgctctcctctattcctgtttaaattgctaataactaaaagcaagttataatacagggctattatggagaagtgtggggatgtagatgactgcatctccacttctgaggcagctgaattagcggcatcacttgatgagaaagagattaatgatttgccattaccggggcaagtagatttcatcaatggaggccctccatgccaggtattatatattatagttttcctttgttatctaatctctggagtaattaataaatgattcattaagacaaagctgttttactttgcagggtttctctggaatgaatagatttaaccatagtacatggagtaaagtacaatgtgagatgattttagctttcttatcatttgctgattacttccggccaaggtatttcctcttagagaatgtgaggaacttcgtgtctttcaataaaggacagacgtttaagttaactctggcttcacttcttgaaatgggttatcaggtagatattcctttcacctaactgcaatttctgtaatatacttgttataagaatacaaatataagtacatgtgtggttgtgtatgatattctggttttgcccgtttaggtgaggtttggtattttggaagctggagcctatggagtttctcagtcaagaaaacgagcattcatatgggcagcctcccctgaagagactcttcctgaatggccagagccaatgcatgtctttgctgttccagagttgaaagttacattatcacataatttgcagtatgcagctgtgaggagtactgcaagtggagcccctttccgtgcaattactgtgcgagatacaattggtgatctaccagctgtaggaaatggggcctcaaagacgaatctggaggtaactacattgaaattatttccaaaattgcttcattctataaaaggttgtaagagcatattcaatttacaatgatttgtttccacagtatcaaagtgaagccgtctcatggtttcagaagaaaattcgaggaaacatggctgtccttactgatcatatatcaaaggaaatgaatgagcttaacctgattcggtgtcaaaagattccaaagcgaccaggcgcagattggcatgatcttccagacgagaaggtacataattggcttctgttctttgcatctgtttttaaatctgatcagaatgaaattgttgagctgctgggttgtttgtttccttaaaaattgcaggttaaactctctactggacaattggtagatttaataccctggtgtctgccaaatacagccaaaaggcacaatcaatggaaagggctatttggaaggctggattgggaagggaacttcccaacttccatcactgaccctcaaccaatgggcaaggttggaatgtgctttcatccagaacaggacaggattctgacggttcgggaatgtgctcggtctcaagtaagtcgttaaacttactgaacattcattgctatttggtttgtgaaagcttgggtagaatgaagtagaaaacattggtataagctcaatggatattgtttgtctgccaaaacagggtttcccagacatctacaagtttgctggtaacattcaacacaagcaccggcagataggaaatgcggttccacctccattggcatttgcattgggaaggaaactaaaggaagcattagacagtaaaaagtgaatgtaatttgaatttttagttgatgggattttgttaaagactcctccattttaccttagacaaaaggcccttaattcatttataaaaatttgttgtctggctttttt

SEQ ID NO: 500 - DNA, 8311 bp, Gossypium raimondii
ggcttataggctatagttacctccaggatcacacatccattctacattacatgtttctcagctgaagaaacatgttggagcagcaccagtctaatcttaattgccattattggatgcacatgaggccttgcttaaggagccagtcagaatttgtgagcacaaaaatggttaagaaaaattaatcaactggtcattgaggtgcttgtggaatgggcagacactttcccttaagatgctacctaagaaccactgcaacagctgtgtgtcacctttcctcattttaatcatcgaggacaaggatctgttttggcaggtagtacttgttacgaggtaaaacttgaattagaaaaataaagataagttaagtaaacagggtgtaaaacaaggtgttttgttttagttaaacggtgcagataagaatttaatgaaagcggtacgcataaagggaagacaacggcctgagctattaataggccaactaacttttcaaacggctaattactttccttttaagcataccattatcgttgagcagtttcaatatttcttccttctcgattttcttctcttcctttttacttatgaattttctttcttgaattttctaattgcgtcataaaaatatataattttttttaagttaaacaatgaggactcaatacatttgaagtaaagttggagtttaagccttgtaaaaaataaaataatactaagagaatttatattagctcgaatttaaattttattaagagcaaatgtaattaaaggggcgaaaaatatccaatctcacttataaacgaaatagcaacgggtagggtatttgacttggtccatatggttgatgtgactttatacaatacaagtggacagcattgtcatagtttagggcggaaaacgggaaagaagtttcgattttttttgtgtgtttttggcgtttggggaaaaaaacttgtaaaaaagttaaaaatggtagaaaattttcttttttggaggaatggcgccaacatttttttccaaaatcagtgttcccgcctttctttgcttttccccttcatttatttataatgttcagtgtttcttccctttctattcatcttcactaaacactgttctcactgaacgaagccaaacatcaaagaaacagtgagtttagagctaaggttttcgtctcttctccaagtcatgggatctgtcgcgcttttggattctaattccccttcaggttttcctttttttattttattttaatctcttaaactgaattattgattccatatattcattcccgattgttgatttttgatttgctgctcaccgaagaaaagaaaaaaaggggggggggggctgggcccatgtctatattaatgtatattatcattttttacgcatttaattttatgtataagagagacgaaactgtagacttactgtttaagacaggtcatctagtctgagctaagccaatcaggtgatggcagtttgttttaattacatgttcaacaaaaatccctttttgttttggttttgtgattttcattgcaattatcgaaggttgcagcttgaatatgaaaatccaagtttagttgttattcagatggggtcttttgattattttctaggattttcttgtttctgcatgttgatcccttgtgctttaaccttcatgcactttgttttattttaatggggctagtcccgtttgagtttcttctgtgtccttttttttctggtggatttgatctttgggacctgttctttttttctataaaacctttggtttgataaacttgttacactagatttgcatttgtatttccctgtgagtttatgctaaacatctctaggttctacttacatttggctttgcaaaatgttttagcaaaacaagattgtgtgtgtctgtgtgtggacttgatctttgggacctgttctttttttttctataaaacctttggtttgatcaacttgtttgattagatttgcatttgtatttccctgtgagtttgtgctaaacatttcaaggttctgcttacatttgacttatcaaaatgttttagcaaaacaagattgcgtgtgtgcgtgaagaatcttgttaatacatttctttacaaagtaaaaattacctagtcttatgctttactgcaagatcttttttgtcttttcttttttttgcttagccgtttcagttatctgtgtgatcgtgctagcatattattttcttatatttttgtttatttatttttcatcatgcagtgatatagaagaggcatgttgtgtttatgctataccatttatttatatttttgtttctgatggttttttaaagtgcctaaactcaagttcacaagatctttttttggcatttaggaatgaagaagaataagaaaggcaagaataaatctgctaaatcttccaccaagaaagagatggaaactgataaaaaagtacagaagcgtaatagtgctcaggaaaatggggagccagtcccttcaaaaaggccaaagagagctgctgcctgcactgattttaaggagaaagcagtttgcatatctgaaaaggattcagttgttgagacaaagaaggatatggtagtagaagatgaaatcctagctgtagcgctgacttgtgaaaaagatgatggccggcctaataggaggctaactgattttgtattgcataattcagaaggtcttccacaaccctttgagatgttggaagtcattgacatgttcataactggtttgatattgccgcttgaagaaaatactgacaaggaaaaagtaaaggagaagagtgttagatgtgaaggatttggacatgttgagtcttgggacatctctggttatgaagatggttgtccagtgatatggctttcaactgatgtagctgattacacctgctgtaagccaagtggcagctataaaaaatattatgaacatttctttgaaaaagctcgagcttgtgtagaggtttataaaaaactttcaaagccttctggtggaaatcctgacttaagtcttgatgaattgcttgctggtgttgttcggtccatgagtggaagcaagagcttctctcgtggggcatcaattcgggattttgttatttcccagggagaatttatttataatcaactgattggtttggatgcaacttcgagggtaaatgaccaggtatttgctggattgcctgttcttactgccctcaaagatgagagcaggaagcgtgaaaatatagggctagacatagcactgttttctggtggtgctctgactattggtaaaaaaggagagggggaaagtaaattggatgagacatattcatctacttttacagctgaggaagatgaggatgcaaagttggcaaaactgttgcaagaggaagaatactggaaatctatgaaacagaagaggaaccaaggctcagcttctatgtcaaacaaattctatatcaaaatcaatgaagatgagattgcaaatgattatcctcttccagcatactacaagaattctaatgaagaaactgatgaacttgtagtttttgaaagtgactttgatgtgtgtgatcctgaggaactccctcgaagcgtgctccacaactggtcattttacaattcagactcaaggctgatttccttggagctgcttcctatgaaaccatgtgctgacattgatgttaccatttttggttctggggttatgactgctgatgatggaatcggattctgtcttgacaatgaccttagtcagtctacttcaggttcttcgagtgtgctgaatgctgatggaattccaatttttttgagtgctattaaggaatggatgattgaatttggatcatcaatgatattcatctcaatcaggacagacatggcctggtattgtctcatgtttcttgattaggattctgttgctataatatttttgctaactcatgtttgatctacaatgcctgcagaaaagtttctaaaaagtaaaaaaaaaaaaaaaaccatagttctttgcaattatctactaatatgcaaaacaaccagattttcctattcattaaataattagttttaactgtgacaagtttttattttctctccatttttcaggtatagacttggcaaaccatcaaagcaatatcttccatggtatgaaccagtactcaaaacagcaagggttgcaataagcattattacattgttgaaggagcaaacacgagtatcacgcctctctttcaatgatgtaattaagagggtgtctgagttcaagaaggataatcgtgcttttatatcttctgatccagcagctgttgagagatatattgttgtgcatggacagataatactacaactctttgcagagtttcctgatgaaaagattaaaaagtgtgcatttgtggttggccttgcaaataaaatggaagagagacaccatacaaaatggttagtcaagaagaagaaagttgtacacaagaatgaaccaaatttaaatcctcgagcagcaatgatgcctatagcttctataagaaaggctatgcaggcgaccacaacaaggctaatcaataggatttggggggaatactattcaaactactctccagaagattcaaaggaggaaactaattgtgaggtgaaagatgaagatgaaaatgaggaacaagaagaaaatgaagatgatgatggtgatgctaatgctgaagctgaagctgaagctgaagctgaagctgaagctgaagctgatgctaatgctaatgctgaagataaaccgattccaatggagactcagaagtctccttcagtatcaaagcaacctagacagtgttctactgaggaagtaagctgggatggagagcctgtaagccaaacaagctctgataagcctctttataaacgagccattgtacatggagaagtagttgtggtcggaagtgctgtttctgttgaagttgatttgtatgaacttcctgcaatctattttgtggagtacatgtttgaaacttcaaagggaagaaaaatgtttcatggacgaatgatgcagagaggatctgaaactgtacttggcaatgcagctaatgagagagaggtgttcctaacaaataactgtggagattttgaattggaggatgtgaaacagactgtggtggtagatattcgattaagaccttggggatatcagcataggaaagataatgccaacatggacaaacttgatagagcagaagcagaggagaggaagagaaaaggacttccaatggagtattattgtaaaagcttgtattggcctgagaggggtgccttctatacgctccccattgattctttgggtttgggttctggttgctgccattcttgccaagttaaggatgctgggagggccaaagaagtgttcaaagtgaattcatcaaatacaggctttgtatacaagggaactgagtactctctccatgattatgtctatgtcagtccacatcaatttacagtagaaagggctgagactgaaaactttaaagctgggaggaatataggcttgaagccttatgttgtgtgccaagtgctagagattattatcccaaaggggcagaaaaaagtttgtgaagagtccacccaagttaaagtcaggagatttttccgaccagaggacatttcagctgaaaaggcttacagttctgatataagagaggtaggtgctatcctaaaatacgatgacagttataaacttcatattgtcatagttttagttatacttttctatggtaaatttatatgtttttttttaaatttaaattttcaggtctattatagtgaagaaacagacattttgtttgttgaggcaatagaaggcaaatgtgaagtcagaaagaagaacgaccttccagcatgcaattctccagtaatatttcatcatgtcttcttttgcgatcgcatatatgacccttccaatggatctctcaagcaggtgattcccttttgcttcctttgctgtagtgcttgttgggaatgatacttccataatcattttcatggtaatttttgtttgcatttataatttgtcctttggaggataactaacttcccccttttttggttggcaaacagttaccagctcaagtaaaactaaggtactcaactggaattgtggataatgaaattgcataccaaaagaaaaagggtaagggtaaacaggaagaaagtgaattagaagttgagaaacagcaagaagcatatcaggagaaccgcttggctacgttagacatatttgcaggttgtggaggtctgtcagaggggttgcaccaatctggtactgtctacctttctgtctatttcatcaatttttatgtgcttagccatatttatttcttaggcactttatgtccaaccatcttttgttattactggtgtaggtgtatcattaactaaatgggcaattgaatatgaagagcctgctggagatgcattcaaactcaatcatcctgagtcattggtcttcattaaaaactgcaatgtcattcttaggtccgtatgacaagtttgctctcctctattcctgtttaaattgctaataactaaaagcaagttataatacagggctattatggagaagtgtggggatgtagatgactgcatctccacttctgaggcagctgaattagcggcatcacttgatgagaaagagattaatgatttgccattaccggggcaagtagatttcatcaatggaggccctccatgccaggtattatatattatagttttcctttgttatctaatctctggagtaattaataaatgattcattaagacaaagctgttttactttgcagggtttctctggaatgaatagatttaaccatagtacatggagtaaagtacaatgtgagatgattttagctttcttatcatttgctgattacttccggccaaggtatttcctcttagagaatgtgaggaacttcgtgtctttcaataaaggacagacgtttaagttaactctggcttcacttcttgaaatgggttatcaggtagatattcctttcacctaactgcaatttctgtaatatacttgttataagaatacaaatataagtacatgtgtggttgtgtatgatattctggttttgcccgtttaggtgaggtttggtattttggaagctggagcctatggagtttctcagtcaagaaaacgagcattcatatgggcagcctcccctgaagagactcttcctgaatggccagagccaatgcatgtctttgctgttccagagttgaaagttacattatcacataatttgcagtatgcagctgtgaggagtactgcaagtggagcccctttccgtgcaattactgtgcgagatacaattggtgatctaccagctgtaggaaatggggcctcaaagacgaatctggaggtaactacattgaaattatttccaaaattgcttcattctataaaaggttgtaagagcatattcaatttacaatgatttgtttccacagtatcaaagtgaagccgtctcatggtttcagaagaaaattcgaggaaacatggctgtccttactgatcatatatcaaaggaaatgaatgagcttaacctgattcggtgtcaaaagattccaaagcgaccaggcgcagattggcatgatcttccagacgagaaggtacataattggcttctgttctttgcatctgtttttaaatctgatcagaatgaaattgttgagctgctgggttgtttgtttccttaaaaattgcaggttaaactctctactggacaattggtagatttaataccctggtgtctgccaaatacagccaaaaggcacaatcaatggaaagggctatttggaaggctggattgggaagggaacttcccaacttccatcactgaccctcaaccaatgggcaaggttggaatgtgctttcatccagaacaggacaggattctgacggttcgggaatgtgctcggtctcaagtaagtcgttaaacttactgaacattcattgctatttggtttgtgaaagcttgggtagaatgaagtagaaaacattggtataagctcaatggatattgtttgtctgccaaaacagggtttcccagacatctacaagtttgctggtaacattcaacacaagcaccggcagataggaaatgcggttccacctccattggcatttgcattgggaaggaaactaaaggaagcattagacagtaaaaagtgaatgtaatttgaatttttagttgatgggattttgttaaagactcctccattttaccttagacaaaaggcccttaattcatttataaaaatttgttgtctggctttttt

SEQ ID NO: 501 - DNA, 7567 bp, Gossypium raimondii
attaagagcaaatgtaattaaaggggcgaaaaatatccaatctcacttataaacgaaatagcaacgggtagggtatttgacttggtccatatggttgatgtgactttatacaatacaagtggacagcattgtcatagtttagggcggaaaacgggaaagaagtttcgattttttttgtgtgtttttggcgtttggggaaaaaaacttgtaaaaaagttaaaaatggtagaaaattttcttttttggaggaatggcgccaacatttttttccaaaatcagtgttcccgcctttctttgcttttccccttcatttatttataatgttcagtgtttcttccctttctattcatcttcactaaacactgttctcactgaacgaagccaaacatcaaagaaacagtgagtttagagctaaggttttcgtctcttctccaagtcatgggatctgtcgcgcttttggattctaattccccttcaggttttcctttttttattttattttaatctcttaaactgaattattgattccatatattcattcccgattgttgatttttgatttgctgctcaccgaagaaaagaaaaaaaggggggggggggctgggcccatgtctatattaatgtatattatcattttttacgcatttaattttatgtataagagagacgaaactgtagacttactgtttaagacaggtcatctagtctgagctaagccaatcaggtgatggcagtttgttttaattacatgttcaacaaaaatccctttttgttttggttttgtgattttcattgcaattatcgaaggttgcagcttgaatatgaaaatccaagtttagttgttattcagatggggtcttttgattattttctaggattttcttgtttctgcatgttgatcccttgtgctttaaccttcatgcactttgttttattttaatggggctagtcccgtttgagtttcttctgtgtccttttttttctggtggatttgatctttgggacctgttctttttttctataaaacctttggtttgataaacttgttacactagatttgcatttgtatttccctgtgagtttatgctaaacatctctaggttctacttacatttggctttgcaaaatgttttagcaaaacaagattgtgtgtgtctgtgtgtggacttgatctttgggacctgttctttttttttctataaaacctttggtttgatcaacttgtttgattagatttgcatttgtatttccctgtgagtttgtgctaaacatttcaaggttctgcttacatttgacttatcaaaatgttttagcaaaacaagattgcgtgtgtgcgtgaagaatcttgttaatacatttctttacaaagtaaaaattacctagtcttatgctttactgcaagatcttttttgtcttttcttttttttgcttagccgtttcagttatctgtgtgatcgtgctagcatattattttcttatatttttgtttatttatttttcatcatgcagtgatatagaagaggcatgttgtgtttatgctataccatttatttatatttttgtttctgatggttttttaaagtgcctaaactcaagttcacaagatctttttttggcatttaggaatgaagaagaataagaaaggcaagaataaatctgctaaatcttccaccaagaaagagatggaaactgataaaaaagtacagaagcgtaatagtgctcaggaaaatggggagccagtcccttcaaaaaggccaaagagagctgctgcctgcactgattttaaggagaaagcagtttgcatatctgaaaaggattcagttgttgagacaaagaaggatatggtagtagaagatgaaatcctagctgtagcgctgacttgtgaaaaagatgatggccggcctaataggaggctaactgattttgtattgcataattcagaaggtcttccacaaccctttgagatgttggaagtcattgacatgttcataactggtttgatattgccgcttgaagaaaatactgacaaggaaaaagtaaaggagaagagtgttagatgtgaaggatttggacatgttgagtcttgggacatctctggttatgaagatggttgtccagtgatatggctttcaactgatgtagctgattacacctgctgtaagccaagtggcagctataaaaaatattatgaacatttctttgaaaaagctcgagcttgtgtagaggtttataaaaaactttcaaagccttctggtggaaatcctgacttaagtcttgatgaattgcttgctggtgttgttcggtccatgagtggaagcaagagcttctctcgtggggcatcaattcgggattttgttatttcccagggagaatttatttataatcaactgattggtttggatgcaacttcgagggtaaatgaccaggtatttgctggattgcctgttcttactgccctcaaagatgagagcaggaagcgtgaaaatatagggctagacatagcactgttttctggtggtgctctgactattggtaaaaaaggagagggggaaagtaaattggatgagacatattcatctacttttacagctgaggaagatgaggatgcaaagttggcaaaactgttgcaagaggaagaatactggaaatctatgaaacagaagaggaaccaaggctcagcttctatgtcaaacaaattctatatcaaaatcaatgaagatgagattgcaaatgattatcctcttccagcatactacaagaattctaatgaagaaactgatgaacttgtagtttttgaaagtgactttgatgtgtgtgatcctgaggaactccctcgaagcgtgctccacaactggtcattttacaattcagactcaaggctgatttccttggagctgcttcctatgaaaccatgtgctgacattgatgttaccatttttggttctggggttatgactgctgatgatggaatcggattctgtcttgacaatgaccttagtcagtctacttcaggttcttcgagtgtgctgaatgctgatggaattccaatttttttgagtgctattaaggaatggatgattgaatttggatcatcaatgatattcatctcaatcaggacagacatggcctggtattgtctcatgtttcttgattaggattctgttgctataatatttttgctaactcatgtttgatctacaatgcctgcagaaaagtttctaaaaagtaaaaaaaaaaaaaaaaccatagttctttgcaattatctactaatatgcaaaacaaccagattttcctattcattaaataattagttttaactgtgacaagtttttattttctctccatttttcaggtatagacttggcaaaccatcaaagcaatatcttccatggtatgaaccagtactcaaaacagcaagggttgcaataagcattattacattgttgaaggagcaaacacgagtatcacgcctctctttcaatgatgtaattaagagggtgtctgagttcaagaaggataatcgtgcttttatatcttctgatccagcagctgttgagagatatattgttgtgcatggacagataatactacaactctttgcagagtttcctgatgaaaagattaaaaagtgtgcatttgtggttggccttgcaaataaaatggaagagagacaccatacaaaatggttagtcaagaagaagaaagttgtacacaagaatgaaccaaatttaaatcctcgagcagcaatgatgcctatagcttctataagaaaggctatgcaggcgaccacaacaaggctaatcaataggatttggggggaatactattcaaactactctccagaagattcaaaggaggaaactaattgtgaggtgaaagatgaagatgaaaatgaggaacaagaagaaaatgaagatgatgatggtgatgctaatgctgaagctgaagctgaagctgaagctgaagctgaagctgaagctgatgctaatgctaatgctgaagataaaccgattccaatggagactcagaagtctccttcagtatcaaagcaacctagacagtgttctactgaggaagtaagctgggatggagagcctgtaagccaaacaagctctgataagcctctttataaacgagccattgtacatggagaagtagttgtggtcggaagtgctgtttctgttgaagttgatttgtatgaacttcctgcaatctattttgtggagtacatgtttgaaacttcaaagggaagaaaaatgtttcatggacgaatgatgcagagaggatctgaaactgtacttggcaatgcagctaatgagagagaggtgttcctaacaaataactgtggagattttgaattggaggatgtgaaacagactgtggtggtagatattcgattaagaccttggggatatcagcataggaaagataatgccaacatggacaaacttgatagagcagaagcagaggagaggaagagaaaaggacttccaatggagtattattgtaaaagcttgtattggcctgagaggggtgccttctatacgctccccattgattctttgggtttgggttctggttgctgccattcttgccaagttaaggatgctgggagggccaaagaagtgttcaaagtgaattcatcaaatacaggctttgtatacaagggaactgagtactctctccatgattatgtctatgtcagtccacatcaatttacagtagaaagggctgagactgaaaactttaaagctgggaggaatataggcttgaagccttatgttgtgtgccaagtgctagagattattatcccaaaggggcagaaaaaagtttgtgaagagtccacccaagttaaagtcaggagatttttccgaccagaggacatttcagctgaaaaggcttacagttctgatataagagaggtaggtgctatcctaaaatacgatgacagttataaacttcatattgtcatagttttagttatacttttctatggtaaatttatatgtttttttttaaatttaaattttcaggtctattatagtgaagaaacagacattttgtttgttgaggcaatagaaggcaaatgtgaagtcagaaagaagaacgaccttccagcatgcaattctccagtaatatttcatcatgtcttcttttgcgatcgcatatatgacccttccaatggatctctcaagcaggtgattcccttttgcttcctttgctgtagtgcttgttgggaatgatacttccataatcattttcatggtaatttttgtttgcatttataatttgtcctttggaggataactaacttcccccttttttggttggcaaacagttaccagctcaagtaaaactaaggtactcaactggaattgtggataatgaaattgcataccaaaagaaaaagggtaagggtaaacaggaagaaagtgaattagaagttgagaaacagcaagaagcatatcaggagaaccgcttggctacgttagacatatttgcaggttgtggaggtctgtcagaggggttgcaccaatctggtactgtctacctttctgtctatttcatcaatttttatgtgcttagccatatttatttcttaggcactttatgtccaaccatcttttgttattactggtgtaggtgtatcattaactaaatgggcaattgaatatgaagagcctgctggagatgcattcaaactcaatcatcctgagtcattggtcttcattaaaaactgcaatgtcattcttaggtccgtatgacaagtttgctctcctctattcctgtttaaattgctaataactaaaagcaagttataatacagggctattatggagaagtgtggggatgtagatgactgcatctccacttctgaggcagctgaattagcggcatcacttgatgagaaagagattaatgatttgccattaccggggcaagtagatttcatcaatggaggccctccatgccaggtattatatattatagttttcctttgttatctaatctctggagtaattaataaatgattcattaagacaaagctgttttactttgcagggtttctctggaatgaatagatttaaccatagtacatggagtaaagtacaatgtgagatgattttagctttcttatcatttgctgattacttccggccaaggtatttcctcttagagaatgtgaggaacttcgtgtctttcaataaaggacagacgtttaagttaactctggcttcacttcttgaaatgggttatcaggtagatattcctttcacctaactgcaatttctgtaatatacttgttataagaatacaaatataagtacatgtgtggttgtgtatgatattctggttttgcccgtttaggtgaggtttggtattttggaagctggagcctatggagtttctcagtcaagaaaacgagcattcatatgggcagcctcccctgaagagactcttcctgaatggccagagccaatgcatgtctttgctgttccagagttgaaagttacattatcacataatttgcagtatgcagctgtgaggagtactgcaagtggagcccctttccgtgcaattactgtgcgagatacaattggtgatctaccagctgtaggaaatggggcctcaaagacgaatctggaggtaactacattgaaattatttccaaaattgcttcattctataaaaggttgtaagagcatattcaatttacaatgatttgtttccacagtatcaaagtgaagccgtctcatggtttcagaagaaaattcgaggaaacatggctgtccttactgatcatatatcaaaggaaatgaatgagcttaacctgattcggtgtcaaaagattccaaagcgaccaggcgcagattggcatgatcttccagacgagaaggtacataattggcttctgttctttgcatctgtttttaaatctgatcagaatgaaattgttgagctgctgggttgtttgtttccttaaaaattgcaggttaaactctctactggacaattggtagatttaataccctggtgtctgccaaatacagccaaaaggcacaatcaatggaaagggctatttggaaggctggattgggaagggaacttcccaacttccatcactgaccctcaaccaatgggcaaggttggaatgtgctttcatccagaacaggacaggattctgacggttcgggaatgtgctcggtctcaagtaagtcgttaaacttactgaacattcattgctatttggtttgtgaaagcttgggtagaatgaagtagaaaacattggtataagctcaatggatattgtttgtctgccaaaacagggtttcccagacatctacaagtttgctggtaacattcaacacaagcaccggcagataggaaatgcggttccacctccattggcatttgcattgggaaggaaactaaaggaagcattagacagtaaaaagtgaatgtaatttgaatttttagttgatgggattttgttaaagactcctccattttaccttagacaaaaggcccttaattcatttataaaaatttgttgtctggctttttt

SEQ ID NO: 502 - DNA, 13373 bp, Gossypium raimondii
gtgccttggaggagttattaaagaatcatcacttgagttaaggatgacttaggcgagtttggacgaacggatcgcctaaggccgcacggctcgagagacgaaaactctagccccgtgacactttcttatagtcatccttagtttgaaatttcacaaaaaaaaaaaaccaatttccacatctataagttgaaaaaacatagagggttgccataaacttggcactttattttggaaggcaacacatcctatgctctgccccaatagtttaaccactaccgtggtctctatgtcctttaacaggtaatgctaaacctgattggaaaaattagttgcaggcatttcgttcacagtggtccttgtgaagtcttcttccatggattcaaaatctttcccacaacctccaccagtacccactgacgaattgttggttttccctagaagcaagtccttccaagacaacgttggatccgacatcggatctacgaatccatttctttttccttaaatcatacttttttggtattacgaacatcagacgaacaagcaccgtcatcctctttgttgccaaaagttaacgccattccaaaaccttaattttttttagttacaaaattcaatcaaaggttaacctagacaatggcaactatttaactaaataaaatattgtagccgattttaatgtccgcctataagcagctaagttgctctctaacccatctttatttgaggcattagaaaaaacagtagcagaaatgtttgaagcagccaaatgttcacctggaaaagagggatgaaattcttagaagtgatgtctaaacggaagcctaagatgcatctaacgaaaaacagcaaatataatattttaattcagcttaaattgaagtaagtggcaattagaattgaatgtagagagaaatgagtacaaaattagggtggattgtggacatcgaattgaaaaggcaaagcctctgagtcgagttactgacagatatgagatgacagggaaagcaactttattacatacgttaaagtttcacaatagtgggcattgttgtccagtaaccaaaaaaaaaaaaagaatctttaatttatgtcatcattacctttgtttttctttcagctccttttgcaatttcccttccaaataggaaattttagaaataattatgtgtttcctacctaacaaagacacactaatcccattttttaaaattgatcacatattttagatttcagaatggagtaggtgaatcataatatagtgtaattaataaaaaagtgacgctagaaaaagaaacccaaataatttcacgaaattacaagaataacccactttttatacatgtagatgaaaatttccatctgcccttatcagtaatttaactgggaagtgaaaacctagaaaaacacggtaacctaacaagttcacaataaagataattaaaaaaagaaaaaggtgatgccagaatcgtaaataaggtggagaatagggataatttgatccgacagcaagaggaaaaaaaaaagtaatatattttaagtcatcggcattggtcttctaatttcttgaactgggtggaattatatttgtcttcggtacaaaccggcggcgtctttatctctctatttctcgctcggttttttttctttcttaattttcaattttcgggattttacaaaaaatcaatttcgaggttgttgatttgaccctagttctttcttttatttataattttgccctctacacacttcaacatggtttcactgtacagagtcataatgatggtccgtctctcataatccatcctctctttcactctctctctctctctgttttcatttactcattgagaggccgggagtgtgtcgtttcagtggaaaaagtacattgcctttttatcaacagtgagtaaagtttttatctttaagtgttttcatgtatatttttttggggttatgggtgttgatcaatgctgcatgtttatttgttttgattggcgatcaatgttttcttccatttcttttctgcgtctttttacaatatggatttttgggtttttggctgattgtgatgatcttgtttgttttgacacttgattatggtttttgggtctttttgtagttactaaggaggttttcttgttctgcatggtggtctcggttaatgctattttcttttgttgtttgcggtatagtactattgatttagttttaaaacatgatgcattaaacaatgtgcttggaactatcatgtatactgatgaacttgatcgttttatatcagtagtagttgcataaacgtttgagctaaagcagggattctgtttttgttttgtgactgattcagcaatgagaacagtggtggtttatatattgcctcttgtgtattcgtttcttaaggtttatgttttacttcctgtcaatgatactgttctattctgtcggcagttaatgttgattgacctaattatgaacttgggattatccatatattttagttttaatggtttgctattatccactgtgctccttttttttcttcaagtgatgatggccatgactcgtgcatttttcctatgatcaattgatatagtgggtacatgtcttggaatttttatcaatgatgatgtagacttattaattgcgggcaggttataactgctataaatggcagcttgaattctaaatcgaggcttatttcgaaaatagcagttcattaactccgcatgtttgttctccttatgggttaagtaaagatgaatgaaacatagctcttatattcctagaggtatatggagggtttatggccgaatgcataccttctggctggacatgtcaacttggtttatttaaatgtggtgatagcttgtttgttgttgctgacctccagactatttatagctattgtttttttgcttctaaacatgattcctatattttgggactgaatttaaagttctatgtacttaaattttcttgcgccattgttgattttgattatgttgctttgggctagcaaaataagagaactaatctttaaacgtttgagtcaatcaattgaattctttgactgagaaggtggtaatgaaaactaaatgtttgtcgtctttactgctttcattctttacactaggaagctatgtacaaaaacatgtttaaggtttatttcagaatactgctgttggacctccgtccgattctttattatggagcaacttttttcatccatccggttctcatgggcagctggcctgagatattgcacgggctttagattaagatgcatttaacaaattttgacgagcagtttctctctctggaatacctcttggacttccataaatgatttattagttatttatattactgtggatgttgtgctcgtaggctttcatgtgttgagacatctttggtgtatgttattattccttggaaattcactttttgaactaaatatagttttaattgtaattcttgtgatccaatgtttaatcatcttatctctgtctttgtaattttatattaaactttatttgagttcttgccggcatgctatattgattgcttgttggtcatcagaagtcaaaagtcaatggcctccatggaaagtgactcatctgaagagcaagaaaattcaactgcctttctgactggcataaaatttcatgtctcgaacgacgctgataatgtaagtatatttcagtactgttttatctctttgtttatttccatgctggaattgataatactggaatgagttgagtgatttggatcactcaatccacacccaccttgtggtaatctaaaacacagtccaatctgtgtgatatatgtttatattgtcattggggcatctccccctatctccatatagatccttaaatttggcttggttctgttttagtttatgatgttcctttccatgaagccattcatgttatctattttttcctgccactggccttctttctttatagtttagtcactgattcatgctttttctgttttcaaggacaattattgcttcacggttattgtatgcttttcttcttaactttatgcttcagattgttttggacatggaaacgaacaatcatgtagtcttttaattatgtccatatttcaattccttgtagcaatttgagcacttatgattcttttctgatactgtgacaggagaacatgtctatcttggaaattactgcacccagtgaggtgtctgatcctaggttggggtttccgaatttttctaatcattgcaccacttgtgatgccagagatatgaaacaatgcgaaggtggatatcgaattagaaaaacttaaatgatattttgcatctgttaacttttttgtttctttatgtagctatcagtaacatactgatttctttccattcatctttgtaggccattttggggttattaaatttccatacacaatactccatccattttttctttcagaagttgtacatatattaaataagatttgcccaggatgtaaatcgatccggaaagatctatggatgaaggtcgggtacctctcaccttcatcaactgaggatcatcatactgttataatttttcctttttcttccattataacatattattgttattccttcttgtcatcctaaagaaaggaaaaaggataaaatagaaattaaaataatatttgaagaatttaaagttcaaaacaaagcctgtatcccttttggcacaatttaattttctgcaagttatgacttttacctgtttttaactatgctgattttagaagtgagagtaccctctaggatccgattttctggtagtatgtttactttcttttttgagcaaactatgtcctggtgtaggcaattttgatgtttttttttcttgcatgtaccagggtgctaattctatagccagattacttgaaaccaaggggtgtaaatattgtgttgtaagtttgtctggcttcttgttttcttaatcctcttttttttttttttcccttttttgtactaatgatttctggaaacaggggaattcaatagagtggtatccacccatgagattcaagataacctcgaaagagcttttcagaaaaagtgcaatcatggtagaggtaagtgaaaactctttaatgaaggtccggaagagaggaaggcaagcattacctgcagattactgggactttattccaaaagatcaacaacaagaagaaggttttgtgaaaccaggtagaagagtcctatcacatgcccaggtatcatgttcttttccaattcacatgaaaaaattatatttctttgttgtctctaatgtcatctcatatgatttatttatgggaatgcaatccactaaatctggtacatactaattaaaaactttttgttgatatatgttttgcagtgaattttttattcatttcctactttattttgtctgcattgatatttaccaacattgaatttttaactatgaagggaaaaaaaaaactcaattatttgattcttaacaatgtctggtggtagtttttggaaggtggaagagagtgagttggttgtttccataaaatgcaaacattccggttggcaaatgcgaattggttttggaatcttgtcatacaataatatcgttttaaccaaaacttaaaactgttagtgatttgaaaactatcatgggtttatatgggattttgctttctatagaactattatgatattataatagatatggctctaattcagctttcttggcaaggaaaattgttgttacttgcatgtgaagaaggaaaaatgaaggaaaatatctcctaatttgtttcatgtgttaatatataatatatcctagttgctatattactggaagagtattttggttttggaaactattattcaagtctcaaatattcttttaaagtgtagagcagaatcaagcattggagtggcctaccccttccccttatatatatatcagaccttccttcactactttgatgagtgcataatgcttattggttttcaggttcgacatttgttgaaggacgttaatccagagttcattaaaaagtttatttcagaagcagactctattttcctcaatttttttcctgtgacacccaatagtcaccgagtgacagaaatcatgcatacatcttctaatgcgcagcgattgatctttgtaagagtctttactttgaacatcctcatttacatgcttccaaggttgtggttgatatggatggtttatcttattatatgcattacatttgttttcttttcagttttactgaattttctggttaatatggttttgttgtaggatgaaagaaccagggtttacaagaaactggttgacttcagagggctagcaaatgaattgagctctcatgtattggaatgcctaaaaatttctaaggcaagttatacctttcttcctttttaattaaaatttggtccaactttcatggaaccttatgctctctttctttgattgcattcaacgtgcagctgcatgtggagaagccatcaactgaagattctgcactcattgctgctctgaaaaagaataaagattctgcttccaacatgtcaggtttaagatatatgaaagatgttattcttgggaagagaaacgaccattgcttccgcatggttcttactggaaacccaaatcttaaactgtctgaaattggtatcccatgtcatgttgccgagaaattgcaaatcgctgagcaactgaacaggtggaatgaggagagattgaaaacttgttgtaatctgcgtattcttgagaagggtgagattcgcattaggagagaaggtaaattagttagaattcgtcataatgaaaaggtccaagtaggggacactatctataggcccctaaatgatggggatacagtacttataaatagacctccttctatacatcagcactctctcattgcgctatctgttaaagttctacctgtcaattcagttgtttcgataaacccactaatatgttccccttttcgtggagattttgatggtgattgccttcatggttatgttcctcagtccattaacacaagagttgagctcagtgagcttgtttctttggataggcagctaattaatggccaaagtggtcgaaatctgctttcactcagtcatgatagtttaacggctgcttatttggtcaaggaggacggggtactattgaacctgttccagatgcaacagctggaaatgttctgtcctaatcattcgccattgccagccattgtcaaagctcctttgctaagtaatcctgtttggactggaaagcagttatttagcatgctctttcctcccgaatttgattatgtttttgcaccaagtggtgttgtaatccacaatggggatctcatatgttcttctgaagggtcttcttggctacgagatgctgacggcaacctttttcaaagtcttattaagcattaccaaggaaaggtccttgactttttgcatgctgctcaggaagttctttgtgagtggttgtcaatgaggggtttgagtgtttcactcttggacctatatctatctcctgacacagattcacaaaagaacatgatggatgaaatcttctatggtctgcaagaagcagagcagacatgtaacttcaagcagttaatggttgattcttgtcaagatttccttgctggaaacgatgaagaaactaataggttcatggttttggatgttgagcagatgtgctatgagaaacaaagatctgctgcacttagccaagcttctgttgattcatttaagcaagttttccgtgatattcagaatttactctacaagtatgcaaataaagacaattcattattcaccatgttcaaagcagggagcaagggtaacttgctgaagttagtacagcatagtatgtgtcttggattgcaacattcacttgtccctttatcattcagatttcctcatcagctctcatgtgctgcatggaataatcaaaagtctcacatcttaacccaaaaggttgatgatactgatgagtctgctaagaaatatatcccctatgctgtggtcgaaagttcgtttgtgaagggtctgaatccattagaatgttttgttcattcagtgactactcgagacacatctttcagtgacaatgctgaccttcctgggacgctgtcacgaaggttgatgttcttcatgcgtgatctatgcgcagcatatgatggaactgtgaggaatgcatatggagatcaggttgttcagttctgttataatatcgataagggtacatttagtccaactagttgccctgacaaattagtaagtcagggcagtagtcttcctgatggaattggtggacaacctgttggttcattatctgcctgtgccatttctgaggctgcatatagtgcattggatcagccaattagtctacttgaatcttctccattgctgaacttgaaggtgctctctctatctcctcacctccacctcctcctccctctccccctcccatcctcgatggtgttttgaagaattaaaaaacttgtcaaagaatttctttccctccaacctgatgaggaaatgggtgaccttttcatctaaaggaaatttgaaggatacaaaattactgtgctgaaacctacctaatagagttgataaggaccttgacactgttgagaacaaaagcaaatgatctttacgtgttcatggtcaactacaatacatgctgcttcgtaatgtaccttctaatagattaagtggcatatgatttctttttatgttcatgcaccaccatgattcagtccaccaaaattattttacatattattgcagatggtaggatgctaacatattattctgattaaattgctcagagggtccttgagtgtggttctaaaagaagcaatgctgaccagactatgtcactatttttatctggtaaacttgtaaggagaaggcacggtcaggagtatggagccttagaagtcaagaatcatttggagaggctgatctttaaagatattgtgtctactgtctcaataatgtgagtttaagttcctttctcattgtcttgtcctttctcgttttgtgatttatttttcccattactttgatgcttttttatttgagatttattaatgtgttatatggcactagcttctctccacagatgtctagtgaaaaccgtttcagtccttgggtttgccattttcatgtgtttaaggtactgtgatacgcaagtggtgtatctatgttgataagatttccacttcaaagtttcacatcaaaattatttactttccaggatattgtgacaaggaggcggctaacagtgcattctattattgatgctcttcacatgcactgcaccaatgccaaaagactatggaaaatcaatttgcccgacatgcaagttacaagcaagtaagtttgcccctttttagcatgtgtagatgttgcaaaaaggaggcactggtaatatgtattgctcttttccctctagtccctgttgaaagaaatcttgaagaccccaaatttgtgctttttctgtcaatattaagatcatgacctatatctttgtacatgtattatcactttctgatgcagaaatagggcttcaatcttttgttttcatggcttgcacccaagtttatgccttgatttttgtggtccttgtcaatctaatctcagcctgtctcaaagttgtatggttagatgcatgaaaaactataatcagcataaattcaatttaattatttcatttgagggcttcaaattttcaataatatgcttccagatggtagttgttccaatgcatttgaattctgaagggtggaaaatggtcgctgtaattgaatctgctagcattattgtttacttcctagagctttattttgcttcttatttgtttgattgaatgacagggcctgttctgttattgacatggaaaatgaagatgatacgttttgtatcactgtcacaattgttgaatgtaaaacttctcgtatagaactggatgtgattcaagacatggtgataccttcccttctggaagcagtggtaaaaggtatgtacttgcatccaaattgactagtattttttttttgaaggagcaaattgactagtgttaggaatcccatttgagggctgatttggtgaaatggcttagacctttattatgggtctttgaacaactaccgtcaagattgagaatatagtgttggaatctaaatttgccatgtgaattgctggtagactatttctatcactctgtttttgaaaatattgaaggttacgccttccctcagtgtgcatttcttatcttttacctataactgttaattccctattttgattacgtctgtttattggaggaagttctgatatttgaacttgtatcattgtatgaccaaatttctggtaggaaaagcagaatctttagtagggtctggtcaaatgtaaaaggcaatatttaaaccaccagaaatatcaaatggcctaaaagatgtgacatgcatctttgtagatatgcattacaagttgattacaagttggtaatattcatctgtttctgccttcaaatttttgaaattttctttaggattcccggagatcaagaaggtggaaattctatggaatgaggatttcagagtcccaaattctcataaacctgctcctggtgaactttacttgagggtttctgtatctggcgattttggtataacgaaactctggagtgtgcttatgaatgattgcctccaactaatggatataatcgattggacacggagccatccagataacattaatcagttttgcttggcattcggaatagatgctggatggagattctttctcaatgtttgttatccttgttataatttattccctgttttctacttgcacaaaagcttaagggtaactgcatatattaacctgctcatgcgtttctctatgcagaatatgaagagtgcaatatcagatactggcaagtctatactaaatgaacatctacaccttgctgccaattgtctgtcagctaccggggagtttgttggtttaaattcaaaaggcttgaaacaacaaagagaacatgcatttgtctcttctcctttcatgcaagcatgcttttcagttagttcttgtcattgtttcccctttgatgctcttaatataaaatgtttaagtagctgtcatttttatagtcaacttagctttatacaatttgtggcagaaccctagtgcttgctttgtcaaagctgcaaagactggagttgcggataatcttcaagggaccattgacctattggcttggggaagggttcctcgtattgggactggtggacagtttgatatagtctattctatgaaggtattttatgcagatcttgctgttgttttaaatatgtagcattgtggattagactttcactatagttgcatttaactgattggaaattgttgggtgttgaatatttaagcatctccccctattttttggttcaaaagaagagagaggcaaacaatgggtgagacataagataccattaaagttattttatgaataatgcattccggaagtgatatggagttacggatttgggcttgttaccaactgatgctgaataggatagtggaaataggttctcttcagaatgtaattggtttttgagagggaccaagtcagcaataaagaaactcgagcgaaatatgtatagaagagaatgcatcttgatggtaaatgtttctcaactaagagagtaacacttgtgaaggatcctattgtcgtatcactgacttggaaatttctgagtcaaagagctcaatttcgtatctcaagggcaggactatcctgtgcatgaggtacattttgatgcttatagtacagattcacttgttctcaatctggtcaaggtataaaaatgagctacgctactttcttagctgtatttgagatggagctgtatataagtttaatagtgcttcaaattaatcaagttttacatttttaatcattgttattttatactctcgaggtttagatccaaattccttagtagtctactggttcttcctttagtttccttcttaaaaaaaaagaagagatttttggctagtaactgtcattatatccatccatccatcccattactatttttcaggatgaagagcttgcagaaccggttgatgtgtataagctgctaggagattctattaattccaagaagcaggatatagagtttgaagtacctaaagtttttaaccctacatctgagaaacatagttctccgttcaagggagctcttcgtgactctgtctttgatgagtggaagaagattgaaacgaaaacaaggtcactcttgagaggacgtctaaccttgaatgacgttcagaggcttgagcgtaatttaaagaatattttgcgcaagtaagctttcctccagttgttggttatgttctatgtttatagtgctcaagtttttcctccattgttggtattgtacacgggctttggtgctcttatattctaatagcttttgatatctgtcccaaattcctaatattctctgaactcatggttgtgccgactgcagatatcctattgatcaccgtgtaagtgaagctgactgggataccttgatgatggcgttgtactttcaccctcatagagttgagaagatcggatctggagccaaggaaataaaggtacgtgatactggaaaaataggaaaaagaaagcaaaaaatgagacaatgaaaaaagaaaacaaaggttgttttaatgcttcatttccatatcttttgcaggtagggcatcatcccgatcatgcagacagtcgttgtttctttttggttagaacagatgagacaactgtagatttctcatatcggaaatgtgttgtcggtgcactcgagatcattgctccttgtagggcacaatcctacaagtcaaaatggttacaacatggtagtttgtaaaccaaactccacaagcgctcacttttgcatgtaaatatagcaagatccataccttcctaaaactgtacatttctacagactactgagcacaagaggagtagtttgaacagtatttcatatccttttgttgactttttttttctttttctttttttaaaatttttaagagtgtatttcccagcctaatagaatagggtcgccgctttcctcagcttctttttgctccttctactggaacttgtttgcctttctttttaacatgagacagaaaagatccagtggaagcagcaacgaaaagcttgtaaagttcgaccccatttcgttttgtattttccataactacacgtgatagtgttattaagtagcctgtttcagctaatctcattattttctttagtttagacgct

SEQ ID NO: 503 - DNA, 11457 bp, Gossypium raimondii
ttggggttatgggtgttgatcaatgctgcatgtttatttgttttgattggcgatcaatgttttcttccatttcttttctgcgtctttttacaatatggatttttgggtttttggctgattgtgatgatcttgtttgttttgacacttgattatggtttttgggtctttttgtagttactaaggaggttttcttgttctgcatggtggtctcggttaatgctattttcttttgttgtttgcggtatagtactattgatttagttttaaaacatgatgcattaaacaatgtgcttggaactatcatgtatactgatgaacttgatcgttttatatcagtagtagttgcataaacgtttgagctaaagcagggattctgtttttgttttgtgactgattcagcaatgagaacagtggtggtttatatattgcctcttgtgtattcgtttcttaaggtttatgttttacttcctgtcaatgatactgttctattctgtcggcagttaatgttgattgacctaattatgaacttgggattatccatatattttagttttaatggtttgctattatccactgtgctccttttttttcttcaagtgatgatggccatgactcgtgcatttttcctatgatcaattgatatagtgggtacatgtcttggaatttttatcaatgatgatgtagacttattaattgcgggcaggttataactgctataaatggcagcttgaattctaaatcgaggcttatttcgaaaatagcagttcattaactccgcatgtttgttctccttatgggttaagtaaagatgaatgaaacatagctcttatattcctagaggtatatggagggtttatggccgaatgcataccttctggctggacatgtcaacttggtttatttaaatgtggtgatagcttgtttgttgttgctgacctccagactatttatagctattgtttttttgcttctaaacatgattcctatattttgggactgaatttaaagttctatgtacttaaattttcttgcgccattgttgattttgattatgttgctttgggctagcaaaataagagaactaatctttaaacgtttgagtcaatcaattgaattctttgactgagaaggtggtaatgaaaactaaatgtttgtcgtctttactgctttcattctttacactaggaagctatgtacaaaaacatgtttaaggtttatttcagaatactgctgttggacctccgtccgattctttattatggagcaacttttttcatccatccggttctcatgggcagctggcctgagatattgcacgggctttagattaagatgcatttaacaaattttgacgagcagtttctctctctggaatacctcttggacttccataaatgatttattagttatttatattactgtggatgttgtgctcgtaggctttcatgtgttgagacatctttggtgtatgttattattccttggaaattcactttttgaactaaatatagttttaattgtaattcttgtgatccaatgtttaatcatcttatctctgtctttgtaattttatattaaactttatttgagttcttgccggcatgctatattgattgcttgttggtcatcagaagtcaaaagtcaatggcctccatggaaagtgactcatctgaagagcaagaaaattcaactgcctttctgactggcataaaatttcatgtctcgaacgacgctgataatgtaagtatatttcagtactgttttatctctttgtttatttccatgctggaattgataatactggaatgagttgagtgatttggatcactcaatccacacccaccttgtggtaatctaaaacacagtccaatctgtgtgatatatgtttatattgtcattggggcatctccccctatctccatatagatccttaaatttggcttggttctgttttagtttatgatgttcctttccatgaagccattcatgttatctattttttcctgccactggccttctttctttatagtttagtcactgattcatgctttttctgttttcaaggacaattattgcttcacggttattgtatgcttttcttcttaactttatgcttcagattgttttggacatggaaacgaacaatcatgtagtcttttaattatgtccatatttcaattccttgtagcaatttgagcacttatgattcttttctgatactgtgacaggagaacatgtctatcttggaaattactgcacccagtgaggtgtctgatcctaggttggggtttccgaatttttctaatcattgcaccacttgtgatgccagagatatgaaacaatgcgaaggtggatatcgaattagaaaaacttaaatgatattttgcatctgttaacttttttgtttctttatgtagctatcagtaacatactgatttctttccattcatctttgtaggccattttggggttattaaatttccatacacaatactccatccattttttctttcagaagttgtacatatattaaataagatttgcccaggatgtaaatcgatccggaaagatctatggatgaaggtcgggtacctctcaccttcatcaactgaggatcatcatactgttataatttttcctttttcttccattataacatattattgttattccttcttgtcatcctaaagaaaggaaaaaggataaaatagaaattaaaataatatttgaagaatttaaagttcaaaacaaagcctgtatcccttttggcacaatttaattttctgcaagttatgacttttacctgtttttaactatgctgattttagaagtgagagtaccctctaggatccgattttctggtagtatgtttactttcttttttgagcaaactatgtcctggtgtaggcaattttgatgtttttttttcttgcatgtaccagggtgctaattctatagccagattacttgaaaccaaggggtgtaaatattgtgttgtaagtttgtctggcttcttgttttcttaatcctcttttttttttttttcccttttttgtactaatgatttctggaaacaggggaattcaatagagtggtatccacccatgagattcaagataacctcgaaagagcttttcagaaaaagtgcaatcatggtagaggtaagtgaaaactctttaatgaaggtccggaagagaggaaggcaagcattacctgcagattactgggactttattccaaaagatcaacaacaagaagaaggttttgtgaaaccaggtagaagagtcctatcacatgcccaggtatcatgttcttttccaattcacatgaaaaaattatatttctttgttgtctctaatgtcatctcatatgatttatttatgggaatgcaatccactaaatctggtacatactaattaaaaactttttgttgatatatgttttgcagtgaattttttattcatttcctactttattttgtctgcattgatatttaccaacattgaatttttaactatgaagggaaaaaaaaaactcaattatttgattcttaacaatgtctggtggtagtttttggaaggtggaagagagtgagttggttgtttccataaaatgcaaacattccggttggcaaatgcgaattggttttggaatcttgtcatacaataatatcgttttaaccaaaacttaaaactgttagtgatttgaaaactatcatgggtttatatgggattttgctttctatagaactattatgatattataatagatatggctctaattcagctttcttggcaaggaaaattgttgttacttgcatgtgaagaaggaaaaatgaaggaaaatatctcctaatttgtttcatgtgttaatatataatatatcctagttgctatattactggaagagtattttggttttggaaactattattcaagtctcaaatattcttttaaagtgtagagcagaatcaagcattggagtggcctaccccttccccttatatatatatcagaccttccttcactactttgatgagtgcataatgcttattggttttcaggttcgacatttgttgaaggacgttaatccagagttcattaaaaagtttatttcagaagcagactctattttcctcaatttttttcctgtgacacccaatagtcaccgagtgacagaaatcatgcatacatcttctaatgcgcagcgattgatctttgtaagagtctttactttgaacatcctcatttacatgcttccaaggttgtggttgatatggatggtttatcttattatatgcattacatttgttttcttttcagttttactgaattttctggttaatatggttttgttgtaggatgaaagaaccagggtttacaagaaactggttgacttcagagggctagcaaatgaattgagctctcatgtattggaatgcctaaaaatttctaaggcaagttatacctttcttcctttttaattaaaatttggtccaactttcatggaaccttatgctctctttctttgattgcattcaacgtgcagctgcatgtggagaagccatcaactgaagattctgcactcattgctgctctgaaaaagaataaagattctgcttccaacatgtcaggtttaagatatatgaaagatgttattcttgggaagagaaacgaccattgcttccgcatggttcttactggaaacccaaatcttaaactgtctgaaattggtatcccatgtcatgttgccgagaaattgcaaatcgctgagcaactgaacaggtggaatgaggagagattgaaaacttgttgtaatctgcgtattcttgagaagggtgagattcgcattaggagagaaggtaaattagttagaattcgtcataatgaaaaggtccaagtaggggacactatctataggcccctaaatgatggggatacagtacttataaatagacctccttctatacatcagcactctctcattgcgctatctgttaaagttctacctgtcaattcagttgtttcgataaacccactaatatgttccccttttcgtggagattttgatggtgattgccttcatggttatgttcctcagtccattaacacaagagttgagctcagtgagcttgtttctttggataggcagctaattaatggccaaagtggtcgaaatctgctttcactcagtcatgatagtttaacggctgcttatttggtcaaggaggacggggtactattgaacctgttccagatgcaacagctggaaatgttctgtcctaatcattcgccattgccagccattgtcaaagctcctttgctaagtaatcctgtttggactggaaagcagttatttagcatgctctttcctcccgaatttgattatgtttttgcaccaagtggtgttgtaatccacaatggggatctcatatgttcttctgaagggtcttcttggctacgagatgctgacggcaacctttttcaaagtcttattaagcattaccaaggaaaggtccttgactttttgcatgctgctcaggaagttctttgtgagtggttgtcaatgaggggtttgagtgtttcactcttggacctatatctatctcctgacacagattcacaaaagaacatgatggatgaaatcttctatggtctgcaagaagcagagcagacatgtaacttcaagcagttaatggttgattcttgtcaagatttccttgctggaaacgatgaagaaactaataggttcatggttttggatgttgagcagatgtgctatgagaaacaaagatctgctgcacttagccaagcttctgttgattcatttaagcaagttttccgtgatattcagaatttactctacaagtatgcaaataaagacaattcattattcaccatgttcaaagcagggagcaagggtaacttgctgaagttagtacagcatagtatgtgtcttggattgcaacattcacttgtccctttatcattcagatttcctcatcagctctcatgtgctgcatggaataatcaaaagtctcacatcttaacccaaaaggttgatgatactgatgagtctgctaagaaatatatcccctatgctgtggtcgaaagttcgtttgtgaagggtctgaatccattagaatgttttgttcattcagtgactactcgagacacatctttcagtgacaatgctgaccttcctgggacgctgtcacgaaggttgatgttcttcatgcgtgatctatgcgcagcatatgatggaactgtgaggaatgcatatggagatcaggttgttcagttctgttataatatcgataagggtacatttagtccaactagttgccctgacaaattagtaagtcagggcagtagtcttcctgatggaattggtggacaacctgttggttcattatctgcctgtgccatttctgaggctgcatatagtgcattggatcagccaattagtctacttgaatcttctccattgctgaacttgaaggtgctctctctatctcctcacctccacctcctcctccctctccccctcccatcctcgatggtgttttgaagaattaaaaaacttgtcaaagaatttctttccctccaacctgatgaggaaatgggtgaccttttcatctaaaggaaatttgaaggatacaaaattactgtgctgaaacctacctaatagagttgataaggaccttgacactgttgagaacaaaagcaaatgatctttacgtgttcatggtcaactacaatacatgctgcttcgtaatgtaccttctaatagattaagtggcatatgatttctttttatgttcatgcaccaccatgattcagtccaccaaaattattttacatattattgcagatggtaggatgctaacatattattctgattaaattgctcagagggtccttgagtgtggttctaaaagaagcaatgctgaccagactatgtcactatttttatctggtaaacttgtaaggagaaggcacggtcaggagtatggagccttagaagtcaagaatcatttggagaggctgatctttaaagatattgtgtctactgtctcaataatgtgagtttaagttcctttctcattgtcttgtcctttctcgttttgtgatttatttttcccattactttgatgcttttttatttgagatttattaatgtgttatatggcactagcttctctccacagatgtctagtgaaaaccgtttcagtccttgggtttgccattttcatgtgtttaaggtactgtgatacgcaagtggtgtatctatgttgataagatttccacttcaaagtttcacatcaaaattatttactttccaggatattgtgacaaggaggcggctaacagtgcattctattattgatgctcttcacatgcactgcaccaatgccaaaagactatggaaaatcaatttgcccgacatgcaagttacaagcaagtaagtttgcccctttttagcatgtgtagatgttgcaaaaaggaggcactggtaatatgtattgctcttttccctctagtccctgttgaaagaaatcttgaagaccccaaatttgtgctttttctgtcaatattaagatcatgacctatatctttgtacatgtattatcactttctgatgcagaaatagggcttcaatcttttgttttcatggcttgcacccaagtttatgccttgatttttgtggtccttgtcaatctaatctcagcctgtctcaaagttgtatggttagatgcatgaaaaactataatcagcataaattcaatttaattatttcatttgagggcttcaaattttcaataatatgcttccagatggtagttgttccaatgcatttgaattctgaagggtggaaaatggtcgctgtaattgaatctgctagcattattgtttacttcctagagctttattttgcttcttatttgtttgattgaatgacagggcctgttctgttattgacatggaaaatgaagatgatacgttttgtatcactgtcacaattgttgaatgtaaaacttctcgtatagaactggatgtgattcaagacatggtgataccttcccttctggaagcagtggtaaaaggtatgtacttgcatccaaattgactagtattttttttttgaaggagcaaattgactagtgttaggaatcccatttgagggctgatttggtgaaatggcttagacctttattatgggtctttgaacaactaccgtcaagattgagaatatagtgttggaatctaaatttgccatgtgaattgctggtagactatttctatcactctgtttttgaaaatattgaaggttacgccttccctcagtgtgcatttcttatcttttacctataactgttaattccctattttgattacgtctgtttattggaggaagttctgatatttgaacttgtatcattgtatgaccaaatttctggtaggaaaagcagaatctttagtagggtctggtcaaatgtaaaaggcaatatttaaaccaccagaaatatcaaatggcctaaaagatgtgacatgcatctttgtagatatgcattacaagttgattacaagttggtaatattcatctgtttctgccttcaaatttttgaaattttctttaggattcccggagatcaagaaggtggaaattctatggaatgaggatttcagagtcccaaattctcataaacctgctcctggtgaactttacttgagggtttctgtatctggcgattttggtataacgaaactctggagtgtgcttatgaatgattgcctccaactaatggatataatcgattggacacggagccatccagataacattaatcagttttgcttggcattcggaatagatgctggatggagattctttctcaatgtttgttatccttgttataatttattccctgttttctacttgcacaaaagcttaagggtaactgcatatattaacctgctcatgcgtttctctatgcagaatatgaagagtgcaatatcagatactggcaagtctatactaaatgaacatctacaccttgctgccaattgtctgtcagctaccggggagtttgttggtttaaattcaaaaggcttgaaacaacaaagagaacatgcatttgtctcttctcctttcatgcaagcatgcttttcagttagttcttgtcattgtttcccctttgatgctcttaatataaaatgtttaagtagctgtcatttttatagtcaacttagctttatacaatttgtggcagaaccctagtgcttgctttgtcaaagctgcaaagactggagttgcggataatcttcaagggaccattgacctattggcttggggaagggttcctcgtattgggactggtggacagtttgatatagtctattctatgaaggtattttatgcagatcttgctgttgttttaaatatgtagcattgtggattagactttcactatagttgcatttaactgattggaaattgttgggtgttgaatatttaagcatctccccctattttttggttcaaaagaagagagaggcaaacaatgggtgagacataagataccattaaagttattttatgaataatgcattccggaagtgatatggagttacggatttgggcttgttaccaactgatgctgaataggatagtggaaataggttctcttcagaatgtaattggtttttgagagggaccaagtcagcaataaagaaactcgagcgaaatatgtatagaagagaatgcatcttgatggtaaatgtttctcaactaagagagtaacacttgtgaaggatcctattgtcgtatcactgacttggaaatttctgagtcaaagagctcaatttcgtatctcaagggcaggactatcctgtgcatgaggtacattttgatgcttatagtacagattcacttgttctcaatctggtcaaggtataaaaatgagctacgctactttcttagctgtatttgagatggagctgtatataagtttaatagtgcttcaaattaatcaagttttacatttttaatcattgttattttatactctcgaggtttagatccaaattccttagtagtctactggttcttcctttagtttccttcttaaaaaaaaagaagagatttttggctagtaactgtcattatatccatccatccatcccattactatttttcaggatgaagagcttgcagaaccggttgatgtgtataagctgctaggagattctattaattccaagaagcaggatatagagtttgaagtacctaaagtttttaaccctacatctgagaaacatagttctccgttcaagggagctcttcgtgactctgtctttgatgagtggaagaagattgaaacgaaaacaaggtcactcttgagaggacgtctaaccttgaatgacgttcagaggcttgagcgtaatttaaagaatattttgcgcaagtaagctttcctccagttgttggttatgttctatgtttatagtgctcaagtttttcctccattgttggtattgtacacgggctttggtgctcttatattctaatagcttttgatatctgtcccaaattcctaatattctctgaactcatggttgtgccgactgcagatatcctattgatcaccgtgtaagtgaagctgactgggataccttgatgatggcgttgtactttcaccctcatagagttgagaagatcggatctggagccaaggaaataaaggtacgtgatactggaaaaataggaaaaagaaagcaaaaaatgagacaatgaaaaaagaaaacaaaggttgttttaatgcttcatttccatatcttttgcaggtagggcatcatcccgatcatgcagacagtcgttgtttctttttggttagaacagatgagacaactgtagatttctcatatcggaaatgtgttgtcggtgcactcgagatcattgctccttgtagggcacaatcctacaagtcaaaatggttacaacatggtagtttgtaaaccaaactccacaagcgctcacttttgcatgtaaatatagcaagatccataccttcctaaaactgtacatttctacagactactgagcacaagaggagtagtttgaacagtatttcatatccttttgttgactttttttttctttttctttttttaaaatttttaagagtgtatttcccagcctaatagaatagggtcgccgctttcctcagcttctttttgctccttctactggaacttgtttgcctttctttttaacatgagacagaaaagatccagtggaagcagcaacgaaaagcttgtaaagttcgaccccatttcgttttgtattttccataactacacgtgatagtgttattaagtagcctgtttcagctaatctcattattttctttagtttagacgcttgaatcttacattattttcttaaagatttaca

SEQ ID NO: 504 - DNA, 11272 bp, Gossypium raimondii
ggtttttgggtctttttgtagttactaaggaggttttcttgttctgcatggtggtctcggttaatgctattttcttttgttgtttgcggtatagtactattgatttagttttaaaacatgatgcattaaacaatgtgcttggaactatcatgtatactgatgaacttgatcgttttatatcagtagtagttgcataaacgtttgagctaaagcagggattctgtttttgttttgtgactgattcagcaatgagaacagtggtggtttatatattgcctcttgtgtattcgtttcttaaggtttatgttttacttcctgtcaatgatactgttctattctgtcggcagttaatgttgattgacctaattatgaacttgggattatccatatattttagttttaatggtttgctattatccactgtgctccttttttttcttcaagtgatgatggccatgactcgtgcatttttcctatgatcaattgatatagtgggtacatgtcttggaatttttatcaatgatgatgtagacttattaattgcgggcaggttataactgctataaatggcagcttgaattctaaatcgaggcttatttcgaaaatagcagttcattaactccgcatgtttgttctccttatgggttaagtaaagatgaatgaaacatagctcttatattcctagaggtatatggagggtttatggccgaatgcataccttctggctggacatgtcaacttggtttatttaaatgtggtgatagcttgtttgttgttgctgacctccagactatttatagctattgtttttttgcttctaaacatgattcctatattttgggactgaatttaaagttctatgtacttaaattttcttgcgccattgttgattttgattatgttgctttgggctagcaaaataagagaactaatctttaaacgtttgagtcaatcaattgaattctttgactgagaaggtggtaatgaaaactaaatgtttgtcgtctttactgctttcattctttacactaggaagctatgtacaaaaacatgtttaaggtttatttcagaatactgctgttggacctccgtccgattctttattatggagcaacttttttcatccatccggttctcatgggcagctggcctgagatattgcacgggctttagattaagatgcatttaacaaattttgacgagcagtttctctctctggaatacctcttggacttccataaatgatttattagttatttatattactgtggatgttgtgctcgtaggctttcatgtgttgagacatctttggtgtatgttattattccttggaaattcactttttgaactaaatatagttttaattgtaattcttgtgatccaatgtttaatcatcttatctctgtctttgtaattttatattaaactttatttgagttcttgccggcatgctatattgattgcttgttggtcatcagaagtcaaaagtcaatggcctccatggaaagtgactcatctgaagagcaagaaaattcaactgcctttctgactggcataaaatttcatgtctcgaacgacgctgataatgtaagtatatttcagtactgttttatctctttgtttatttccatgctggaattgataatactggaatgagttgagtgatttggatcactcaatccacacccaccttgtggtaatctaaaacacagtccaatctgtgtgatatatgtttatattgtcattggggcatctccccctatctccatatagatccttaaatttggcttggttctgttttagtttatgatgttcctttccatgaagccattcatgttatctattttttcctgccactggccttctttctttatagtttagtcactgattcatgctttttctgttttcaaggacaattattgcttcacggttattgtatgcttttcttcttaactttatgcttcagattgttttggacatggaaacgaacaatcatgtagtcttttaattatgtccatatttcaattccttgtagcaatttgagcacttatgattcttttctgatactgtgacaggagaacatgtctatcttggaaattactgcacccagtgaggtgtctgatcctaggttggggtttccgaatttttctaatcattgcaccacttgtgatgccagagatatgaaacaatgcgaaggtggatatcgaattagaaaaacttaaatgatattttgcatctgttaacttttttgtttctttatgtagctatcagtaacatactgatttctttccattcatctttgtaggccattttggggttattaaatttccatacacaatactccatccattttttctttcagaagttgtacatatattaaataagatttgcccaggatgtaaatcgatccggaaagatctatggatgaaggtcgggtacctctcaccttcatcaactgaggatcatcatactgttataatttttcctttttcttccattataacatattattgttattccttcttgtcatcctaaagaaaggaaaaaggataaaatagaaattaaaataatatttgaagaatttaaagttcaaaacaaagcctgtatcccttttggcacaatttaattttctgcaagttatgacttttacctgtttttaactatgctgattttagaagtgagagtaccctctaggatccgattttctggtagtatgtttactttcttttttgagcaaactatgtcctggtgtaggcaattttgatgtttttttttcttgcatgtaccagggtgctaattctatagccagattacttgaaaccaaggggtgtaaatattgtgttgtaagtttgtctggcttcttgttttcttaatcctcttttttttttttttcccttttttgtactaatgatttctggaaacaggggaattcaatagagtggtatccacccatgagattcaagataacctcgaaagagcttttcagaaaaagtgcaatcatggtagaggtaagtgaaaactctttaatgaaggtccggaagagaggaaggcaagcattacctgcagattactgggactttattccaaaagatcaacaacaagaagaaggttttgtgaaaccaggtagaagagtcctatcacatgcccaggtatcatgttcttttccaattcacatgaaaaaattatatttctttgttgtctctaatgtcatctcatatgatttatttatgggaatgcaatccactaaatctggtacatactaattaaaaactttttgttgatatatgttttgcagtgaattttttattcatttcctactttattttgtctgcattgatatttaccaacattgaatttttaactatgaagggaaaaaaaaaactcaattatttgattcttaacaatgtctggtggtagtttttggaaggtggaagagagtgagttggttgtttccataaaatgcaaacattccggttggcaaatgcgaattggttttggaatcttgtcatacaataatatcgttttaaccaaaacttaaaactgttagtgatttgaaaactatcatgggtttatatgggattttgctttctatagaactattatgatattataatagatatggctctaattcagctttcttggcaaggaaaattgttgttacttgcatgtgaagaaggaaaaatgaaggaaaatatctcctaatttgtttcatgtgttaatatataatatatcctagttgctatattactggaagagtattttggttttggaaactattattcaagtctcaaatattcttttaaagtgtagagcagaatcaagcattggagtggcctaccccttccccttatatatatatcagaccttccttcactactttgatgagtgcataatgcttattggttttcaggttcgacatttgttgaaggacgttaatccagagttcattaaaaagtttatttcagaagcagactctattttcctcaatttttttcctgtgacacccaatagtcaccgagtgacagaaatcatgcatacatcttctaatgcgcagcgattgatctttgtaagagtctttactttgaacatcctcatttacatgcttccaaggttgtggttgatatggatggtttatcttattatatgcattacatttgttttcttttcagttttactgaattttctggttaatatggttttgttgtaggatgaaagaaccagggtttacaagaaactggttgacttcagagggctagcaaatgaattgagctctcatgtattggaatgcctaaaaatttctaaggcaagttatacctttcttcctttttaattaaaatttggtccaactttcatggaaccttatgctctctttctttgattgcattcaacgtgcagctgcatgtggagaagccatcaactgaagattctgcactcattgctgctctgaaaaagaataaagattctgcttccaacatgtcaggtttaagatatatgaaagatgttattcttgggaagagaaacgaccattgcttccgcatggttcttactggaaacccaaatcttaaactgtctgaaattggtatcccatgtcatgttgccgagaaattgcaaatcgctgagcaactgaacaggtggaatgaggagagattgaaaacttgttgtaatctgcgtattcttgagaagggtgagattcgcattaggagagaaggtaaattagttagaattcgtcataatgaaaaggtccaagtaggggacactatctataggcccctaaatgatggggatacagtacttataaatagacctccttctatacatcagcactctctcattgcgctatctgttaaagttctacctgtcaattcagttgtttcgataaacccactaatatgttccccttttcgtggagattttgatggtgattgccttcatggttatgttcctcagtccattaacacaagagttgagctcagtgagcttgtttctttggataggcagctaattaatggccaaagtggtcgaaatctgctttcactcagtcatgatagtttaacggctgcttatttggtcaaggaggacggggtactattgaacctgttccagatgcaacagctggaaatgttctgtcctaatcattcgccattgccagccattgtcaaagctcctttgctaagtaatcctgtttggactggaaagcagttatttagcatgctctttcctcccgaatttgattatgtttttgcaccaagtggtgttgtaatccacaatggggatctcatatgttcttctgaagggtcttcttggctacgagatgctgacggcaacctttttcaaagtcttattaagcattaccaaggaaaggtccttgactttttgcatgctgctcaggaagttctttgtgagtggttgtcaatgaggggtttgagtgtttcactcttggacctatatctatctcctgacacagattcacaaaagaacatgatggatgaaatcttctatggtctgcaagaagcagagcagacatgtaacttcaagcagttaatggttgattcttgtcaagatttccttgctggaaacgatgaagaaactaataggttcatggttttggatgttgagcagatgtgctatgagaaacaaagatctgctgcacttagccaagcttctgttgattcatttaagcaagttttccgtgatattcagaatttactctacaagtatgcaaataaagacaattcattattcaccatgttcaaagcagggagcaagggtaacttgctgaagttagtacagcatagtatgtgtcttggattgcaacattcacttgtccctttatcattcagatttcctcatcagctctcatgtgctgcatggaataatcaaaagtctcacatcttaacccaaaaggttgatgatactgatgagtctgctaagaaatatatcccctatgctgtggtcgaaagttcgtttgtgaagggtctgaatccattagaatgttttgttcattcagtgactactcgagacacatctttcagtgacaatgctgaccttcctgggacgctgtcacgaaggttgatgttcttcatgcgtgatctatgcgcagcatatgatggaactgtgaggaatgcatatggagatcaggttgttcagttctgttataatatcgataagggtacatttagtccaactagttgccctgacaaattagtaagtcagggcagtagtcttcctgatggaattggtggacaacctgttggttcattatctgcctgtgccatttctgaggctgcatatagtgcattggatcagccaattagtctacttgaatcttctccattgctgaacttgaaggtgctctctctatctcctcacctccacctcctcctccctctccccctcccatcctcgatggtgttttgaagaattaaaaaacttgtcaaagaatttctttccctccaacctgatgaggaaatgggtgaccttttcatctaaaggaaatttgaaggatacaaaattactgtgctgaaacctacctaatagagttgataaggaccttgacactgttgagaacaaaagcaaatgatctttacgtgttcatggtcaactacaatacatgctgcttcgtaatgtaccttctaatagattaagtggcatatgatttctttttatgttcatgcaccaccatgattcagtccaccaaaattattttacatattattgcagatggtaggatgctaacatattattctgattaaattgctcagagggtccttgagtgtggttctaaaagaagcaatgctgaccagactatgtcactatttttatctggtaaacttgtaaggagaaggcacggtcaggagtatggagccttagaagtcaagaatcatttggagaggctgatctttaaagatattgtgtctactgtctcaataatgtgagtttaagttcctttctcattgtcttgtcctttctcgttttgtgatttatttttcccattactttgatgcttttttatttgagatttattaatgtgttatatggcactagcttctctccacagatgtctagtgaaaaccgtttcagtccttgggtttgccattttcatgtgtttaaggtactgtgatacgcaagtggtgtatctatgttgataagatttccacttcaaagtttcacatcaaaattatttactttccaggatattgtgacaaggaggcggctaacagtgcattctattattgatgctcttcacatgcactgcaccaatgccaaaagactatggaaaatcaatttgcccgacatgcaagttacaagcaagtaagtttgcccctttttagcatgtgtagatgttgcaaaaaggaggcactggtaatatgtattgctcttttccctctagtccctgttgaaagaaatcttgaagaccccaaatttgtgctttttctgtcaatattaagatcatgacctatatctttgtacatgtattatcactttctgatgcagaaatagggcttcaatcttttgttttcatggcttgcacccaagtttatgccttgatttttgtggtccttgtcaatctaatctcagcctgtctcaaagttgtatggttagatgcatgaaaaactataatcagcataaattcaatttaattatttcatttgagggcttcaaattttcaataatatgcttccagatggtagttgttccaatgcatttgaattctgaagggtggaaaatggtcgctgtaattgaatctgctagcattattgtttacttcctagagctttattttgcttcttatttgtttgattgaatgacagggcctgttctgttattgacatggaaaatgaagatgatacgttttgtatcactgtcacaattgttgaatgtaaaacttctcgtatagaactggatgtgattcaagacatggtgataccttcccttctggaagcagtggtaaaaggtatgtacttgcatccaaattgactagtattttttttttgaaggagcaaattgactagtgttaggaatcccatttgagggctgatttggtgaaatggcttagacctttattatgggtctttgaacaactaccgtcaagattgagaatatagtgttggaatctaaatttgccatgtgaattgctggtagactatttctatcactctgtttttgaaaatattgaaggttacgccttccctcagtgtgcatttcttatcttttacctataactgttaattccctattttgattacgtctgtttattggaggaagttctgatatttgaacttgtatcattgtatgaccaaatttctggtaggaaaagcagaatctttagtagggtctggtcaaatgtaaaaggcaatatttaaaccaccagaaatatcaaatggcctaaaagatgtgacatgcatctttgtagatatgcattacaagttgattacaagttggtaatattcatctgtttctgccttcaaatttttgaaattttctttaggattcccggagatcaagaaggtggaaattctatggaatgaggatttcagagtcccaaattctcataaacctgctcctggtgaactttacttgagggtttctgtatctggcgattttggtataacgaaactctggagtgtgcttatgaatgattgcctccaactaatggatataatcgattggacacggagccatccagataacattaatcagttttgcttggcattcggaatagatgctggatggagattctttctcaatgtttgttatccttgttataatttattccctgttttctacttgcacaaaagcttaagggtaactgcatatattaacctgctcatgcgtttctctatgcagaatatgaagagtgcaatatcagatactggcaagtctatactaaatgaacatctacaccttgctgccaattgtctgtcagctaccggggagtttgttggtttaaattcaaaaggcttgaaacaacaaagagaacatgcatttgtctcttctcctttcatgcaagcatgcttttcagttagttcttgtcattgtttcccctttgatgctcttaatataaaatgtttaagtagctgtcatttttatagtcaacttagctttatacaatttgtggcagaaccctagtgcttgctttgtcaaagctgcaaagactggagttgcggataatcttcaagggaccattgacctattggcttggggaagggttcctcgtattgggactggtggacagtttgatatagtctattctatgaaggtattttatgcagatcttgctgttgttttaaatatgtagcattgtggattagactttcactatagttgcatttaactgattggaaattgttgggtgttgaatatttaagcatctccccctattttttggttcaaaagaagagagaggcaaacaatgggtgagacataagataccattaaagttattttatgaataatgcattccggaagtgatatggagttacggatttgggcttgttaccaactgatgctgaataggatagtggaaataggttctcttcagaatgtaattggtttttgagagggaccaagtcagcaataaagaaactcgagcgaaatatgtatagaagagaatgcatcttgatggtaaatgtttctcaactaagagagtaacacttgtgaaggatcctattgtcgtatcactgacttggaaatttctgagtcaaagagctcaatttcgtatctcaagggcaggactatcctgtgcatgaggtacattttgatgcttatagtacagattcacttgttctcaatctggtcaaggtataaaaatgagctacgctactttcttagctgtatttgagatggagctgtatataagtttaatagtgcttcaaattaatcaagttttacatttttaatcattgttattttatactctcgaggtttagatccaaattccttagtagtctactggttcttcctttagtttccttcttaaaaaaaaagaagagatttttggctagtaactgtcattatatccatccatccatcccattactatttttcaggatgaagagcttgcagaaccggttgatgtgtataagctgctaggagattctattaattccaagaagcaggatatagagtttgaagtacctaaagtttttaaccctacatctgagaaacatagttctccgttcaagggagctcttcgtgactctgtctttgatgagtggaagaagattgaaacgaaaacaaggtcactcttgagaggacgtctaaccttgaatgacgttcagaggcttgagcgtaatttaaagaatattttgcgcaagtaagctttcctccagttgttggttatgttctatgtttatagtgctcaagtttttcctccattgttggtattgtacacgggctttggtgctcttatattctaatagcttttgatatctgtcccaaattcctaatattctctgaactcatggttgtgccgactgcagatatcctattgatcaccgtgtaagtgaagctgactgggataccttgatgatggcgttgtactttcaccctcatagagttgagaagatcggatctggagccaaggaaataaaggtacgtgatactggaaaaataggaaaaagaaagcaaaaaatgagacaatgaaaaaagaaaacaaaggttgttttaatgcttcatttccatatcttttgcaggtagggcatcatcccgatcatgcagacagtcgttgtttctttttggttagaacagatgagacaactgtagatttctcatatcggaaatgtgttgtcggtgcactcgagatcattgctccttgtagggcacaatcctacaagtcaaaatggttacaacatggtagtttgtaaaccaaactccacaagcgctcacttttgcatgtaaatatagcaagatccataccttcctaaaactgtacatttctacagactactgagcacaagaggagtagtttgaacagtatttcatatccttttgttgactttttttttctttttctttttttaaaatttttaagagtgtatttcccagcctaatagaatagggtcgccgctttcctcagcttctttttgctccttctactggaacttgtttgcctttctttttaacatgagacagaaaagatccagtggaagcagcaacgaaaagcttgtaaagttcgaccccatttcgttttgtattttccataactacacgtgatagtgttattaagtagcctgtttcagctaatctcattattttctttagtttagacgct

SEQ ID NO: 505 - DNA, 8965 bp, Gossypium raimondii
ttatttgtttggattggtgatcaatgtttacttctcttgcttttttatgtctattctgaatttgggtttttgtctttggttgattgttttgatattatatttgttttgcccctagacttatgattactgggtctcttttagttgattaggtggtatcttgtttctcatggcggtttcggttaaagtttttttttttttttcttgtttatgatataaaactgtttgctttgaaacaatgtgcttggaactctcatgttcatcaatggacctgatcattaaatcagtagtagttataagcttttgaactaattaaagcaggggattctttttctttttctcttttaattactgattaaaaaatgagtgacaatgatgtttcatttcttagttgtgtggtgtttatatatatacatgtacatactgttcaatgttttgcttttattcagtgatgctgttatcattctgttggcaatcagtgttgtttggactaatgaagaactcagatatgtgttggcaattagtgttgattggcctaattaaaaacctagattatgtatcgtgtcaaggtctataagtggttacggcagtagatcatgcatttttcttatgatcaatcgatatgtgagtaagatgcttgttgaaaatttgatcagtggacttatttaattgtcggccgttacaacggctataactatcagtttagattcttattctatgcttattccaacatatcaggctttgttcgtcatatattttgagtaaacaaggctagaataggacttatagattatgtgttggcaattagtgttgattggcctaattaagaacttagattatgtatcgtgttgaggtttataagtggttatggcagtagatcatgcattttcggtatgaccgattgatatgtgagtaagatgcttgttgaaaatttgatcggtagacttatttaattgtcggtcgttacaacggctataactagcggtttagattcttattctatgcttattccaatatatcaggctttgatcgccgtatttgttaagtaaacaagactaggatgggaaacatagctattaaatgcatagaggtatatggagttttatgacataatgcatgcttttcggcttggcactagtacttggtttatttgaatccatttattgcttgtcgtgtttacttaatgcattctagtaaagtttactgagattatcctccaggcattttccgtatttattatgttttagcggatgaatttaacattctatgagcttgatatctcttaccgattttggtttggtaatcgatcacgttatccctttctggtgcatgttgtagtgcccgctattttacctttattatgtctttgaaatggccattatgttttaaaaccctaattattgtaattcaagtgtttaatcatcatgtttttctctttgtagtttatattaatcttcagtttaaggctttggggaatcccatatcggttgtttgattgatcccatgaagtcaaagccgatgacctccattgaaacggacttgtctgaagagcaagaagtgctagctgccactatgactggcataaagtttaatgtatcgggtgatgaagataatgtaagtatacttcattgctgtttttatttatttgtttacctctatgttggaattgataataaaaagattgagttgagtgatttaatagaaccaatccacacctgctgtacgataaactttaaggaaggcgagtctgatttttttgtgaaaatatttgaattgaatttatattcttattcagctatgatttttatatttgctagtcactgtttcttacttttttcggtttttaagattgtttcagacatggcaacttaacaatcatgtagcactttccttaaattattgttagtatttcccttcctcttaacaacttgggacgtcattgttctgttcggattctctgacaggagaagatgtcagtcatggaaattgttgcatcaagtcaggtgtctgaccctaagctggggttcccaaatttgaggaatcattgcaccacctgtgacgccagagatttgggacattgtgaaggtgaatggcaaatttaaaactttaaatgatatccatgtctgttttaagttttgtttcattatatagctattgaaaactcacaggtttgtttccattcgtcttcctaggtcattttggggttattaaatttccgtacccaataatcaatccatattatctatcagaagttgtgcagatattaaataagatttgccttggatgtaaatcaattcgcaaagatctattgataaaggttgcatacctcacaccttcttaaacagatcatcatattgtcatgtaatatcatagtgtccatacgggcttgtttattagtgttgatgtttttcattgtcatgcatgtaccagggagataagtcggcatccaaactacgtcaacgcaaggggtgtaaatattgtgttgtaagtttgtctggcttcttgtgctcttaatcctttttttcttttatcttttattttttttactaattatttctggtcgacaggggaactcaattgactggtatccaccaatgacattcaagatatcctctaaagagctttccaaaaaaagcacaattgtggtagaggtaagtgaagactctttaatgatggtccgaaagagaggaaggcaagccttacctgctgattattgggattttattccaaaagatcaacaagaagaagaagatggtttgatgaaaccacgtcgaagggtcctatcacatgcacaggtagcattttcttttccaattcactgttttacggtgcttcttttgttatctatatcgcgttgttggcattggtatttgccaaccttgaacatttatggtgcttcttttgtttgactacattgtggtgttggtgttgcccgccccttcatgttaacaatcccttttttttaaccacattgatgggtgcatattgcttgatggttttcaggttcattatttactgaaggatgttgatccagagttcattaaaaagttcattcagaatgtggactctattttcctcaattgctttcctgtgacacccaatagtcatcgagtgacggaaatcactcatagatcttctaattcacagcgcttgatctttgtaagcatctttacttcgaacattctgttttacatgctaaacgaccttggttaatgtggatggtttatatgattatgtgtattatatctgttttcttttcagttttacttatttttctggttaatgattttgttgtaggatgagagaactaggctttacaagagactggttgatttccgaggagtagctaatgaactgagttcccatgtattggaatgcctaaaaatttcaaaggcaagttacagtgccttgttttcttttttgtatttggttcaacttttgtggaatcttatgctccatctctgtggttacattcattgtgcagctgttccaggagaagccatcaaatgaagataatgaacttatccttgccctgacaaggaataaagatcctgtttctaacatgtctggtttaagatacatgaaaaacgttcttcttggaaagcgaaatgaccattgcttccgcatggttcttaccggaaatccaagtcttaaactatcggaaattggtataccatgtcctgttgcagagaggttgcaaattgctgagcaactgaacaagtggaacgaggaaagattgaaagcttgctgtaatttgcgtattcttgagaagggtgagatttgtattaggagagaaggtacattagttagaattcatcataatgaaaagatccgactgggggacatcatctataggcccctaaataatggggatatcgtgcttataaacagacctccttctatacatcagcactctttcattgccctatctgtcaaagttctacctgtgagttcctctgtttcgataaacccccttatttgttccccttttcgtggagattttgacggtgattgccttcatggttatgttcctcagtccatcaacacaagggttgagctcagcgagcttgtttctttgaataggcagctaattaatggccaaagtggtcgaaatctactttcactgagtcatgatagtttatcagctgcttatttggtcaatggtgatggggttctcttgaacttgtacgaaatgcaacagcttgaaatgttctgtcccaatcgttcaccgtcgccagcaatcatcaaagctcctttattgagtaatcctgtttggactggaaagcagttattcagcatgctctttcctcccgaattggattatggtttttctccaagtgatcttgttatccgtaatggggagcttataacttcatctgagggatcttcttggttccgagatgctgatggcaacctttttgaaagtctcattaaaaattgtcgaggaaaggtccttgattttttgcatggtgctcaggaagttctttgtgagtggttatcaatgaggggtatgagcgtttcactcttggacctatacctaactcctgattcaaattcacgaaagaacatgatggatgaaatcttctatggtctccaagaaacagagctgacttgcaactttaagcagttaatggttgattccttctgtgatttccttgctggaaataatgaagaaattgatggttttgtgggttttgattttgagcggatgtgttatgagaagcaaagatcagctgcagttaatcaagcttctgttgattcttttaagcaagtttttcgagatatccagaatttatcatacaaatatgcaaataaagacaattcattattgaccatgttcaaagcagggagcaagggtaacttgctgaagctagtgcagcatagcatgtgtcttggactgcaacgttcagttgtacctttatcattcaggtttcctcctaaactctcatgttctgaatggaatgatctaaaatctcagggcttaacccagagcggtgatgacagtgttgaatctgcaaagaatttcatcccatatgctgtgatcgaaagttcttttatgacaggcctgaatccactagaatgttttgtgcattccgttactagtcgagacagttctttcagcgaccatgctgaccttcctgggacactgtcacgaaggcttatgttcttcttgcgtgatctatgcgcatcatatgacggaactgtgaggaatgcatatggaggtcaggttgttcagttcagctatggtagtgataagggtacatctactgcaactagttttgctaatgaaatacaaagtcagggcagtatcctacctgatggaacaggtggccaacctgttggttcattgtctgcctgtgccatttctgaggctgcatatagtgctttggatcaaccgattagtctacttgaaacttcaccattgctaaacctgaaggtgcactctctctttctctttaatatagttgctaagaaccatggtctctcatctaaagaaaaatttaaggatacaaattagtactgtgctgaaacctatctaatatagttcctaagaaccatggaacaacttgacactattctgaactaaaagcaaatggttcgaatgtgcttatggtcaaattccatgcattttgcttctcaatgtccatgttctttttatgttatatgtgccaccacaacccagtccaccaaagttttagccctgatgggatggtgagcaggggcaaatccagaagctcttttttttttttgtggggggggggggggcgaattgaattataaattttttgtgaggctaaagtgtaattttatcttgtattcacttatgatttcatcacttttgaaaggactatatagaaatctttttattttggggggccaaagtgcaagtttaccatatagtaacttttaattctatcatttattaggagactaaaaaaattttcccactctaaattcgcttctgatggcgagatggtgtgaatcccgaatttagttggttgatataaaaatggttgcacatgttagaatgctaacaaattaatctgattaacttgctcagagggtccttgaatgtggttctagaagaaggaattcagaccagactatgacgctatttttatcggataaacttggaaaggggagacattgtttcgagtatgcagctttagaaatcaagaattatttggagaagttgatcttttcggatattgtatctactgtcttaataacgtgagtttttatttcttttataatctcgtcctttctcgttttatgcttttcttattattactcgagatttaattgtgtcctgtggtatagctactccccgcagaagtcaactgaaaactgtttcaacccttgggtttgccattttcatgtgtgcaaggtaatgtgataggtaaatggtatttttaatgatgataaatcttcggctttcaagtttcccccataaaatcctgtactttacaggagatcatgaaaaggaggcgcctttcagtgcattctattattggttctcttcagatgcactacgccaatgccaaaaaattatggaaaatcaatttgcctgacatccaagttacaagcaagtaagttccccccccccccccttttctttagcatgtcccattgttgcaagaactactcactgacactattaatacaatgtaattcatcttttacatagttcaatgaatatcaaaatatctgtccatttaagttaggccaacttatccttatatccgtgggaagttgcttgggttgttaaacaaaacagtgaaattgccagctctggagataaaacatgtccgctagcattattgatttatttcgcagaactttatttttgcttcttgacttgcttgattgaatggcaggtcttgttctcatactgatatgccaaataaagatgatatgttttgtatcaccgtcacgattgttgagccttccaaaaggtctcatatagaattggatgtgattctagccatagtgttaccttcccttctggaagcagttgtaaaaggtttgtaattctagttctccgtttttgtccaaatttactagtattcgaaatctcgttcgtcttcttttggtgttgaatctataaaattctctttaggattcccggagatcaagaaggtgcaaattttatggaatgatcgattcaaagtctcaaaatctcataaaacttctcctggtgaactttacttgagggtagctgtaacaggtggttttggtaaaacaaaactctggggcatgcttatgaatgattgccttccaataatggatttgatcgactggacacgtagtcatccagatgatattaatcagttttgctcggcatatggcatagattctggatggaaattttttctcaatgtaagtattacgtcattgttattactccacatatttctaccggttaacagcattaaattaacttgcttcatgctattttaaatgcagaatttgaagagcgctatatcagataccggcaagactatactaaatgagcatttgcatcttgtcgccgattgtctgtctgttaccggggagtttgttggcttaaactcaaaaggcttgagactacgacaagaacatgcatttgtctcatctccttttatgcaagcatgcttttcagttagtatcattatatctaatttgatgctcttaatttaagccaagtaaatgtcgtttttaaagtcaacttagccttatctaatttgtggcagaatcccagtgcttcctttgtcaaagctgcaaagaaaggagtttcggataatcttcaggggaccattgatgcattgtcatggggaagagttccttgcatcgggaccggtgcacagtttgatatactgtactctatgaaggtatatttatgcatgtcttgcaacataatgtactgtcaaagttattttcatgaatgatgcattttagaaataactagctaattgtgttcatgccattgttaatttcaggatgaaatgatcaccgaaccggttgatgtgtataatcttcttggaaatattgttggttctcagaaccaagatgtagagtttgaagtaccccaagcttgtaacatcaagtccgagaaatatgtctctgaacttatggatgcacttggtgattctgcctttgaacggctgaaaaatattgaaacaaaaatattgagagaatttctgacgttaaatgacattcagaggctttcgcgaactttaaaggatatattgcacaagtaagctttcctccaatttgttgtttaccttctctgttcagtttggtcgtgcttttccgttctctgattgccatatagttccaggtttttggtgatgttatattataatcggtttcaatatgtctttgctaaattccgaatatatgccaagttgaccctttatcttgagcttgttgcactgctttgtatgtcttagaatggtggatagcttatgatatctcctgatttctcgtcttgagtgttttgattctcaacatcaattcagataaaatgactagacatgtttcgtattcttaatttctcagacttgaagttatttacttcttctaagtttatacttttgctgactgtaggtctcctattggccaccggttaagcggagctgactggaattccgcaatgatggcattgtactttcatccgcgaagagatgagaaggtcggatctggagctcaagaaataaaggtatgttaaaatatattggagttttaacatctattatacatgtacatacgcacagatacgatggtttcttgatcttcgttcccctattttttgcaggtagggtatcaccctgaacataaaaattctcgctgctttcttttggcaaggaccgatggggcaatcgtagatttctcgtatcataaatgcgttatcggggctcttgaggtcatcgcccccgataaggtccaattctacaagtcaaaatggtcacaatccggtaatctgtaa

SEQ ID NO: 506 - DNA, 17084 bp, Gossypium raimondii
tcgcttaatttttagacttatttttagttttttatattaatttttggttttaaatttttagatttattttcacaaaatgaactttgctttaagttttttaatatcatttaaaaaaaattcaaactaataatttttcaaaattttttaaattatttcactattttaaatatgaaatatttatttttacataatgaagattaaaattaattatattttaaattaattttacaaaatctttgcttcataaatcattcaaacaccttcgatttttttgagaagagcagtagccattactccaatcaaagtgttgccaaatttataaaattttaatataggtttaaaataattattttttcattattattatttaattaaaattgaacatcctcattttactctttaatttgaaagccaatagagcaagacaagcaaggtctgactgtcatttccttcaaaccttactgtaggtacatagtagatcctataatttgtttctctctttcatagcatacaaattatgacttacacttcaaatatcttgtatttaattttatttaaaatttcatatttatgtgaatttttataaattaataataactccataactaaaaataaaataaaatcatgattgatgatattataccagtaaatgcataatttttataataactatttttataattacaattaaaaattaactataatcattaaattaaattattagatttaattaaggatttttaaaatacttaaaataaaaattttaatatatacttaaaatgtatttataatacatatttattaaaaaatacaaatttaattacaaatattaaaaaatatttaaaacatattcataaactcaaataaaataatatacccaatctcaagggtgagatttgtttgattcgaattgttcattataattcggtccaattcttaattttttcacgttaatatttactttttgaatttattttaacaaaataaattttattttatagtttttaaatattatttagcaaaatcttaaagatattttttaaataaataaaaataatctttatataatattttaaataaaatatattttatataatttttttaaaatattttctattttaaatagaaaatatttatttttacatcataaaaaattaattataaataaataaaaataaaaacaatattttataaaccaatcaaatacttcaattttaagactagtttagaaatgcttctaatgagtatttttttgaagaaaaaatactttttgagataaaaatattattaaataaaacacttttaagaaattttttaatactttttatttcaaaaatatttattagaaatactgttaaactaatggtgagtttggatagacggtgcgtttatctacggttagtgtaaaaatagcagtggcggtgatattagatactgtaacgatactatgtatgaaataaaaagaaagctaaacgcaccgcacccaacctcccatctaaacctaacctaaatcttaatcaagctattaatatctagatttttcttactcaaccctaccaaccaacccaaacaataaagtaaaaatcatgtatacaccaacatgctcaaaatttccctcacaaaaagaacaccagtttctataagtccctttctctttctctctcactctcactctcactcatttgactgtccaaatcttctgttatttcacttctcctcctctctttccttcagtcagggagaggaagagagaaaaattgtacaaaatcatggaagagaaatttctagttttatttgaaaaaaaaaacatttttttgggctacattttctcttccctccccactaattttatttttttggtttgatcagtcatttctggctcttacatcgagaacccatttggtttccttctttttaaatttttttagggttttagtgtttcaaaattttagtcagaaaattcagaagaaaccaaagatatttcaggtaatttattttttaagtcttatgggcctaaatttatgatttttccttctttaacgtttgggtacttagaaactgaagcaaaggcgaagaaaatggagaaaaagatgacaaactttttttttgggtattcttttccctaagtaaacacaatttttgagttagagtttttttttggttttttggtttgttactggaaatgttagacggtgtttcttttcttcattttatcaggaaccaaaaaaagttttaatttttaggctttttttttttaactctttgcctaaaacccatttcttgggtttcgttgttttttcagggttatttcatttaggtagactaaaaagaagaaattttcgaggtaatatgctttttacccttttacttctacttcttgttttaacccctttcttgcatgtgatctttgttgagacagttgatttaaaaaaaaaaaaagaagagtgcaaggaatttggccatttgtgttttgttagtcaacttcagtttggttttcaattttggttttaagttatgcatgtctatggtcttgcattttctttgtccatcgtgccgaagtagagagttccttgtgtagttgacctttctcaaggtgagtcttttcatattccagatataagaggaaaaaaatcacccttaatctctttgctgtttacccggcatgatgactttgtgaagttaggtggctaaaatttcttgtttttggctgttgattctcatcattatggttcaggctactagttcattaacagaaaaagcataatatatatttttaacataaatgtagctactatcttatgatcgtccatgcctatgttacttggacttaagtgtgagtgtttgtatgcgtccaacacggatgggtatgttcattttttttttctttttaaaagtttggggggggtttcatatatcaacagactcttgtctgtaaatgagttatacataggtgttggagagggatattttaagaaaaatgaagagagggaataatgcaggtctatgcttcatgggtttgaaatggttagtttttgagtccccttcaaattaggatagtctatattactaaatgaattgtggttttattgattttgttagttggtgaatggaaatgacaaaacatctttcttataaattaatgtgtagttactgtattacttgcttttttttttttgtggaattaagcttaattgactgaacttgctattttgaacaaccacttcctttcgtgatatgtactgtgtgctggaattttcttacgccttcttcttctcttgtagacttctctgtccttcgtgtaattaaatgttattcatggagaacttgcaacttgtttttagcacattagctctgctctgatttgttcagttgctatagtagtttgggagtgattatgctcaggctatgttgctttggcttttaattttccttgaagtaccatgtatgaaacatattaagacatggatatggaggtatgaccctctaaagagttgagcatatacatctcaaacacatacgaatttcctacatgcatccctagtctgactaacataggtattaggttatagctattcaaccttaaactaaggtggatttgtaaaacaattcattttgtccttatcagtagtatctaggatgaccatatgatactggatgggttttggtgtccaacttatttgaagagcgttcaaatgtagttatagggagaaagttgccactggttttaaacttttaatatcattagcgatagcttttcctttttcccctgcatcttgtggtctttttttgttgtaatattattccccttatcattttacttattggatgtttatttgcacagttttgtcttatagtttaaagcgagaaacatggaggaaaattcttcgtcagttattttagatggtgagatagttggtataaagttctgcctggcaacccctaaagaaattgtgagttgaaatctgtctttctcatttatttgcacattagtttgtttctctatagcaataatcttccccccttggtcttttgtcatttggatgactgcaaaatgatttttggatgttccgcttattttaatgctgtcttcacctcctattcgattcctgcaaaggagttatctgtggtatctatatttgcttcttggaactagttttagcatctacaactgggaagtcgaatcatttaacaacaatgttttctgtgaacactaattttgattgattagggtttatcattgagaattacttaccctcaaattaatagtgttgatgatggactaaattctcttattttttatgcaatagttcattctttgatgctaattgactttgttcatcttccaaaatttattcacagcttacagcatcagtcagtggctttcctattaaccatgttagtcaactctcgaattcctaccttggtttgccccttgaatttggtaaatgtagcgcatgtggtacatcagaacctggacaatgtgaaggtgcttacttctattcttgccaatggataaaagttgaaagctagaaaaacaaagagaaaaatgccaaacttctcatttttgttgctgctttcaggtcattttggatatattgaattaccaataccaatataccatcctagccatatcagtgaattaaagcgactgttgagtttgctttgcttgaagtgcctaaaattgaagaacaaggtatgttaactattgcattatctattataaatgatcttgttttgaagtcacttgtacagaaagcggctctgatctctttggctctttttcattagttaaagaagatcaatgaaaggtcttgtcaaaggatgcttagctttttaggttgaaatgtatatctgtcttccatgcttcattagggacagaataaatcttgggatactgaggtataaaccttgcaggatattacctcttatatctaaaaatgtttagcaaattataagcctggaagctcatcaaaaagagatatcaccataaataatggtttgactcataagaatatcataaatattgttacctttttgactgcaggaaaaagtttaaagtcttaaatataactattcctctcttcaaagtaaaataaagtaatccgacgaatggctcacttgttgagagctaaaacaggattaaaatcttgccagtggttaaagtgatgaaaggtttctatttcctcactgctcctagatagatttaccaacccttatttctttccatttcaagttacttttcttcctccattttaccaaatttctctgtctagaactaagatcagcaattaacttattgtactttgtttagcttatatcatcctttatttgcacaaatcttgagttggcatttaaatgcataaacaatgtatttgtaagaaaatgtttaatcatgtgaaagtttctagaaatgccttgatttttcctctggagaatttgaaattcagcgctcaatgccctgcagttttaaatgataatatcccttaatttttatgtaacatcatttgtgaaaggttggattcttaattctttacttctcactaaatagcatgctgctaaatctgttgatgtatttacatgcttggtagttattagtgtttcacattacagtttcagatgaaaagtggcagtgtcgctgaaagattgctatcgtcctgttgtgaggtgagtttgatgtgcctaacattttttgcttgtttgatttgcagtacgagtgtttactaattgcagtttatcatttctgatgatgtttactattttgcatgtgattgcccacacaaacagttttctgtccccaattgaactgtatggtcatgatggaggggatggggttgttttcagagcctactccttcggatgaaggagaggcaaaatagtgggaatatgatgatcgattttaatttaagggcaactttttgagatatttacatggactaacaattgatatcgtgtaaattgtgcatgatggggtttctagtataatacctcattcttcatcctgggttaaatgagaattatttcttgaaattagttgaaattggacttatttgtatatgtatttgttctctttaattttttttggaggtgtgttattctttgttttcttacccttttctctcttgattttcatagaatactccacaagtttcaatcaaagaggttaaaacaacagatggtgcttgttatttggagttgaagcagccatctagacaatcaaaaactaactggaattttttagagagatatggttttcgctatggcgaccatcatactcgaactcttctgccttgtgaggttggtcttcaacttctctcttcttttggtgtttgaccttggctttcatatgttcatgtttgttgagatttgatgctgagtcattgtgtgctattctctttttcccaattttttcatgatttgatgttttattttgagctttacatttctagcttattattttatttttattatgctgtgacacagtacatgattacgcacctagacatgtatttacttgtattagtatcataaagttcagtatagtagtagtcttttaaagcagtcagtagtgcgtttgagtttggctgattttttgttcatatttcttggtttcaagcatcatcttgttatttttaaagttattaattagtctctgaaataataccaaatgcgtcagttttaaaaaaaatttagttcctgatacaagctgatgtgagagttgatttgttggatgagtctaaattttaccaaatctagaacaattatcttcaggaaagcattaggtttcctgaactgttatttggtcttgatacgaatatctgtttgatattgtgtctttgatgaaataacaacggttcagggttaatttttatttatttgaaaacgctaacaggtggtggaaatactgaagagaattccttcacagacaagacggaaactttctgggaaagggttcttcccacaagagggatatattttgcagtatttgcctgttcccccaaattgtttatctgttccggacgtttcggacggcgttagcgtcatgtcctcggtaagtgtattatgaacaaattaggttgcttatcttggttttcatgttggatcatattagtgttatctctttcgtggttgaccttttttttgtcaggatctttctacatcaatgctgagaaaggttctgaagcaagttgaaattatcaaaagttcaaggtctggtaccccaaattttgaatcgcatgaagtagaagctaacgatttgcaatcagcagttgagcaatatcttcaagttaggggtactgttaaagcatcccgcagcatagatgcacgatacggggttaacaaagatgctagtgattcgtcaacgaaagcatggctagagaaaatgagaacactgtttattagaaagggttcagggttttcttcacgcagtgtgattactggtgatccatacaaaaaggtgaatgagattggcattccatctgaaattgctcagagaattactttcgaggagagggttaacatgcacaacatgagatatttgcaaaatctggtggataacaagttgtgtttgacctacagagatggtggttctacatattcattgagggaggggtcaaaggggcatacatttttgagacctggtcaggtggtacatcggcgaattatggatggagatattgttttcataaataggccaccgactacacataagcattcattgcaggcactttctgtatatgtacatgatgatcatacagtgaagataaatcccctaatttgtgggccattaagtgctgattttgatggagattgtattcacttgttctatccgcagtctttatcagcaaaagcagaggtttatgagcttttttcagtggagaagcagttgcttagctcccatagtggcaacctaaatttgcagttggccactgattcattgttgtcactcagagttatgcttaagacatttttgtttaaaaaggcagatgctcaacaattgtctatgtttctctcttcagctttgccagaacctgcttttttaaagtgtaatcatgttgctccatgttggacagccttccaaattctgcagaccgcttttcctgcatgcctagattgctccagtgatagatacttaattggaaaaagtgatatattgaaagttgatttcaataaggaccttatgcagtctgtcatcaatgaagttgtggcatctattttctatgagaagggtccaaaagaggttcttaacttctttgattctttacaacctttattgatggagaatatctttgcagagggcttcactgtttgtctagaagatttttctgtctctagggaagttatagaaaatattcagaaggatattcaggttatttctcccttgctttatcagttaaggtcaacttataatgaattagttgagttgcaaatggagaatcacattcgagtagccaaagagccaatagctgatttcatactaaaaacatcctctttgggtaatttaattgactctaggagtgattctgctgtcaataaggttgttcagcagattggattcttgggaatgcaactttctgataaaggaaaattctactcgaagactttggttgaagatgtggctcaccaatttcaaagcatatatccttcagatgcaatcgattatccttctgctgagtttggactgattaaaagttgctttttccgtgggcttgatccgtatgagggcattgttcattcaatatctacaagagaagtaatggttcgctccactagaggattgtctgaacctgggaccttgtttaagaatttgatggccatccttcgtgatgttgttatttgttatgatggcacagttagaaatgtcagtagcaattcaataatacaatttcaatatgggctaagtgctagaactagacctcaattccccgctggtgaacctgtgggtgtcttagctgctactgcaatgtcaaatccggcatataaagcagtgcttgattcatctcctagtagcaattcttcttgggaactgatgaaggtaatccactatggattgtgtagaatgaaatgattaggtagtaatgctgaagcatgtctgttttgtatatcacttaccattactttgtgattttcttattttcaggaaatattgctttgcaaagtaagtttcaaaaatgacccaattgaccgccgtgtaattctgtatttgaaagattgtgattgtgggagaaagtattgccaagaaaatgcagcatatcttgttaagaatcatttgagaagagtcaaactcaaagatattgcagtagatttcatcattgagtatgttcaatctcataatcactctgctttctggggttccattcccccccccatattttgtttgttgaaaaggggatatgtatatgattactgatgagcttgagtaataatgcagtagtataaggcctaactgtagcgcattgcttacagataccagcagcagcaaattgtatcagaaatagaggcaggccttgttgggcatatccttctcaataaggttactgtacttagcctaacattattgtttcttttgggatatatttaagactttaaattgcatccatgttgcttcttttaatatatctcattttagaggtggtgaaaaacacaggatctattgaaggagttgagtgttagtgtgcaagagattcatatgaagtgccaagaaactattaactcctttcgtaagaagaaaaaaactgctgaaacttttaagaggacagatttgtttgtcaggttagttttcttcaatggaatttgttatggcggactaaatgtgttttctttattctactgtctgttaatagttactgccagaagtttgctaaaatttattgtagttccactgatttgaaaaacaaatatatattggtgcgactcttagcattatgttctttagctgatgtctaggcagtatataacttatcagtaataacattggtatgtgaaatagataccaaattcttctgctttactgtacgcatttcaaaatatgactaagtgccaactatcaacaatccaaattcttctgattacttatctcatgccaaaatcggactaagcaccaactattggcaatcagctattagttaaagtgttcttacaaaatattccaattttaccacttgtgctttttctctgtgttctgggctcctaaaattgcttatgcttttaattacgggttaatttaaaaacctcttaaaaattgggccttagctcaatcagtaatggtgggtgtgagacatggatagaagtcctaggtttgagctgtagtgctcttccttttaacaaaaacataaaaagaagcctcatacttcatctttcagctggccaatctagaagtagtagagtttgatattctccctttattgaccaactgtgctagaaccctaacagtgtgtgatctgtttctgttataacatttatctggttgcaatgggacaaagtactggtaaaactcttgcatgataagaatcactgctgatgttgaccttttctctggaaggaacctgataggtcactaggctgccaccaaaaaagaacttgggaggctgtttgacgttcggtttagcttgcattgtctgcttttatctatttcattttatctgatttctacttattgtgactttctctttggttgcatgtcttatcattgagaatctctattatttcttgatccactgcactgttctgtcgctatgtacataaattttcctctctttgaactttttggcagtgaaagttgttccatccagcaatcctgtgtggacaaatggcttgacatgccatgcttgatgttcttttttcgaaatacaaatgatgataatctagatagtgctatacaaatcctggctgacatcatctaccctgttcttctacaaacagtgatcaagggtattgccctatactttgtgatttttggtttctcttttgatgaaatgttcagcaatatgtacgaatcttacatattgctcaacagataagggtgacagtgtgattagctttctttttaaaaatttttaatatgtaattattatgttaacaagttaaggtcgccaagctgtagatatagtctcttccaatctctggtcatactttttgaatattttaatttctttgagttaagcatatagtagcagtgtataaggtccagaaaaggctaggcaacaaaactcatatagatatccacacaattattgttagttgtatcattaattttcaactttgtacaactctcaagttgttttcttttccaaaccttatgatacttggccttgaatactttctctgtctcaattatatttagcttgtaatctgagaaactggttatgatggttgctttccgacaatgtttgcattttgatatttactgttttggtatctttaatggacaggtgaccctcgtatctgttcagcaaaaattatctgggttaaccctgatgcaacaacttggataagaaatccaagtaagactcagaagggtgaattggctttggaagttgttttggagaaatctgctgtgaagcagaacggtgatgcctggaggactgtcatcgattgttgtcttccagtgctaaatataattgacacccataggtctataccttatgccataaagcaagttgagcaactgctcggaatttcttgtgcttttgaacaagcagtgcaggtatatttcaaccagacatcaagtgtagagtagggtttgatggttgtttagacgtgcatacttttcatttttggcttgcattttttgcacacgtggcatctactataacataacttactttttcttactgttaatggatgaatatagtagctcatatatacttttatcctaacaaataatcttaaagcttcattgtttcattctctgtcactgaaaatgctcactttttgtgacatttacagcgtctctccacttctgtgtcaatggtgacaagaggtgttctaaaggaacacctcatgctcttagctaacagcatgacatgttgtggaaatttaatcggcttcaactctggtggttataaaacactatctcgctcattgaatattcaagtgccatttaccgaagcaacactgtttgtaagtattttgttattctttctaagttgagaaattacaagaagtcccttcttggataaaccattgttcctttgaatcaattagctcttttatggttgcacagacaccaagaaagtgttttgaaagggctgctgagaaatgctatgatgattccttgtcgagcatagttgcatcctgttcttggggtaaacgtgtggctgttggaacaggatcacggtttgacctcctgtggaatcaggaggtatgtcatatttggagttacgctttttaatgatattcctaactcttatcctcgattgttgcttgaacttggtatttttggtggaatttggtgtcaacacgacttgtcacgaacatgggtatgggacctgtgatggttttagctggagatatctgaatccaccaaattagaccaagttgctaccctaaccagaattagtttcttcagttccataccctttcaggttttaattgctatagatcttcatgccacacaataagctgacaatttagactcagttacagtaacaagatatgaagcttgatgatctgatgtcatctttgtttgcttggttcctctctcttcctccatcttgggttattactgccaacgcccttgcccttttcatctgtcccatttaggttcatttactaagatcttaatatttttacttgaccaaaaaaacgggtcttaatattttattttggttaaagaatccatagagctttttcctcattttgaaccctctataactgtattggcatgtgttctatttcatgtagttggcatgtcagacaatgcatacctgcagttgacacctgcaattgagttcgagcaacaaacttcttattggctttcattgatttctagtgtagcattttctcattatcttttttctttcccagtctggatctgatcaaatgagtggaatggatgtctacaactttctgcacatggttagtggtgctggtggaagcaattctaatactgcttgcctgggagaagaagttgatgatttaatggatgagtggtgcttgtctccagaccatagcactggtttagataagccggtgtttgaggacgcagctgaatttgagaataatttagacggtcagtcagctagtgcaaattgggaaaaagatgtgtctttggacaaggtgtcagatgttggttgggatgcatctggatggaataaaaatgctgaggatgttgacaaatttgctgcagctgcgaccagttcggagaagcaaaatgagtggtctggttggggtgcgagcaaatctaactcacaagatgttggttgggatgctttgtctggatggaataaaaatgcagaggatggtgacaaatttgcagctgctgcaaccagttcgaagaagcaaaatgagtgttctgattggggggcgagcaaatctaaatcacaagatgttgtctctccaaaagtggatgttggttgggatgccttgtctgcatggcataaaaatgcagaggatggtgacaattttgcagcagctgcatccagttcaaagaagcaaagcgagtggtctgattgggggatgagcaaatctaaatcacaagatgtctctccaaaaacggatggaacttgtatgaaagagcaaactgaattgtctggttgggagatgaaaaagtttgatacacgagatgtccttcctgtggaagagagagcctccaagcccaatggttgggattctggtgctagttggggaataatgagcaaagaatctgaagaacttgatgctagtgctgcagctccatggtctggttgggggacaaaagattcctcccctaaaaaatctttggacaaaacttccaaatctagtagctgggatactgtttcttcttggggaaggaagactgctgcagttcatgaatctggcttcattggaaacgataaccagccgggccaagggagaattgaaaatgaatgggataataaagcaagtcaagtaaagccggtgcagtcagcatctggttggaataacaaagtgacagaggaaatggtagttcaatcgacatctagttgggatgaaaaagcttcttgggaaaagccagttcagtcaatgtctggttgggtttcctcatctgctgcaggctcagatgagtcacctacaaaaggctgtagtaagaatagtaattgggaccaacaaaaggcacagacaatgaataatgcttgggaccaacaaaagtcacctgcaacaaatagttcttgggatcggcaaaaatcatctacggcaaataattcttgggatcaacaaaagccaccagcaaatagttcttgggaccaagaaaagtcacctacaattaataattcatgggaccagcaaaagtcacccgaatgttcacagggttggggcacccttaatgacttaaaccaacctgcaagttctagtggctgggatatgccacagggtgaggataacactcaaagtgaaaaacagcatcagtggggacagagtaagggctcacgtcgttgggcttcagatgctaataagaagagtcgtcctttgaagccagctcgaatgatgaatgatgattccagtatggctgcaatgtacactgttacaagacaaagactagacatgtttacttctgaggagaaagatattctcttggatgttgagccactcatgcagtcaatcagaaaaataatgcaccagactgggtaaatttttagacttttgctcttgaaattttatgacaatgtttttagttacatcagaaagtagaaagtaatttctttatgttgttaattgacatggatctgcatgagttaggaaattctgggaaattagatgcccttacatttgatgatctatttgtatggcattatatgtttttaatcacctttcaagtgggaaacaatttgggttttgcatgaacaatctttgctatcatagttcatgtcaaaattttcatgattcttttaagcattagggttcgctcaagttttattagatacatatgtaacaaagcagacacttccaaggacctagcctacatttattctcggagtctaattattgtactgcttaatctttttttctacttttccattccccaaccctgcaatcaatagtttctgctcatgttttcatcttatgcgagttttaatagaaaattcatatttgaaggtacaacgatggggatccactgtctgccgatgatcagacgtttgtacttgataatgttttagctcatcatccagacaaagctgtaaaaatgggtgctggtattgattatgtcatggtatggcttctctatccaatttttttcccactttgcctttgtttgaatgatgttcctatcatttgtgatacatggaagaattttaggccatggcttggcatctgtgatttgtgagcttttaataagtggacaaaggcatccatgtaaacacattctcttaatggttggagttctccattagttacacgagtcactcactattcatctctcatattggctcgtactttgcatgtgtttacatgttactaccaagttccaatttcaccaatgataagatgtttgccttgttctgaggtgtcggctctgacatttcatctctttgtagtttaagttctttgtttagtgatagcataaaattctcaggccttttaaagtactctggaagtattagacgaaggtgccttcagcttagggtgatgttttcttgttctttattcacttaaagaaccaaattcccttgatacagcttgtgttgttttggactgtgcattatgtctgcatgttaactcttactgatattcagtacacttctgtgacatctagatcctatgctgtctggtcacgtaaattcgtcccatgcttcctggcccttgccttagattggttttgttaagcattgaacctaaaaccgattggtaataggtggagaggcacaatttgaatgtaaaagcacaagaaatccgagacttaatagatgtcagaaaacacacttaacatgcttaaaatttcttgtatgttagatattttataagacttggggaaaacatgattgcatatagtcatcagcataggatgaagtgatctttttatttttttggtcagtttaacagttccaatttcagtctatataagaccggttctgaatttgattttggaatgagttacctatgattttggaatgagttacctatgaatgatggtgtgcaattttatagtgatattaatatatttttgggcacatagtatttatggattttaattatatattctttcagagaagaaaagaaaggattaatcaattatttgttgtgcatcaccatttgatgcaaaacaggtaaacaagcacagccttttcctggataccaggtgcctctatgttgtcacaaccgatggtcataagcaagatttctcttatctcaagtgtctggagaacatgatcaaggggaaatatcctgatttggctgaagcttttgttgcaaaatatttccgaaaatctcgagggaaccgtgagcgaggtgttgctccagagaattctcaagggaaccgcgaccaaagtgttactcaagatgataactctcaagggaaccgtgaccgaagtgaccgaagtgttgctcaggacgataatgagggggaggttaagcagtaggcatctgtctctccaagtgttaatatcattcagagaggtctagttaggtattttgttcattcctgatatgaatcttttgatatgtacatgtaaagcagatgttagtgtgtttatccccctcaaaaattatactttcatagatcccaatatgaactgccctcttttagatggcacacattagcagttacatgtattctggttaaagtggtttttacttatgttgcttcatactctcttcttttttaccaaaggaggcaaatgccttaaaaactagtgaaatcaaattacacagtcccgagcatagttaaaatggggcctaacaaacatatgcgg

SEQ ID NO: 507 - DNA, 7563 bp, Gossypium raimondii
taatcttaattcctctcctctttcaaataatgtggcccaatttaaagggataaagttttagttttaagagaagttaaattttatctattcacctggttatttaatgtacgtactagattaaaagttgatcatcataaattaattctctctccacaaaaaaaattatggctgccatcacttaaggtttgtgtggttaaggaaaaaggattaagaagggaaatcaaatttatatggtattcttcttcgtgttcttcgtcaaatctagtggccaacttcaatttcacataagctatgtcttaagtttgtaaaaatcatattattctaaacatctaaaataattgtttatacaatattaaagatttataatttgcatcataactatatctaaatctaaagatatcatatcaaaatcttattaaaaaagtggtatttattgcctaattggaaaaaccgaaatattttgcaagtgcaatggttgttgtggcataatgataaacaaaatttaaccttaaaagcaagatttttagaacgaatggtcgaaatgatttagagtatcgattttgcagtcaattaaattaattattaaaaaataaaagaaaattgattgaattattttattaacttgattcaattggtttgtgggttaattggtttaaccatttatttcgaacaaatatcttattctatccagtccaattctaaaaacaatgcttgaaagtgcttagacattgtgatgttaagtcttttaaaattattttttatttttacaaacaaacttaaatttaaaaattaattactacaacgtaattagacctagtcatgagtcgggctacttggctcagctcgaagactcgcccaaaaagtgggagggtttaggcaaaaatataggtctgaaaaatgggtttggacaaaaaaatgagacctattttctaaaagggataggccttgggtaagctttttttggcccgggccagttcaacctgaatttgcaaaaaattatgcctattatattgctaagcatttattttaatatttgtagtgtatttgatgtattatattttttaaacttgtttttatataaaattaaaaatataaaaaaattaatatgaacagactgagctgagctcgagttttagcatttttatcctaattaagcttgaacaaaattttaaatctatttttcaagctggacctaaaaaataaacctaaaattctattcaaacctgattaatcctaacctataattaactctaaacataaccgaacaaactcaaatttacaaaattttacttcaatttatataaaaaatgatttttaaattcattatcactcaaatcaaagcctaaaggacccatgcgtcttttactacacccgtcaaacagtacagaatcacttttttatggtaacaaatttcctagttttacaataacacccctgagtctcaccaaaatagaacaaaaagagagaagtcaaggctatttacgtcatttcagttcgtctccaaaacaaacccacatgtcaattttcattgctgtttgttcttcgtctgatcgtctccgcccaattttttttttttttaaaaactcccccctaaaactcaagacttcactcctttgagactgaaacactgggaaaacccactgaaatttgatgcacattgctttacagaggctgtaaaacccttagaaatcactgaattttcacatctaagcaccgagaagattagggtttagggggggttttgttcttaatttctccttcctctccacaaactttcaatgtaagtctttctcagttcatccattgcttgtgtacgtgttgctaatgtatatatatatctatactattccactgtttatcttcgctgttctaatctttctttttgttgaagccttataaagtctgttttcctgttttctttgtgatttttttttgggggggattgtttatgtttgtgtaaaccttatttttacggggttttactttacttttctttttttattcttgttttagattttggtgcaatgggggcttcgccagatggaaagggaaacgggggaatgggcagtactagtggtgaaaagtttgcaaatggaactgatttgaatatggatatagatgaagatgatgatgtgtttgatgagctggtcagtgtgcaagagctgggagaagagtttttgaggaatttctgtaggaaagctgccgtgtctttcttcaatcagtatggtctagtaagtcatcaaataaactcttacaatgatttcataaaatacggtctccagaacaccttcgactcctttggggagtttgttattcattctggttatgatccatcgaagaagggagaaggtgactggcgtcatgccagagtgaagtttgggaaagtcaccgttgagaggccaaccttttgggctgtcacaggtggcaatgagctcaacatgcttcctaggcatgcccgccttcagaacatgacttactcatccaggatgaaggttactgttgagcttcaggtgagtagatatcaccaacagtttaaacttctagtgatttcaatgtcacgtgttcttgttgatgtttgacgtgttagcttttctggtaattttaataatctggaatctaaatgtgctgtgtcttagtatcttcattgcttaactgatggttttggctaaaaataagttccttaaagtatgatatttttgtgccctggtaatgtatcaggtatatacagcaaaaagtgtaaagagtgacaagtttaaaactggaagagaagaaattgttgaagaggagatcgtgcatcaagataacagggagattataattggaaggatccctgtgatggttaagtctgagctgtgctggatgaatgaggttgaaaagtctgattgtgattttgatcacggaggttattttctcatcaagggcgcagagaaggtcagtctggcatttttttattctgttagttgacttgttattcagtgcccatacaccattattgctgaacagacttgaatttgctaaccataattaataattttttgccatatttaattgtagatattcattgcacaagagcaaatctctctgaagaggctctggatttcaaacatacagggctggactgttgcctacaggtcggaggtgaagagaaataggctaattatcagactagtggagaattccaaagtagaatatatcaaagggggggagaaaatcctgactgttttcttcttgtcgattgagatccccgtttggattttattttttgcccttggtgtacgatcagacaaggaagttgtaagtctgattgattatggaagcagtgattcaagtatatcaaacatactgttcgcgtcgattcgtgatgctgattggaaatgccgcaattttcgtgaagaaagtgctgctctcaaccatttggataggttacgcaaagaaactagatttccccccgaagaaagtgttgaagagtgccttggaaagtatctgtttccctctctcaaaggattcaagcagaaggctcggttcttggggtacatggtcaagagtcttttgcaagcattcaccggtcatcgaaaatgtgacaatagagatgattttaggaacaagaggttggagttggccggtgagctgcttgagcgtgagatgaaagttcatattgcccatgcaaggagacgtatggcaaagactctgcagagggatctttatgcggatcgtactgttcgtccaattgagcattatcttgatgcttccatagttacaaatgggctctctagagcattttctactggagcttggtctcatccttacaaaaagatggaaaggatatcaggtgtagtggcaaatctcggacgagcaaatccattgcagacaatggttgatttgagaaaaacacgacagcaggttcagtacactggaaaggtcggagatgcgagatacccgtaagttttgtcagactcgtatcttgtaaattgtaacccattgctgcaaaagatgcaatatttgtttcacttcatagcaatctatttttacattcagaactttgtgatatcaacaatatgagtttcatatcttttgttggtttggtatctttgatagtttgattatgcaattgcatggacatgaatctttgcaaactgtgtatctcttatactttatctgaaagtcatttttttcacttcagaacagttggattagaagttagttaaatgtttcaatgattctatctttagttttttgctttcctgtggtaattttcctctagaatctgttattagtagtgtttgtattttagggtttgaaatatggagttgatttatctttagagcatttgggtctgttgagatgtttgtcagcaataatgttgagatgtttgtcagctctgatataattttctaatgcagacatccttctcattggggaaaagtttgctttctctctactcctgatggtgaaaattgtgggcttgttaagaatctggctaccactgctcttgtgagtacgaacatagtgaaatccgtagtggaatccatagtcgacacgttgtttgattctggaatggagaaagtggttaatgatacttcaagctcacttgatgggaaagataaggtctttctgaatggggaatgggttggtgtttgtgaagattctcttttctttgccgctgaacttagaagaaaacgacgcaggaaagaattgccgtatcaggtgatcgccatcccatttcatagaccttatagcttttgaatttctccacttcgaaatttttatatgcatacctgcttgttcactgatcaacgtaatgggcttgaaccatgaaacaaaaattgtgtctgttaaggttgtatgtgtcaggagggctttggacaattttaatcagctgtactcgaaaactcagcttttcttgatgttttcatctttttcttattagtagttggcatgtttgtgaacttcagcaattagaaatgagaagtgaagccctaggctgagaatcttttccttttactaaaatggaagagagtaaaattgcttagaagtcccccagcatcgattcttgtacaatatagttttgtgaaatttaaattgcttttattctgttgttcattattattggtctcctcatcttttctctaaatgattttcatcttgtaggtggaaattaaaagagatgagcataaaggagaggtgcggatctttactgatgctgggaggattctacgcccgcttttagttgttgaaaatctgttcaaactaaaagcattcaagggcaaggaaaattatgctttccagccccttttagacaaggggattgttgaactcattggagctgaagaggaagaagattgtcgcacggcatggggtatcaggtacctcttaaccgaagttgaggggaagcaacctgtcaagtacacgcattgtgagctggacatgtcatttcttttgggtttaagctgtggaatcattccatttgccaatcatgatcatgcgcggagggttctttaccaagcccagaagcattctcagcaggcaattgggttctctacaacgaacccaaacatcagggtggacactttgtcgcaccagatgtattatccccaaaggccactcttccatacgatgactgctgattgtcttggtaaatctggatttcctcttggtcagaatagattggaaccgaagccagaactctacaatggccagaatgctattgtggctgtaaatgttcatctcggttacaaccaagaggattccttggtaatgaaccgggcctcgatagagcgtgggatgttccgcaccgaacatgtaagaagttacaaagctgaagtagataacaaggaaatccaggagaagaggcggaaggctgaagatattgtaaactttggaaaaacagaaagtaagattggacgggtggacagccttgatgatgatggttttccttatatcggtgcttccctgcagtctggtgacattgtcattgggaggtttgcggaatctggagctgatcatggtgtaaaactgaagcacaccgaaagaggcatggttcagaaagttgtgttatcttcaaatgatgatgggaaaaattttgctgtggtgtctctgagacaggtagcgttagcatgttttgttctgcaaaatagcgtctactgcttttaagtaatgttcatcagttgtctttctgatatatttttcaggttcgttctccctgtcttggagacaagttctcaagcatgcatgggcaaaagggggtccttggttttctggagtctcatgagaactttcctttcacaactcaaggaatagttcctgatatcgtgattaacccacatgcatttccttcacgacaaacgccaggtcaactcttggaggctgccttgggaaaggggatcgcctgtggtgggtcgaagaaacatgccacccctttctccactctctccatagatgccattacagaacagcttcacaggtaatgaattgccctggaacaagttgacctgcgtgcttactgtgcattcatcatggattttttcattatagagatcttaggtgggccgtttcagagttgttttggtgtatcaatgcctttaacgaatactattggattttcacgctttgttgctttgttgatctgcatgcttactgtcctggaacgattagcgagcatacatgctggttttcagactttgatcacacataagctatagctttgttttttgtgtctctaggctatttgatatgttcttgaagcttgactcactgtttgtagtgattatatatttaagttgtccatttcgttgtctaataccattattgggttttcttatagttactgttatttacaatgatggctactttgtctaatatctcccacagggctgggttttcaagatggggaaatgagagagtttacaatggtcggactggtgagatggttcggtcactcatatttatgggtccaacattctatcagcgtcttgtccacatggctgaagacaaagtgaaatttcgtaacactggacctgtgcacccacttacaaggcagccagttgcagaccggaaacgttatggcgggatcaaatttggtgagatggagcgggactgccttattgctcatggtgcatcagccaacttgcatgagcgcctcttcacgcttagcgattgctcacagatgcatgtatgtcagaattgcaaaaatgctgcaaatgttattgaacggaccgtagcagctggtcggaagattaggggaccctattgccgggtttgccagtcaggggatgagattgtgaaggttagtgtgccgtatggtgccaagttactgtgccaggaactattcagcatggggattagtctgaaatttgagacacagctttgttgagttagctgctaaactctttatcaactgttataacttctaatcgcaaatacttgggttcttttggttgaatgatgatgtaaatattagcaatcgaagttattgcagaatttaacttgtcaattgccttgcctttaatacttattatgcctctttaacacaatcccttggtctgattttaaaaatcaatttaattt

SEQ ID NO: 508 - DNA, 6601 bp, Gossypium raimondii
gttatttaatgtacgtactagattaaaagttgatcatcataaattaattctctctccacaaaaaaaattatggctgccatcacttaaggtttgtgtggttaaggaaaaaggattaagaagggaaatcaaatttatatggtattcttcttcgtgttcttcgtcaaatctagtggccaacttcaatttcacataagctatgtcttaagtttgtaaaaatcatattattctaaacatctaaaataattgtttatacaatattaaagatttataatttgcatcataactatatctaaatctaaagatatcatatcaaaatcttattaaaaaagtggtatttattgcctaattggaaaaaccgaaatattttgcaagtgcaatggttgttgtggcataatgataaacaaaatttaaccttaaaagcaagatttttagaacgaatggtcgaaatgatttagagtatcgattttgcagtcaattaaattaattattaaaaaataaaagaaaattgattgaattattttattaacttgattcaattggtttgtgggttaattggtttaaccatttatttcgaacaaatatcttattctatccagtccaattctaaaaacaatgcttgaaagtgcttagacattgtgatgttaagtcttttaaaattattttttatttttacaaacaaacttaaatttaaaaattaattactacaacgtaattagacctagtcatgagtcgggctacttggctcagctcgaagactcgcccaaaaagtgggagggtttaggcaaaaatataggtctgaaaaatgggtttggacaaaaaaatgagacctattttctaaaagggataggccttgggtaagctttttttggcccgggccagttcaacctgaatttgcaaaaaattatgcctattatattgctaagcatttattttaatatttgtagtgtatttgatgtattatattttttaaacttgtttttatataaaattaaaaatataaaaaaattaatatgaacagactgagctgagctcgagttttagcatttttatcctaattaagcttgaacaaaattttaaatctatttttcaagctggacctaaaaaataaacctaaaattctattcaaacctgattaatcctaacctataattaactctaaacataaccgaacaaactcaaatttacaaaattttacttcaatttatataaaaaatgatttttaaattcattatcactcaaatcaaagcctaaaggacccatgcgtcttttactacacccgtcaaacagtacagaatcacttttttatggtaacaaatttcctagttttacaataacacccctgagtctcaccaaaatagaacaaaaagagagaagtcaaggctatttacgtcatttcagttcgtctccaaaacaaacccacatgtcaattttcattgctgtttgttcttcgtctgatcgtctccgcccaattttttttttttttaaaaactcccccctaaaactcaagacttcactcctttgagactgaaacactgggaaaacccactgaaatttgatgcacattgctttacagaggctgtaaaacccttagaaatcactgaattttcacatctaagcaccgagaagattagggtttagggggggttttgttcttaatttctccttcctctccacaaactttcaatgtaagtctttctcagttcatccattgcttgtgtacgtgttgctaatgtatatatatatctatactattccactgtttatcttcgctgttctaatctttctttttgttgaagccttataaagtctgttttcctgttttctttgtgatttttttttgggggggattgtttatgtttgtgtaaaccttatttttacggggttttactttacttttctttttttattcttgttttagattttggtgcaatgggggcttcgccagatggaaagggaaacgggggaatgggcagtactagtggtgaaaagtttgcaaatggaactgatttgaatatggatatagatgaagatgatgatgtgtttgatgagctggtcagtgtgcaagagctgggagaagagtttttgaggaatttctgtaggaaagctgccgtgtctttcttcaatcagtatggtctagtaagtcatcaaataaactcttacaatgatttcataaaatacggtctccagaacaccttcgactcctttggggagtttgttattcattctggttatgatccatcgaagaagggagaaggtgactggcgtcatgccagagtgaagtttgggaaagtcaccgttgagaggccaaccttttgggctgtcacaggtggcaatgagctcaacatgcttcctaggcatgcccgccttcagaacatgacttactcatccaggatgaaggttactgttgagcttcaggtgagtagatatcaccaacagtttaaacttctagtgatttcaatgtcacgtgttcttgttgatgtttgacgtgttagcttttctggtaattttaataatctggaatctaaatgtgctgtgtcttagtatcttcattgcttaactgatggttttggctaaaaataagttccttaaagtatgatatttttgtgccctggtaatgtatcaggtatatacagcaaaaagtgtaaagagtgacaagtttaaaactggaagagaagaaattgttgaagaggagatcgtgcatcaagataacagggagattataattggaaggatccctgtgatggttaagtctgagctgtgctggatgaatgaggttgaaaagtctgattgtgattttgatcacggaggttattttctcatcaagggcgcagagaaggtcagtctggcatttttttattctgttagttgacttgttattcagtgcccatacaccattattgctgaacagacttgaatttgctaaccataattaataattttttgccatatttaattgtagatattcattgcacaagagcaaatctctctgaagaggctctggatttcaaacatacagggctggactgttgcctacaggtcggaggtgaagagaaataggctaattatcagactagtggagaattccaaagtagaatatatcaaagggggggagaaaatcctgactgttttcttcttgtcgattgagatccccgtttggattttattttttgcccttggtgtacgatcagacaaggaagttgtaagtctgattgattatggaagcagtgattcaagtatatcaaacatactgttcgcgtcgattcgtgatgctgattggaaatgccgcaattttcgtgaagaaagtgctgctctcaaccatttggataggttacgcaaagaaactagatttccccccgaagaaagtgttgaagagtgccttggaaagtatctgtttccctctctcaaaggattcaagcagaaggctcggttcttggggtacatggtcaagagtcttttgcaagcattcaccggtcatcgaaaatgtgacaatagagatgattttaggaacaagaggttggagttggccggtgagctgcttgagcgtgagatgaaagttcatattgcccatgcaaggagacgtatggcaaagactctgcagagggatctttatgcggatcgtactgttcgtccaattgagcattatcttgatgcttccatagttacaaatgggctctctagagcattttctactggagcttggtctcatccttacaaaaagatggaaaggatatcaggtgtagtggcaaatctcggacgagcaaatccattgcagacaatggttgatttgagaaaaacacgacagcaggttcagtacactggaaaggtcggagatgcgagatacccgtaagttttgtcagactcgtatcttgtaaattgtaacccattgctgcaaaagatgcaatatttgtttcacttcatagcaatctatttttacattcagaactttgtgatatcaacaatatgagtttcatatcttttgttggtttggtatctttgatagtttgattatgcaattgcatggacatgaatctttgcaaactgtgtatctcttatactttatctgaaagtcatttttttcacttcagaacagttggattagaagttagttaaatgtttcaatgattctatctttagttttttgctttcctgtggtaattttcctctagaatctgttattagtagtgtttgtattttagggtttgaaatatggagttgatttatctttagagcatttgggtctgttgagatgtttgtcagcaataatgttgagatgtttgtcagctctgatataattttctaatgcagacatccttctcattggggaaaagtttgctttctctctactcctgatggtgaaaattgtgggcttgttaagaatctggctaccactgctcttgtgagtacgaacatagtgaaatccgtagtggaatccatagtcgacacgttgtttgattctggaatggagaaagtggttaatgatacttcaagctcacttgatgggaaagataaggtctttctgaatggggaatgggttggtgtttgtgaagattctcttttctttgccgctgaacttagaagaaaacgacgcaggaaagaattgccgtatcaggtgatcgccatcccatttcatagaccttatagcttttgaatttctccacttcgaaatttttatatgcatacctgcttgttcactgatcaacgtaatgggcttgaaccatgaaacaaaaattgtgtctgttaaggttgtatgtgtcaggagggctttggacaattttaatcagctgtactcgaaaactcagcttttcttgatgttttcatctttttcttattagtagttggcatgtttgtgaacttcagcaattagaaatgagaagtgaagccctaggctgagaatcttttccttttactaaaatggaagagagtaaaattgcttagaagtcccccagcatcgattcttgtacaatatagttttgtgaaatttaaattgcttttattctgttgttcattattattggtctcctcatcttttctctaaatgattttcatcttgtaggtggaaattaaaagagatgagcataaaggagaggtgcggatctttactgatgctgggaggattctacgcccgcttttagttgttgaaaatctgttcaaactaaaagcattcaagggcaaggaaaattatgctttccagccccttttagacaaggggattgttgaactcattggagctgaagaggaagaagattgtcgcacggcatggggtatcaggtacctcttaaccgaagttgaggggaagcaacctgtcaagtacacgcattgtgagctggacatgtcatttcttttgggtttaagctgtggaatcattccatttgccaatcatgatcatgcgcggagggttctttaccaagcccagaagcattctcagcaggcaattgggttctctacaacgaacccaaacatcagggtggacactttgtcgcaccagatgtattatccccaaaggccactcttccatacgatgactgctgattgtcttggtaaatctggatttcctcttggtcagaatagattggaaccgaagccagaactctacaatggccagaatgctattgtggctgtaaatgttcatctcggttacaaccaagaggattccttggtaatgaaccgggcctcgatagagcgtgggatgttccgcaccgaacatgtaagaagttacaaagctgaagtagataacaaggaaatccaggagaagaggcggaaggctgaagatattgtaaactttggaaaaacagaaagtaagattggacgggtggacagccttgatgatgatggttttccttatatcggtgcttccctgcagtctggtgacattgtcattgggaggtttgcggaatctggagctgatcatggtgtaaaactgaagcacaccgaaagaggcatggttcagaaagttgtgttatcttcaaatgatgatgggaaaaattttgctgtggtgtctctgagacaggtagcgttagcatgttttgttctgcaaaatagcgtctactgcttttaagtaatgttcatcagttgtctttctgatatatttttcaggttcgttctccctgtcttggagacaagttctcaagcatgcatgggcaaaagggggtccttggttttctggagtctcatgagaactttcctttcacaactcaaggaatagttcctgatatcgtgattaacccacatgcatttccttcacgacaaacgccaggtcaactcttggaggctgccttgggaaaggggatcgcctgtggtgggtcgaagaaacatgccacccctttctccactctctccatagatgccattacagaacagcttcacaggtaatgaattgccctggaacaagttgacctgcgtgcttactgtgcattcatcatggattttttcattatagagatcttaggtgggccgtttcagagttgttttggtgtatcaatgcctttaacgaatactattggattttcacgctttgttgctttgttgatctgcatgcttactgtcctggaacgattagcgagcatacatgctggttttcagactttgatcacacataagctat

SEQ ID NO: 509 - DNA, 6077 bp, Gossypium raimondii
tataataaatcctagttttatctttatatcatactttaatttttaacttttatgattttacttctataagaaaaacttataatctacttttaatctcttaaaaaaatataacttcacccttaaatattatattaaaatcgaatatcaaatgatatattaaacataatacattttctatggataaaagtgatgacttatatatcttagaaaaactattttacataaacaatagaatcagtctatggaatggaggttttataaaatgttatatttaatgaacttatttcaccaatatatgcacttacatgttactccaaagtaagtcaatatgtttaggcttagcatataacaatcttttaatatatataatttatttatgtgaaggttgattttctgtgattttacgtattaaattttgatttgattcaatttttataaattattaatataattattgatgtaacatcattttatgtttatatattgtatataaaaataattatatttatccaatctaaaaataaattgatgtatttatttatttaaatgtgtataattgaatcaaaattaaagtttcacgtataaatttgaaccacaatcaaagtttcatatgtataattgcatcaaattaaaattaatgtattaaattacacattaaattaaaatttatgtatcattttaaagttatacccctaaatttttaggatataataaaataagagcaaaaataaaaataaaaaacatttgataacatttttcttgttttaataatttacttttaaaataaaaaactactacattgttagggtaacatatatcattagtcgcctaattattattgtgtttctgttttgatcataaaactataaaaaattccaatttcatcactaacattttaaatagtttatgttttgatcactctccgtgaaatggtttaggaaaatgatagatgtgacctataataatgatagatgtggtcaatctcaattctaaataattcagtaaatttaattatctatatttacaaatgttatcctcaaacgtatataattaaataaatttcccaacatcctgattctataatctctaccatgaaagctagctgcgttaatgtaggcctgaatcaagtccaaaaaggttccatcaacccaacttttgttattttcatttgtaggcatgatgtttggagaattggattttgcgaatcaatcaacttaagcttcacttccactaaatcaaccttatttttagtttcttttcaatccccctccaaaaaaaaaaatttgtttgaagaatgctaagcaacagaaacacaaataactgaacaatctttttgcattttttattactatactagattttaggaatgaacatacaataatatataaatattgagaatcaaatatgttattataccagataaaaataatcacatcatcatctcttaattatatttatatttaagggaaacaattgggtgtagtttttttttttttaatggctaaaggcaactctaattccaaaggataaaaaaccttggcccaagttaaataatcataaaacttcagtgaaagcagaaaaggtgaaaggaaaaaaagggtgtaaaccaccgcgccactagccggcagtagtagactgaaaccgaggcaaaagcaaacactggaaggcaaagcaaaaccttgtgagagaagagaggtgatggatggtacggagatagagagacccacattacggctcaccaacataccccaaaccgccgttgccaaagatctcttagacttcttcgagtccaagctcggccctgattcggtcttcgccattgagatctctaccgaccgcaacaactggaagtctcgtggttttggcagagtgcagttcgctgctccccaagctaagtccgatgcccttcgtctctcccgccacgatcacctccttttcaagtcccattctcttaaactctctcgaacttatgatgacatcatccccagacccatcagggccgatcataggcttgatggtggagtccttcatgcgggttttatgtctagtgatgattgcttgcgtgtcttggagcgctgggagggtgtgagaggttggataatgcccgagagaaggagattggaattttgggtatggaccgatggagagtgttacaagcttgattttctgtttgatgatatttttgagactgttggctgctgcttcgatggctctgcatgcaatgctcttctcttgagggtatgcttttttcatcatcgctgctaaccaattatgtgtttccagtctattacatggttggttatttgcaattttgagcactaatttcatgtttactgtcattcttttaacggggatttgttataaagatttcatagctagagaactgaaacaaccgagcttattcatgttatgtgtactttccagtaagcctatgtttgcagtttattgagcttgttaatatcattttgaacaagaaaattgcatttatagaaatatcattaatgttttcaccatggagttaattgatttcgtaatgccatggaaggactcgtatgcaattattttagatgtaatatactgctggggtacatatgttgaaaactattaattgtgttaattgtgtggaatggtttttggataactattgtttccaggttaggtatgctccaaggatatatcagaaagtatctgggccgaatgtggcttcaaaattcagtacggatcggtatcatatatgcaaggagaagtttgacttcctttgggttcgaacaacagatttttcaaggataaaatcgattgggcaatcgacttcgttttattgggaatttaatgcaggattttcaatctcggatatgtctacatatctcccgtgttatagagaagacatccaatctccatctttagaggccagaagagaattctcatctccatcagaaattgttccgcttgtaaagttcccatcagattccaagttagcatatgagatcctttttcagctcaatgcccttgttcatactcaaaaaattagcattgctgcagtggacactgatctgattggtatcctcagtggtttgcctgtcgaaactgctgtaatgattctgcagaagcttcgcctgctgcagtccccttgctataatcccgtttcatttgtgaaagcaaaattacctacaggaaaaaactaccgaattcctttatctgtttctgaaaggttaaaaaatcacaatgtcatgagctgtcgtagagccctaattacgcctacaaagatttattgcttgggtcccgagcttgaaacagctaattatgtggtaaagaactttgcagaatatgcttcatattttatgagagtcacttttgttgaagaagattggagtaagctttctgcaaatgccatttctactggtgtgcatctgggtgttttttctagacctttcaaaacaaaaatatatgacaggatattgtatgttcttcagaatggaattgttatcggagataagcgattcgagtttctggcattttctgctagtcagcttcgatcgaattctgtctggatgtttgcgtctaatgatgaggttaaagcagaagatattagagaatggatgggatgcttcaagaagatacgtagcatatctaagtgtgcttcaagaatgggtcaattgtttagttcctcgatgccgactcttgttgtccctgtgcaggatgtggagattattgatgatattgaagttaaaactgatggcattaattattgcttctctgatggtatagggaaaatttctctgccttttgctagacaagttgctgagaagtgtggattgaatcacattccatcagcatttcaaataagatatggtggttacaaaggtgtcgttgctgttgaccgtaactccttttggaagatgtctctgcgtgatagcatgctaaagtttgaatctaaagtcaggatgcttaatgtcaccaaatggagtgaatccatgccttgctttttgaatcgagaaattgttactctcttctccaccttgggcatcaaggatgaagtttttgagagaatgcaagaggaacaactgtgtctgcttggcaaaatgctaacaaatagagaagcagctttggataccttacaaagtttaggtggagttaattccaagaacattctggttgaaatgcttcagttttatgagccaaatgtccaaccttacctctcaatgatgcttcaagcacattatgagaatctactgtctgatctaaaaagcaggtgccgtatatttgttccaaagggacggatcttaattggttgtttggacgaaactggtacactgaattatgatcaagtttatctctgcataaaaatgaaaaaagcagaactagaatgtgcagaccaaagttacttccgtaaggtggatgaggaaacagctatagttataggaaaggtggttgtcacaaaaaatccttgccttcaccccggggatgtcagagtccttgaggctgtttatgaaccccaactagaagagaagggtttggtggattgccttgttttcccccagaaaggtgaaaggtattatggttcacagtttaatttaactcttgttttcgtattcttcatggaaaactcaatatactctgctctcctatatgaaatagttgctaccacgtgtttgttcctatcattttctgatcttgaggtcacttataagattgtgtttgtcttactattcctggataacattgtgtctgatgccatttatggcaacaagaggtggttactgttagttatttttggatcttaaatagattggtgtggctaacgcctacaatttgatcttgtaggccgcatccaaatgaatgctcgggtggtgatcttgatggggaccagtttttcattagctgggacaaagatctcatcccatgtcaaactgagccgccaatggactacactggacgaagacctcggataatggatcatgaggtgaccttggaggtagtttgaaactgagctggaatttctgatgtgatgaaacttggaaagatttgtatttagttagatttttttttcatccttatcctttggtgaaatttttgcaggaaattcagaagttttttgttgactacatgatcaacgatactttgggtgccatttctactgcacatctagtgcatgctgatcgtgaaccagacaaagcgtgcagtgaaaactgtctagcattggctactcttcactctatggctgttgattttgccaagacaggcgcaccggctgagatgcctcgtgctctgaaaccaagggagtttccggacttcatgcaaaggggaaacaaacccatgtatacttcctctggtgtactaggaaaactgtaccgtgctacaatcaactccacagtgcaaacaaggtcaaagtttgtttggacaaaagagatggccgagttagtttatgatcatgacctggaagtaaatggctttgagtcgctgatatcagttgcagagacccataaagagatgtatgaagagagaatgagcttattgatgagttattatgatgtagagtatgaggacgagatcctgacaggtaacatatacaacaaagcacagtttttgctgcgagacaaccggagatatggagaaatgaaggaacgaatcgtgttgtctgtcaaggacctacagagagaagctaaagaatggtttaagagtagctgcagcaaggctgatgagcatcaaaaacttgcctcagcatggtattatgtgacttaccacccgaattacttccaggaaaggatgaattccttgagctttccatggattgttggagacattttactgagggttaaatctcggaataagtttttgaatagccgagaaattcagagaaaccgaccgaaattcgataatgtctacattaagtccccaagaaggcatacttcaggtgatgaatcatccatggaatgaccaaatttaataatattctcctgtgaatgtaaactgctgtctcgctaatttgaaatgatttgaaaggatatgggtagggaaaatcaaggtatttaaaatttaagaactacaattttatttttatttttatttaatatataatt

SEQ ID NO: 510 - DNA, 7711 bp, Gossypium raimondii
aaaattatttaaaatggcactggggcacttcttgctaagccttccctgttgcatcaaaatggcatctacttcctctttagtaattagatgtcctcgcgatgatattgctgttgcagatgatgcctccttcgacggaagcgaacttgtattcatttaacgatggtggattttgcagcggaagggagcatttgtttctctttcaatttttatgatgaatatctccttcttgaccaacctttgctcttggcttgcttcccaaacagtgcttcagttatttggtgaatcttgggctcgcttttagctttcaagttggtctcttccactaatggtgtttgtaggggatttttttaagtaaagaagaagataaatgaaacaagaaaagaaaagaaaagataaatgttgtattgttatgaaaaagaaatcaaaattacatgttagtattttagtaaattaaatgacgtggattagtgtaaatgtatttgtttttatcgatttaaacattcagattagaaatttttttaaagaaaaatggttaatgggttgaatttggtgtattaagtgtaatattttcgtccatgtacatttgaatttttcgaacaaattgatttaataaaattatccataatttacattaatatcatttgcatattgtacttaatgatttttgaatgcaaaacaaaataatatatcattgatctaacataataaaatgtgagtttgaacctattgaaatacgtttatcctcctatttaagagttgatgagaaataatgcttaatcttaagcactgttgcaagattcctttaatgtgtttaccatatttggagttagtctcatgtttctataagtgttaagttatcaaaattaactctaaaagcacttgtttttttattatataattttacaatattttaatcaatttcaataatgttaagtcagagcaattcaaatgtcacattttccttgataattttattgaaattttatatttcagtattttattcaattttgattttttttacttaaataaaatataagttcagttacaaacactcctttcaacaagcgtttcactttcacacactttttatcacttgattattattaatttttcatattacttaaaaaaatatattttttgagtttccaacaattttagttgatgatgcaatcagatttataaattaatttcaatattatacaagtattaatatataaactgtaataaaaataagaattaagacaaatgatatgaaagaaactaaactggttaaaagatttgataaataagacaatttagtaaagttgttaaaaaagataaagagtctaaaaaatatatatgaaaatatgtttaaaagtatcataaataggagattctctctaaacatcaaaattttacgatggaaaaaagcgcactcaattttaatccaatttagctaatttaaattctactaataaaatatttcttttgtactcaatacaaatgacaataaaaatggcaaaagcgggaaatggaaacaacttctccagcaagtagtaagaaaaaaaaaaaaaaaagggggggagggggaagacctgaactggagactaaagttctttgtctttctcctaaacaacttcttcgtgaagtgcttaagaatcaagacacgataaaagcacacttgtttatatactgggtccatccctctaactctaagctcactccctaaaactcacaaatactttgctttctctttctctcactcctactctgcaaacgcgttcaaagttgcttctcttcttgtgtcaaaccaatacgctttcaggttagcagatttttctgacaacccaattttcttttcaagtttaatttcgtttgttttctaaccttgcaatgaccacattttgtttttgaaggggtttctgtttgaaattaaaatgagaaactggatttgggtatttcgatttttatcacatcatgttaaatttgatgttttatttttcttttttcttttttatttctgtaatttgctaaattgtcgatttgattgtttggctgtatgtgatttagcagaagattaaaaggttgaatttgatcttctgattaatagacacagggttgacaattaaagtgaggcatcatgttgtttgttatggtctctttaaggttatccaagcttttacctaaaacaatgcaagaagatgaatttcatactactagtgataattggaatggattctgttttgcatcaattaggtatatttcgtacggttaaattacgaatcctcgattaggatgtggaatgtaaggataagggcagaaaatgaagtctatatagtatacatgttccatagaataagggtggatcgtttccattttcctttgttattttctactaaagaaaaagaaaaaaaaagggttaaatcactgttctgctattaacgattcttcaatttgttccgagaacatgaagaagttactccataagtttcgattgcatgatacattctgtttccaccattgtcgaagcacaaagctctaacctttgaaactaaagtatgtagtttgtttctcagtccaacttagtgctaatgcattttcaaagataccatggcttgaattaactttttagttccattatttgctcacctattatggggcacttaaatggcttgaattccatgggttggtagcaaattgatgcctgtaatttccccctctggataaaatgcttttgagaggaaatttacctagtattgttgctgagtatgttagtgttaatccacctagtcgctgcggaggttgttgtaaaagaaaattaaggcttattttcaattgactaatataacagaagtctgtgtgctgatttcttaatttgttttctttttctcttatgaatatgttgtgtctagttttgtttcaggaacttattggctttcaacccgaactggttaattttctgaaatatatggagttagaagggagtgtaaaggagactgtggtgacacaagttagtgttggtggatttgaccgacatgtcaaagccagagatctgatgaagtacttggagaatgcagttggcgttgtctggaggtgtagactgaagacctcatggacaccaccagaatcgtatcctaatttcgaaattactgacacttctgttatccaaagaaaagataactataagaaggtggagccccatgcctttgttcattttgcttcaccggaagcagtgacttgggctgtggatgctgcaggtcgtactgagcttgctttcaacaatcagctgttgaaggttagtttggggcctgagaatccttattacttgaatcgacggaggagggacacagcaccctttatgctacctgatgtctccctggagattggagcactggctagttgcgatgaattctttgttggctggagaggacctccttctggtgttgagtttcttgtggatccatttgattgtacctgcaaattttgtttctccagagatacagccttctcgttcaaaggcacaaatgagcgtgctgtcataaagtgtgactttaaggttgaatttctggttagggagatcaatgaagttaagcagtattcagaacagacgggttttgtagtgctcttgcagctggcttcgtcaccttgggtctggtatagaactgctgatgacgactttgaaaaatcagttccatttgatctgttggatgatgatgatcagtggatccggaccactgattttactgcaagtggagctatcggtcgttgtaatacatacagagtcctagtccgtcctcgtcatggtttaaagctgaagaaggccatgtattatctcagagaacgaagagtaccagtgaaagatctcagatcacaacttaggatctgtgatgaaccttattttgggaggtccatgtctgatcacttctattatacttacaaggaagggattccttttgaaataatgtttttggttaatgctgtactgcataaaggcatatttaatcagcatcagctatcaatggacttctttaagctactgagaaatcaatcaatggaggtcaatgtggctgcactaaggcacatctattcctctaggcatccagtgtatgatgcctataagaggctgaaagatgttcatgattggctgttgaagaatcccaaactctttaggagccctccgcagttggatgatattgttgaaatcagaagattggtcattaccccaaccaaagcttattgtcttcttccggaagttgagctttctaatagggttctcaggaaatataaagatgttgctgatcggtttttaagggtcacatttatggatgaaggcatgcagacaatgaatgcaaatgtgctcacttactataatgccgcaattgtaagggatgtgacgtctacctctttttctcagaaaacgggagtattcaaaagggtaaagtctattctaacagatggattttacttgtgtggtcgcaaatactctttccttgctttctcagccaatcaattgagagaccgctctgcatggtttttcgctgaagatgggaagataaatgtgcttcaaattataggttggatggggaagtttgcaaaccggaatattgctaaatgtgctgccaggatgggtcagtgcttctcgtcaacgtacgcaacagtggaagttccttcaggacaggttaacatgcaccttccagatatacagaggaatggatatgatttctctgatgggattggcaagatcactcccgatcttgcaatggaagttgctcagaaattgaagctggacttgaatcctccttgcgcttatcaaattagatatgctggttgtaaaggggtcgtggcttgttggccggaagaaggtgatgggatccgtctttctttacggtccagtatgattaagttcttttctcaccacacaacactggaaatctgttcttggacaagatttcagcctggcttcctgaataggcaaattattacattgctttcaacactaggtgtgcctgacaaagtattttggggaatgcaaaagtccatggtttctaagttggacaaagtccttgtggacactgatgcagcatttgaagtcgttatttcatcatgtggtgagcaagggcatactccagcaataatgttgagtgcaggtttcaagcctcaaacagaacctcatttacgaggaatgttgacttgtgtgagagcatctcaactttggggccttagggaaaaatctaggatttttattcattcaggcagatggttaatgggcgttttggatgaactaggtgtacttgaacaaggtcagtgctttatccaagtgtcaaatccatctctacaaaactgcttccttaaacatggttctaggtttgctgaaacaaagaaaaattttgaagtaattaaggggctggttgtcatagctaagaatccttgtcttcaccctggagatgtaagaattctagaagcagttgatgcccctggtttacaccatttgtatgactgtctggtcttccctcaaaagggtgagagaccccatacgaatgaagcttctggaagtgatcttgatggggacctttattttgtcacatgggaagaggctcttatcccccctagcaagaaaagctcacaacccatgcagtataaccctgatgagcctcgggagttgcatcgcccagtcactcataaggtaactgtttgttctgttttattattatcattgaacttttatgaacctgtggttttccagaattgtttttctcttatttccttttttccaattggcgaatttccagaatttttttttaatttccttattctcaattgcaaaatataagtaccagcacttcttaataaaaccaacaatttgttcctacaaaacagtattgttttctagtatggtacttggaagctagtattgaaaggaatgtttctatcatagacatgcatgtttgagcgcctaactatctgttttaatgttattattcttttatggttatataaccggctgtcttaatgttgtaatggcactatgttgttgggttgaaacctgattgacagactgtttttgaaatggtttttcttgtcactggtaactgtttgtgttgctataatttccatagggcaatgagaaaaactgtggcggtaacactaggaagttctcaagtataacatattaataaaacaggaaaagcgggttttggatttatatcatggtgaataccttattataatttcctagtgtgctaaagaggaaaagaatcctcaaatggtagaaactggagcacaatcgtgggaatataatcttgtatacaatatatcaaaaaggggggtcatcagtttatattctgatgaatgaactatttttaagttccaagtaggtgaaagacataatcttttgactcttttgtttcacatttactctacaggacataattgagtttttttcaaaaaacatggtgaatgagcacctgggaagtatctgcaatgcacatgtggttcattctgaccttagtgaccatggtgcttcagatgagaaatgtatacatctcgcagagttagcggctatagctgttgattttcctaaaaccgggaagattgtgtcgatgcctgctcacttaaaaccacaactttacccagattttatgggtaaagaggagttccagtcatacaagtcaaacaaaattctgggaagactatatcgtgatatcaaagatgcgtatgacgaagatgtctctgaatcttctgggctcaatttttgtgctagtgacatcaattatgatgcagatcttgaaattacaggatccgctgactacatagctgatgcatgggctaaaaagtgctcctatgacgggcagctgattggactacttaaacagtacaaagttaagagggaagaggaggtcgtaactggccaaatctggtccatgcccaaatatgccagtaagaaactaggggatttgaaggagaagcttggtcattcttatggttccctcaggaaagaattcagacaactttttgagaacatggattccgactttgagcagctcaatgaggatgagaagaacaagttgtatgaaagaaaggcttcagcatggtaccaggtcacttaccatcctgaatgggttcagaagacgttagagttccagaagcctgatggtgatgaaggtgttgtgatgttaagctttgcttggattgctgctgattacctagctcgaataaaagttaggcaccagggcactgaaaatcttgactttgctaagcctgtcaactctctagtaaggtacctagccgatcgaatataaccagtatttgactgttttggcagcaaattcatttgctggatccggcttcttggtcgcaaagccactctgccattttgaaagataagttgtaatgttggtttgtaatgcagtacatctctcttgttaccctattgttgctatgacctattgtgattgttcaaagatgattttccatgctttgtatgaaagtaatatttttcaattttcttgctttgcttgaatataatcatggtcttgtctcagtaaatggattagcaagtggttttggtccctccagtataaccgttgctcattgtaagttctgcttattgtgatccttcaaaggctatggatcaagaggctgccctgcctgtctcaatcattattgaccctttcttttggtcttaagtttcatttttacatgctttgttctatttaggttctttattatcgat

SEQ ID NO: 511 - DNA, 4189 bp, Gossypium raimondii
ttattagtccttgcgaattgactacccgctaccatcagaaaggtctttgcctattcatctttacgaccaaaccaccctcctttttaatgtgaatacaatctttattgtagacacatcctttaggccaccaagccctaccttaatgtaacaatcccataccataatttaaaaggaatgacaaaatgagtcccatcatgaatatctctccatgcacaccacaatgatagcctattagtagatggtttaccatattagaactatcaagcacaagacctccactatatataccccctttctcctttgtgctattaggtcctttacttacactcctcttatgctccgctcagctaggatgaaccaatcttccttaacaccaccgcatcatcctctttatcccctcccttattgatatactcataaaaaaacttatcatctaatcatcccaaaattcaatattaaattttaatcatttccctctatcttttccaaagacatgtctgattctaaacatttcgatgacgatggacgaaatggggcaaaattttataaaaaagccaaatgaagcaagtaataaaaaagtttgtgtttgtacccaaaatcggagttcaaacatttgtgtaattaatttccttttcaagagtaaagaagtgcagagtaataaaaagaaaacaaatcagtaatcggctaaaatcaaaattcatgaatcatttaaccttcagatgagggaacatttaactcaaaacatattatattaggacaaagacgaatccaatttgtgagttaaaaactggataaatattgggcctgaaatctcttggaattgacgtgctgctaaaaggtaatgatccattatttgggctcaaagtattctatatccaagtaagcaaataatagtaaaaattaatttcagaattcagatgaataagcatttgatcgaattcactgctttgacccccataccaacttatggtgcatcctggggaaaaacattaatcccaatctttatatttcttttcctttcggatttcatctttacatttccaacaacttaattaccacgccaccaaaaagaaaaataaagttcaatcgctataataaacccaattgccagtgcaatccaatcaaatcaaaggatagtaaacttcgaagtagttttcgtgcctaaaaactaaaaaacgaagtttcaacaccaaaatattggggtgctggccatatttgtctaaaggaggaataaatctacatataggcgatcaatcaatatatataatcctccttaaagaagtaggaagtgcccaatgaacaaaacttcttctcagctaagttgttttgtactgtaatgttaatcataaaggggcgtggactaaatcttttagcatcaacttgtaaaataattaatcctttaacgaagtagcttgtgtccaattataggaacttctttgccaagttttagagaaagacattaggaatcaagtcatatatatatatatagcagctagatagatggtcattttttgtgaagaactgaatagactgaattcgatcgatcctttactcggaattactaatatggccaacgaattagcatttgatctgatctatggagttggtgacgagaaggatattttcgagctttcatatgctacatttgctgaagagttgcagctccaggagatcctgaaggagtccatgatgggttctgaaaaggagctggaagatgcagctagtgaagccaaccagaaacttgagtgtcttgtcagccatggattatccaacacggaatgtgctatctcccatgtctcagagattcatgagcctcagtcgttcaataaacaggggtcagcaagatggcgtccccagcagaggtttggttacattgagcaacagaggataaactgggatgacaaaggaagagaccgtttcaggtggaggaaacctacagggtggcacaacattaggggaagaagggtgggagatgttcctcaaaccagttccaggtcagtgatttttacttatttgtaacagatggaaaaatacatattttaactaatatctgaaacattggttctccagcaaggaatttcatgcaaaaaccagttcctggggtgaaggcagtcctcttgttggcactggtaatattgaagatcctaagggtaaaggcaaagccatagatgatggctggttgctggtctccaaatggaaatccgaaagcaggggtggaaacagtgttgacaaacagcaggttgatctcgggcatcctaatcatttaaagggttcaaaagatgacgacacaagtgctgttcacgaagatgattgcgagtccttggatgatgaggatgactttgattccgatgatagtcaaaagagctacgagagtcgcaagaagagtaaatggtttaaggaattttttgagagaatggacgccttgaatgcagaggagattgatcaaaccctgtggcactgtccagcatgccaaggtggtccaggtgccatcaaatggtacagaagcattagtgacctgatagcacattccaaaaagattggatcgagaagggtgaagttacatcaagagctcgcgatgcttctagaaggggagttgtgcattaggggaacatcagtttctcctcctgctgacccaattgttggtacttggaaaggtttaaaagaggaggcaagagatcatcaagtagtttggcctcccatggttgtcattatgaacacaatgacaagcaattcaaaggatggaaaggtaaaaatgatcagaaaatcttttggtttttaatagttgaaccaatgatgctggtttctagcactgattaaattgaaaattgtaatatacattatattatctaatatgcatgcaatttacaacttctttcagtttgttggcatgggaagtcatgagcttcttgagcacttcagctcgtttcctgctttaaaggctcaacattcctatggtcctcaaggtcaccgtggtttgagcgtcttgatctttgagagctcggcggtaggttatttagaagccgaacgactgcatcagaattttttggaccaaggattggataaatttgcttggaattcttgtacaaacgaagtcctgccaggaggagagcgccaactttatggtttcatggcagtgaaagaggacctggattgcttcaaccagcattgccaaggtgctctttgtcattcatactgttaaaggttctaagtaaatgccctggatcattttaactgatttaatctcaaactaacgtgtatgagatttacacttgcttccagttcgtattctcttcaagtgattgacatgctattactattgatcaggtaaatcaaagctcaaatatgagctcaaatcatatcaagaagcggttctgaatgaaatcaagaaaatgagggaggatagccagcaacttatccggctcaaggataagcttgaagaagaaataaaacgagcaaaaactcttgaaagatcagtcgatgatctaagtaggaacctgcaacagagaatgaaggacatctgcatatttgaacgaagggtcaaatcactgcatgaagataacaaagaagaggtaataatactcttttaacaaattccacacaaaattttccttttatgcataaggttgttagctactatataatacatataggtaactgaaacttgagtggcgtaatttctcaggtggaatcccaggagatcttttataaggatcaaattaaaattctggaagcaagagtgaaagagcttgatcacaagttgaaggaatctggcgcaagtcctttacatacaggggaacctgaacctgccatgtccggcctattggaggaggagcacactccatatcagtacaacagcaacctcggcattgatgaagattcaagtttggagaatggaaagcttccaagcaaatccaatgaaaatggagattgaaaacattcaaaccaccagcttttaagactttactgcaactcataaagtaatatcagtgtaggattatatatccctgtggatgcgttgtagggttgggtgctatttgtttataagaaccaactattatttcataatttcttcatgataattacatgggtactttatgtttattaaaaaaaagtttttttgatacaatattgagggtaaggatgagaatcacatgatttaaattcgcatgttgtatcaaatggatatcca

SEQ ID NO: 512 - DNA, 4683 bp, Gossypium raimondii
tccgtctttaattgaacccaacataatttaaatttcatttcatatatttatctctatataagcatgaatgtttggagctgcatttgtcacaatgcttgcattttatgttatgtacatatttggtgtgccagactgccagctaaagtgaatttcttttttctatgaaattgtggtttggttggtgattgtatcatgatttttcaaagaccagcacgaattattgagttttactgattggaaattgattatttgtttttgttaattttgagctaatattatacaatgaaacagttttaaatggtaactcccttgcactggaattattattttttttataatatatgaagataaatgtgaaactaggtttaatttcaatgaaattaaataattgtttaaatcgtttatttagcctctaaacctaacaaatttaaactaaatatggtcacatgaaattgatgattcttgtaaaattggtattgatgattcttccaactttggaaggtttaggttaaaataatttatttagataaattaaattaattaaaataaaaggttggcttgagcttattagtcttatatattatatgatttgtagcataaataaattaaaaataatacaactttttgtaaaagaaacgtggaacagcttcaaatgattttagtttttttctttttcgtatttcatgtttgttttataattcatatttggaattagtaatcgttcctttcagcaaaattgatttcaaagtttgaatttacgttttctttttgagagtataatacatcttaccattacacttaatacttgttggaagattaatatttataagtatgaagtgtattaatatcatatataaatttgagtcgaatatgacaaaacttgatcatgaacacttcttactgtaggggtggcaatggagcgagataggagttgatgtagttagagacagatctaggaggctgagaggagccttaaccccttaaaatgaaaaattttctatttgagtattttataatttataaaattttaaattagtaatgataaaattatattttgacccccaaaaagataaaactttgatttagacctctaaaaattataaagatataaactattaaaataacaaaattaaatttttactattataaaaatgtataattaattccggcccatcccaaaatttttggacttcacctgcccctaaatcatatttctagatccgccactgaatgtagttaaatttaccactactccatagttggtgtgctttgatccaccaactacaccgctccgttataaatatgtattcttaaaaattattattactttcaaagtgttgatatatccatttctaccccacttctgctttaactttctttttaatggaaaggctccgtttaaatttaatttatgttattttaatattttcaatattttttaataaaatatttaaacataattcttcaaataatttaaacataaaacatataaattttgtgaacatattattacaagtttaccctttttaatatatataattaaaaagaaacctcatttctagtttcccttgtctacatgcatctctcatgaatcacgcgagtattgattgtgtcagcgccgtgtccgattcgtgtttgatttctttcgttccgtttcccggcgtttcagacaccggtacgagggtttccagcattagtgctttaaagattggagaatgagttcgagaaaaggaggatcaaaagggaaagaggtatctggagtctctcgtcccaaggttgaccagctaagccatggtgtagcggaaatgaacatggattcttcacaagatgatggtgagtgggaagttattcaaagaaaacccaagaatacaggtggaagcagtggtgcaaagccatggggttctcaaaattccaaccctaaaccttggaatggaggcatgcggggtaatgctggacctggaagaggcaccggcggcaatgcttgggctaatcatggtgctgattctaggatagcaagtggccgagggaattcaaggccccaaatagtcaacaagagcttggacaaccaccaagtgccttccaatcctgtcattcgcccgcctcttgagcatggttggaattggcagtcaagaactggttccaatccatccaagggttttcaagatggatatgagaaagacaatgtcaacgctgaggctgaaaaagacaacgatgttgatgatattgaggatgattcggatgatgttgctgctgatgattctgacaatgagcttctaaccgatgaatttgattcagattcaagtcaaaagagccacgagacaagaaagaaaaatagatggtttaagaagttttttgatagtttagataagttgcgcgtggaagagatcaatgacccagcaaggcaatggcattgcccggcttgccaaggcggtcctggtgccattgactggtatcgaggccttcagccattagggacacatgcgaaaactaaaggatcaaaaagggtgaaactccatcgtgaacttgctgagctcttggatgaggaattgcgtagaaggggtacttcagttatccctgcaggtgaagcttttgggaaatggaggggtttaaaagatgacgaaaaagatcatgaaatagtctggccacctatggtaatcataatgaatacaaggcttcaacaagatgataatgataaggtaccccgagaacttgtactatttctgttttccagttataattcaatggaatttaattaaatctttgtaattaccgaggagctatttatggcgttgtgtacttcagtggattggtattgggaaccaagagctgcttgactatttcagctcatatgctgccgtgaaggctcgccattcatatggcccacaggggcatcgtgggatgagccttctgatttttgagagcacagcaagaggttatttagaagctgagcgtctgcataagcattttgctgagcaaggaacggatagagaggcttgggaacaccgtcaggtcttattttatccaggtgggacgcgccaactctatggttacatggcaaacaaggaagatctggacatcttcaaccaacattctcaaggttctctcctactgaagacaatggttatttgcatgcagggataaactgcgagataactttattgcacgaaaagtttctttattattttctgccgattcttatgcatttaattcacttgtgtgtaaatgttatgttgattaggaaaatctaagctcaaatttgagatgagatcttatcaagagatggttgttaatcaaatcaggcaaatgagcgaggccaaccaggagcttattttttacaagaacaagtttgctatacagcaaaggctcaaaactgcccttgaagagtcttttggtgttgtgagcgaaaagctccggaagacaatggaggagaacaggattgtgagacagagaaccaaaatgcagcacgaacagaacaaggaagaggtaattgttttagtttctgataatttacatctaaatgcagatgcaagctagtggctttcttcacagatttgttgctagatgtaatggttgtggcgtactaattactaatttataccatagaacataacttcattttagtaagttactggttgatcatatctttgcaaccatatttatcttaactagccagggatgaatatgaaaactttgctagtatctttatatgtttgctatgcttatacatctgtgatcttatttttggatataaaaatttggtggagatgaatatgaaaattttgcatctccaaggaaaattccaggtagcatttcatttttatttagtaggaccaagcagtttagtgtggccttagaactttgagatgctttaactcgaaaaaacgtccatgtccaaaccgtctctttcagagcatgttagtgtcttcccttgaacttttccatgtacttgataaattacattctatttgctattctctagtttctgtttgatgttaactgttttgtatattgctcttcgcagatggatttccaagaacaattcttcaaggaacaaatcaaatttattcatgaagcaagggatgaggaggaggagaagtttgagaagctacagcagcaacagcgtgagaagtttgtcaagcaatctactcctaatacttcaaatacagaggaatacaggcgtaggtatgtaattttgatgctaatgtgaatttccatgtgtaatcggatcgaaacatgctaaaatgctgctacaccttccgtttatttgtttattaatttgtctacatcaatcatgagataacccatttttctttcttgtttcatttgtagggcggatgaaattgcaaaattcataaagctccaggacgaagagatggaagcttttgtgtctgagagggacaagctgattaccgtacacaaagagaagatggctgcaatgagacagaggcattggcaggaagaagttgagctcgaaaaggagtttgatacggaattgagccgtctcatggagaagtatactcctactatgcctggaatggacaaatatatatattaaaattgttttctacatagattaaatttgattaaaatatgggcgagacttctgagttcgattcaatagcatataaaacttaatattataataatataatactaaaatataaacattaaaaatatccgttg

SEQ ID NO: 513 - DNA, 4649 bp, Gossypium raimondii
tccgtctttaattgaacccaacataatttaaatttcatttcatatatttatctctatataagcatgaatgtttggagctgcatttgtcacaatgcttgcattttatgttatgtacatatttggtgtgccagactgccagctaaagtgaatttcttttttctatgaaattgtggtttggttggtgattgtatcatgatttttcaaagaccagcacgaattattgagttttactgattggaaattgattatttgtttttgttaattttgagctaatattatacaatgaaacagttttaaatggtaactcccttgcactggaattattattttttttataatatatgaagataaatgtgaaactaggtttaatttcaatgaaattaaataattgtttaaatcgtttatttagcctctaaacctaacaaatttaaactaaatatggtcacatgaaattgatgattcttgtaaaattggtattgatgattcttccaactttggaaggtttaggttaaaataatttatttagataaattaaattaattaaaataaaaggttggcttgagcttattagtcttatatattatatgatttgtagcataaataaattaaaaataatacaactttttgtaaaagaaacgtggaacagcttcaaatgattttagtttttttctttttcgtatttcatgtttgttttataattcatatttggaattagtaatcgttcctttcagcaaaattgatttcaaagtttgaatttacgttttctttttgagagtataatacatcttaccattacacttaatacttgttggaagattaatatttataagtatgaagtgtattaatatcatatataaatttgagtcgaatatgacaaaacttgatcatgaacacttcttactgtaggggtggcaatggagcgagataggagttgatgtagttagagacagatctaggaggctgagaggagccttaaccccttaaaatgaaaaattttctatttgagtattttataatttataaaattttaaattagtaatgataaaattatattttgacccccaaaaagataaaactttgatttagacctctaaaaattataaagatataaactattaaaataacaaaattaaatttttactattataaaaatgtataattaattccggcccatcccaaaatttttggacttcacctgcccctaaatcatatttctagatccgccactgaatgtagttaaatttaccactactccatagttggtgtgctttgatccaccaactacaccgctccgttataaatatgtattcttaaaaattattattactttcaaagtgttgatatatccatttctaccccacttctgctttaactttctttttaatggaaaggctccgtttaaatttaatttatgttattttaatattttcaatattttttaataaaatatttaaacataattcttcaaataatttaaacataaaacatataaattttgtgaacatattattacaagtttaccctttttaatatatataattaaaaagaaacctcatttctagtttcccttgtctacatgcatctctcatgaatcacgcgagtattgattgtgtcagcgccgtgtccgattcgtgtttgatttctttcgttccgtttcccggcgtttcagacaccggtacgagggtttccagcattagtgctttaaagattggagaatgagttcgagaaaaggaggatcaaaagggaaagaggtatctggagtctctcgtcccaaggttgaccagctaagccatggtgtagcggaaatgaacatggattcttcacaagatgatggtgagtgggaagttattcaaagaaaacccaagaatacaggtggaagcagtggtgcaaagccatggggttctcaaaattccaaccctaaaccttggaatggaggcatgcggggtaatgctggacctggaagaggcaccggcggcaatgcttgggctaatcatggtgctgattctaggatagcaagtggccgagggaattcaaggccccaaatagtcaacaagagcttggacaaccaccaagtgccttccaatcctgtcattcgcccgcctcttgagcatggttggaattggcagtcaagaactggttccaatccatccaagggttttcaagatggatatgagaaagacaatgtcaacgctgaggctgaaaaagacaacgatgttgatgatattgaggatgattcggatgatgttgctgctgatgattctgacaatgagcttctaaccgatgaatttgattcagattcaagtcaaaagagccacgagacaagaaagaaaaatagatggtttaagaagttttttgatagtttagataagttgcgcgtggaagagatcaatgacccagcaaggcaatggcattgcccggcttgccaaggcggtcctggtgccattgactggtatcgaggccttcagccattagggacacatgcgaaaactaaaggatcaaaaagggtgaaactccatcgtgaacttgctgagctcttggatgaggaattgcgtagaaggggtacttcagttatccctgcaggtgaagcttttgggaaatggaggggtttaaaagatgacgaaaaagatcatgaaatagtctggccacctatggtaatcataatgaatacaaggcttcaacaagatgataatgataaggtaccccgagaacttgtactatttctgttttccagttataattcaatggaatttaattaaatctttgtaattaccgaggagctatttatggcgttgtgtacttcagtggattggtattgggaaccaagagctgcttgactatttcagctcatatgctgccgtgaaggctcgccattcatatggcccacaggggcatcgtgggatgagccttctgatttttgagagcacagcaagaggttatttagaagctgagcgtctgcataagcattttgctgagcaaggaacggatagagaggcttgggaacaccgtcaggtcttattttatccaggtgggacgcgccaactctatggttacatggcaaacaaggaagatctggacatcttcaaccaacattctcaaggttctctcctactgaagacaatggttatttgcatgcagggataaactgcgagataactttattgcacgaaaagtttctttattattttctgccgattcttatgcatttaattcacttgtgtgtaaatgttatgttgattaggaaaatctaagctcaaatttgagatgagatcttatcaagagatggttgttaatcaaatcaggcaaatgagcgaggccaaccaggagcttattttttacaagaacaagtttgctatacagcaaaggctcaaaactgcccttgaagagtcttttggtgttgtgagcgaaaagctccggaagacaatggaggagaacaggattgtgagacagagaaccaaaatgcagcacgaacagaacaaggaagaggtaattgttttagtttctgataatttacatctaaatgcagatgcaagctagtggctttcttcacagatttgttgctagatgtaatggttgtggcgtactaattactaatttataccatagaacataacttcattttagtaagttactggttgatcatatctttgcaaccatatttatcttaactagccagggatgaatatgaaaactttgctagtatctttatatgtttgctatgcttatacatctgtgatcttatttttggatataaaaatttggtggagatgaatatgaaaattttgcatctccaaggaaaattccaggtagcatttcatttttatttagtaggaccaagcagtttagtgtggccttagaactttgagatgctttaactcgaaaaaacgtccatgtccaaaccgtctctttcagagcatgttagtgtcttcccttgaacttttccatgtacttgataaattacattctatttgctattctctagtttctgtttgatgttaactgttttgtatattgctcttcgcagatggatttccaagaacaattcttcaaggaacaaatcaaatttattcatgaagcaagggatgaggaggaggagaagtttgagaagctacagcagcaacagcgtgagaagtttgtcaagcaatctactcctaatacttcaaatacagaggaatacaggcgtaggtatgtaattttgatgctaatgtgaatttccatgtgtaatcggatcgaaacatgctaaaatgctgctacaccttccgtttatttgtttattaatttgtctacatcaatcatgagataacccatttttctttcttgtttcatttgtagggcggatgaaattgcaaaattcataaagctccaggacgaagagatggaagcttttgtgtctgagagggacaagctgattaccgtacacaaagagaagatggctgcaatgagacagaggcattggcaggaagaagttgagctcgaaaaggagtttgatacggaattgagccgtctcatggagaagtatactcctactatgcctggaatggacaaatatatatattaaaattgttttctacatagattaaatttgattaaaatatgggcgagacttctgagttcgattcaatagcatataaaacttaatattataataatat

SEQ ID NO: 514 - DNA, 3755 bp, Gossypium raimondii
tccgtctttaattgaacccaacataatttaaatttcatttcatatatttatctctatataagcatgaatgtttggagctgcatttgtcacaatgcttgcattttatgttatgtacatatttggtgtgccagactgccagctaaagtgaatttcttttttctatgaaattgtggtttggttggtgattgtatcatgatttttcaaagaccagcacgaattattgagttttactgattggaaattgattatttgtttttgttaattttgagctaatattatacaatgaaacagttttaaatggtaactcccttgcactggaattattattttttttataatatatgaagataaatgtgaaactaggtttaatttcaatgaaattaaataattgtttaaatcgtttatttagcctctaaacctaacaaatttaaactaaatatggtcacatgaaattgatgattcttgtaaaattggtattgatgattcttccaactttggaaggtttaggttaaaataatttatttagataaattaaattaattaaaataaaaggttggcttgagcttattagtcttatatattatatgatttgtagcataaataaattaaaaataatacaactttttgtaaaagaaacgtggaacagcttcaaatgattttagtttttttctttttcgtatttcatgtttgttttataattcatatttggaattagtaatcgttcctttcagcaaaattgatttcaaagtttgaatttacgttttctttttgagagtataatacatcttaccattacacttaatacttgttggaagattaatatttataagtatgaagtgtattaatatcatatataaatttgagtcgaatatgacaaaacttgatcatgaacacttcttactgtaggggtggcaatggagcgagataggagttgatgtagttagagacagatctaggaggctgagaggagccttaaccccttaaaatgaaaaattttctatttgagtattttataatttataaaattttaaattagtaatgataaaattatattttgacccccaaaaagataaaactttgatttagacctctaaaaattataaagatataaactattaaaataacaaaattaaatttttactattataaaaatgtataattaattccggcccatcccaaaatttttggacttcacctgcccctaaatcatatttctagatccgccactgaatgtagttaaatttaccactactccatagttggtgtgctttgatccaccaactacaccgctccgttataaatatgtattcttaaaaattattattactttcaaagtgttgatatatccatttctaccccacttctgctttaactttctttttaatggaaaggctccgtttaaatttaatttatgttattttaatattttcaatattttttaataaaatatttaaacataattcttcaaataatttaaacataaaacatataaattttgtgaacatattattacaagtttaccctttttaatatatataattaaaaagaaacctcatttctagtttcccttgtctacatgcatctctcatgaatcacgcgagtattgattgtgtcagcgccgtgtccgattcgtgtttgatttctttcgttccgtttcccggcgtttcagacaccggtacgagggtttccagcattagtgctttaaagattggagaatgagttcgagaaaaggaggatcaaaagggaaagaggtatctggagtctctcgtcccaaggttgaccagctaagccatggtgtagcggaaatgaacatggattcttcacaagatgatggtgagtgggaagttattcaaagaaaacccaagaatacaggtggaagcagtggtgcaaagccatggggttctcaaaattccaaccctaaaccttggaatggaggcatgcggggtaatgctggacctggaagaggcaccggcggcaatgcttgggctaatcatggtgctgattctaggatagcaagtggccgagggaattcaaggccccaaatagtcaacaagagcttggacaaccaccaagtgccttccaatcctgtcattcgcccgcctcttgagcatggttggaattggcagtcaagaactggttccaatccatccaagggttttcaagatggatatgagaaagacaatgtcaacgctgaggctgaaaaagacaacgatgttgatgatattgaggatgattcggatgatgttgctgctgatgattctgacaatgagcttctaaccgatgaatttgattcagattcaagtcaaaagagccacgagacaagaaagaaaaatagatggtttaagaagttttttgatagtttagataagttgcgcgtggaagagatcaatgacccagcaaggcaatggcattgcccggcttgccaaggcggtcctggtgccattgactggtatcgaggccttcagccattagggacacatgcgaaaactaaaggatcaaaaagggtgaaactccatcgtgaacttgctgagctcttggatgaggaattgcgtagaaggggtacttcagttatccctgcaggtgaagcttttgggaaatggaggggtttaaaagatgacgaaaaagatcatgaaatagtctggccacctatggtaatcataatgaatacaaggcttcaacaagatgataatgataaggtaccccgagaacttgtactatttctgttttccagttataattcaatggaatttaattaaatctttgtaattaccgaggagctatttatggcgttgtgtacttcagtggattggtattgggaaccaagagctgcttgactatttcagctcatatgctgccgtgaaggctcgccattcatatggcccacaggggcatcgtgggatgagccttctgatttttgagagcacagcaagaggttatttagaagctgagcgtctgcataagcattttgctgagcaaggaacggatagagaggcttgggaacaccgtcaggtcttattttatccaggtgggacgcgccaactctatggttacatggcaaacaaggaagatctggacatcttcaaccaacattctcaaggttctctcctactgaagacaatggttatttgcatgcagggataaactgcgagataactttattgcacgaaaagtttctttattattttctgccgattcttatgcatttaattcacttgtgtgtaaatgttatgttgattaggaaaatctaagctcaaatttgagatgagatcttatcaagagatggttgttaatcaaatcaggcaaatgagcgaggccaaccaggagcttattttttacaagaacaagtttgctatacagcaaaggctcaaaactgcccttgaagagtcttttggtgttgtgagcgaaaagctccggaagacaatggaggagaacaggattgtgagacagagaaccaaaatgcagcacgaacagaacaaggaagaggtaattgttttagtttctgataatttacatctaaatgcagatgcaagctagtggctttcttcacagatttgttgctagatgtaatggttgtggcgtactaattactaatttataccatagaacataacttcattttagtaagttactggttgatcatatctttgcaaccatatttatcttaactagccagggatgaatatgaaaactttgctagtatctttatatgtttgctatgcttatacatctgtgatcttatttttggatataaaaat

SEQ ID NO: 515 - DNA, 6479 bp, Gossypium raimondii
aattatatatttatttaaatttttcaatacataaagtacgattatttttgtagtcttaattcaattagcatgaacattgttcccaatacaagaggacgtgagttcgagtatttatgggttgaggagggggtatagatagttctagacattgtatcaaaaacaaatataattagaacttataatgaaattattaaaaaaagaaaaaccattagttttacctattaattgaatattcaaatgactagtcaatttatggctcaatccacattttgttttctctttcttctttaacaaaagtttgatcctataatttataaatctcaaattcaacacaacacaagtctgtgtttaagtttgaataagaatgattaaatttaaaatattataccttagattcaatcatattctaaataaattaaattatgtaattttttttattttgaaatactcacaacgtgagtaaaaaatataattatttaattttaaatgatatatagttcgttgacatggttgttattgtagtaattagaaagacgcgctttctagcgcatttaagtatgtatcttcttttgcttttaaatttgagatgtttgtagttaaatgtttaagtaagcaatatatataaaaggaataaggttacatttggtacttatactttcatagaatgtttaatgtaatatttgtactttgaaaatgtttaatgtgatacttgaactatcaatgtgtatttcatcattgttcttgtactttaataaaatgtctaatgtggtatccgaactatcaatatgtgctttgtgtcatatttgttgcaaagatggcacgggagtccaagggtcatacacttgaagaaatacaagcatcacttactacttctccgtagtcagaaccaagtgtaatgagttactttcctgtactaattattatggtacatggtgttaacaacattagtgaattgttaaataaaataataaaaaattgacacataatttcttttcccaaatcataagtccttacggacaatataaaaattatatggaaaactaaataaaaaaattaaagtaaattaaccatgtttagctctttgcttttaatttaatttaattctttttttatctagtttttaacgtaatgttatattatctacgagtaaatgatgatttgaaaaaaaagttacgtgtcgaatttatattggttggtttaacaattcactaacgatattaacgtcaaatactataataaaacatatattgatggtttagaaattacataggagaatttcaaagtagaggtactacattagacattttatgaaagtataagtaatgtaataaaatacatagtgatggttcaagtaccacattagacaatttttaaagtacaagtatcaaattgaatattttagaaaattacagataccaaatatgatattaccctagataacagaaattcctcgcgaggagttttatattaggtaagcttaattagttaagatatccccattctcaacaatgcgcgtgcaacacaaatctccttcttgcactcagctatttttatggtcctcactctccattcacttctacaccactgccttttctctgcaggtatctccttctctctcgtggctcttacgattatcaggtaaaaatacccattattctttgatttctcttaaaagttatagtgcttttaatctatttttctattttaaagtgtttttcttttttaattttttaatctctcgccatgcatggctttattgttcttcccagtttcataaaaaaaaaaaaatagagaacgttatttcacgttatgattttgttttttaatgtattgtttatcaattacttgtgcaaatgtgtacgttatgtagtctgatggattccagttattcgcattgttatattctgtaatcttacactttgaattggtgctttattattattttttaaaattttattttcaagttttaagctttttgagaagatctcttaaaacccatatagtgaaccccaaagtgattgctgaaatatgggttttactcatttataattgttttaatctgcaacggttaatttgttgcttgtccttgcttatgatcagctacaaagagatttattgagataggtttaatcttggtaagaacaaaagatacatttatcctggggagattattcagtttttactgtacaattggcctatttggattccacattggtattttatttttgttttaagtgcttaaagaatccttgccttttgctatgatgggatacaaaaggaaggatttttctgaggaattcttacagttgggacgttttattgataagcaaatgggcggtatttataggtcgttaggtcgttaactcgtcgccaacttgtcatattagttttggttataacataggcttttttgattgtggcatcgaatatgaaaattgaccaatcttttcattcaaacagtgatctaggactagaaagcgtttgaaagatcttaatggcagatgctactgattcatttcctgacttgcggagtgtgtataaaagttctggtcaccaagttaatcgcctaagtcagaatgtggcaaacatgaagctagcttctgcgcaagatggtgaaaaggagaactcattgggatccaataacaaaggtgctgaaaatgttgggtttcctcaagattctacccctaatgtatggggacatccgaatgtgattcagaaacttaggatgcaaggtaatcttggttcagaaaaggttactcacaaagcctggccaactcaaaatgctgtttctaggacgcaacaaggtgatagaacatggggaaatagtagtataaaatctccatcctcagagtatggaaggaatgaccctgatcaagctggttttactttctctaataattcttgggatggtcaaattaaaaccgaccatgaagtgggtgataagttggatgatgaaattggagataatgaaaatgttgatgatgaatatggtaatggtgtctctaatattgagtacgatagtgatgatatcgatgattatgtttccggttcagatgaagatgagaagagccatgaagcacgcaaggagagcaagtggttctattttttttttgaaagtttagagaaactgacagttgaggagattctttctccggttcggcggtggcactgtccagcatgtcaaggtgggccaggagccatcaactggtaccgaggtgtgcaacccttattgactcattccatgactaaaacaacacggagagctaagctgcatcgtgtatttgctggacttttggttgaggagatgcgcaggagaggagctttcattaaaccagtcaatgatgcatttggcaggtgggaagggctgactgatagagttgcagatcacgagatagtttggcctccaatggttatcattatgaatacaagatatgaacaggatgaaaacggcaaggtactatatggctatcatctttgttttcagagatcttattttccttattttcccctggtttcaagcaaaatgttaccactttttcagtaaaatatcttgtaaaagaaaacccaagaaaatgctacgtagcatttattgcttttttggtaaaatatctcttgtactcttgtattaatatactcttaatatctcttgtatcatttcatcagtggattggaatgggaaatcaagaacttctcaattacttcagctcgtatgctgcagtaaaagcaagacactcatatggtccacaagggcatcgggggatgagtcttctgatctttgagagctcagcagcgggatatttagagactgcacgcctgcataagcattttaaggagcaagggagggatagggatgcttgggattgttcacgggttccattctgtccaggtggcaagcgccaactctatggctacattgccatgaaagaagatctggatttatttaaccagcactctcaaggtcaaatcactctctctcctctcaaaatatcgtgtctatgtgtatacacttgtgcttgcatgtgctagataaagaaataaaaggaactccatagtagcaaggaattgaatgcctatacctttataatttttaaaggattaaatcacatttttatcattttttttgggggggtggggggtgggagtaactttgctatttgctaatgggaatattatttaatttgttaatataaaattttcaacttttggtgccattgcaaacttaaaaagatgatttgtagttcctttttcttttggcttctttgcaaagttttgattactttgatagtcacagccttacttgattatggagacaggaggtaatcctcaaaaacaactcttaccagttcgtgacagtttgttcttgtttaggataaagcgacattgccttaaattatactcttactttagtaagagaagtagttaaaacatgcatttaaatttgccgaattggctggtgttttgtttctataatttgttttaaaatttaaatatttccttttcttgaaagaaaaaatttaatgaatgattgatggtggaagatgcataatttaatctgtattggcaatgtagtttcctttttcagtcatgtttgatactctatgcgatcaagcaggaaagtccaagctgaaatttgagacgaggtcatatcaagagatggttgagagtcagataaagaagataaatgatgatagtcagcagcttaacctacttaaaaagaaggttgctcaagagcagcagcactcacaagtccttgcagagtctctaggacgattgagtgagaagctgcgccagacgacagaggaatatggtatcatgaggcagcaaactagattgcagcatgagcagaacaaagaagaggtagcatttttaaaactttgtattcctttacttttattgccaatcatggttgccaagttaggacaagaagggtgccctgggaccaccttctccatgtttcactatttggtaaaatggtgatcatactcagtggatgctattactgttgtcatgttgtttcttaataacttgtagggaggctgaacttaaggtaaatctaagaagtcagttcagaggcatgcttgtgcttgacattgaatcttctccatgttttataagtatatttaagttgacatcgaatcttctaatttgttatctcaatgcattgatttgcagttgggcgccaaagaacagtattttaaggagaaaattaatgttatttaccaagccataaagttgaaggaagataattttgagaagctgcagagggcagcgagggagagagttgagcggtcaaatgcaactctgataaataatgaagatcagcacaggtaacagttatgattcaaaatatctcgttttgtcacacatgacctacttcatgctgtaatgaagatttttcttttctgagatggaatgtctatacgatctgactaccttgagaaggtttttgttttctgctgacttgatactgctctgtccatcaaataaaatatctgtctctttatttttcctttaagtttctgtgtttgtcttatgcatatttagacataaaatgaggtatgatctttcgaacatatgcaaaacttagaaaaagattatttctataccagttttagatgcctactatataggactctaaacctccgaccgtgggtaattcaaggtcacttgctgctactagggtcttgttttgttgaaactgaaacttgttgactttatactgtaattatgatctgataatagttttcaacaaaatttgaacattcagtgctactgagttggaggaaaactcaaggtccataacaatccaggagaagaagatggaggaattcgaggcagagagggagaagctaatgaaaagtcatcaagatggaagattggcaatcacacagcggtactgggaagagctgattgagcttgaggaagggtttgaaaaagaattgaccctgcttatgggaaagtacaaccccgatcgcctcgaggaagagactactgacagccttgaaggacgagacaagagaggagcaagagatattgaaacagaatagacaacaatgatcctatttgtcgagggtaagaagcagcatattatgttttgggtaaaaggtatacaccagttttattaccaaagatacttcagttttggatatagagggctaaaagtgaagcctttctggatcggtacaaacattggaataatgaaacttcaagtgctttattattattattgaacatacatagctgaggattcttttgtgtttaagctgtcttgcaatgacaatttttgcagtggcatatatgtttgatgattcgatgtctgaatttccatgcaaaaagaaaacatttttgtttgctaagaaatcgacaaaaaaattggggtttctgcagatttgctctctctctctctctaatattttttcaacaagttaactaaatatagaaattgggttttgtccatgcagaaaacctgctaatattgt

SEQ ID NO: 516 - DNA, 6292 bp, Gossypium raimondii
gacgtgagttcgagtatttatgggttgaggagggggtatagatagttctagacattgtatcaaaaacaaatataattagaacttataatgaaattattaaaaaaagaaaaaccattagttttacctattaattgaatattcaaatgactagtcaatttatggctcaatccacattttgttttctctttcttctttaacaaaagtttgatcctataatttataaatctcaaattcaacacaacacaagtctgtgtttaagtttgaataagaatgattaaatttaaaatattataccttagattcaatcatattctaaataaattaaattatgtaattttttttattttgaaatactcacaacgtgagtaaaaaatataattatttaattttaaatgatatatagttcgttgacatggttgttattgtagtaattagaaagacgcgctttctagcgcatttaagtatgtatcttcttttgcttttaaatttgagatgtttgtagttaaatgtttaagtaagcaatatatataaaaggaataaggttacatttggtacttatactttcatagaatgtttaatgtaatatttgtactttgaaaatgtttaatgtgatacttgaactatcaatgtgtatttcatcattgttcttgtactttaataaaatgtctaatgtggtatccgaactatcaatatgtgctttgtgtcatatttgttgcaaagatggcacgggagtccaagggtcatacacttgaagaaatacaagcatcacttactacttctccgtagtcagaaccaagtgtaatgagttactttcctgtactaattattatggtacatggtgttaacaacattagtgaattgttaaataaaataataaaaaattgacacataatttcttttcccaaatcataagtccttacggacaatataaaaattatatggaaaactaaataaaaaaattaaagtaaattaaccatgtttagctctttgcttttaatttaatttaattctttttttatctagtttttaacgtaatgttatattatctacgagtaaatgatgatttgaaaaaaaagttacgtgtcgaatttatattggttggtttaacaattcactaacgatattaacgtcaaatactataataaaacatatattgatggtttagaaattacataggagaatttcaaagtagaggtactacattagacattttatgaaagtataagtaatgtaataaaatacatagtgatggttcaagtaccacattagacaatttttaaagtacaagtatcaaattgaatattttagaaaattacagataccaaatatgatattaccctagataacagaaattcctcgcgaggagttttatattaggtaagcttaattagttaagatatccccattctcaacaatgcgcgtgcaacacaaatctccttcttgcactcagctatttttatggtcctcactctccattcacttctacaccactgccttttctctgcaggtatctccttctctctcgtggctcttacgattatcaggtaaaaatacccattattctttgatttctcttaaaagttatagtgcttttaatctatttttctattttaaagtgtttttcttttttaattttttaatctctcgccatgcatggctttattgttcttcccagtttcataaaaaaaaaaaaatagagaacgttatttcacgttatgattttgttttttaatgtattgtttatcaattacttgtgcaaatgtgtacgttatgtagtctgatggattccagttattcgcattgttatattctgtaatcttacactttgaattggtgctttattattattttttaaaattttattttcaagttttaagctttttgagaagatctcttaaaacccatatagtgaaccccaaagtgattgctgaaatatgggttttactcatttataattgttttaatctgcaacggttaatttgttgcttgtccttgcttatgatcagctacaaagagatttattgagataggtttaatcttggtaagaacaaaagatacatttatcctggggagattattcagtttttactgtacaattggcctatttggattccacattggtattttatttttgttttaagtgcttaaagaatccttgccttttgctatgatgggatacaaaaggaaggatttttctgaggaattcttacagttgggacgttttattgataagcaaatgggcggtatttataggtcgttaggtcgttaactcgtcgccaacttgtcatattagttttggttataacataggcttttttgattgtggcatcgaatatgaaaattgaccaatcttttcattcaaacagtgatctaggactagaaagcgtttgaaagatcttaatggcagatgctactgattcatttcctgacttgcggagtgtgtataaaagttctggtcaccaagttaatcgcctaagtcagaatgtggcaaacatgaagctagcttctgcgcaagatggtgaaaaggagaactcattgggatccaataacaaaggtgctgaaaatgttgggtttcctcaagattctacccctaatgtatggggacatccgaatgtgattcagaaacttaggatgcaaggtaatcttggttcagaaaaggttactcacaaagcctggccaactcaaaatgctgtttctaggacgcaacaaggtgatagaacatggggaaatagtagtataaaatctccatcctcagagtatggaaggaatgaccctgatcaagctggttttactttctctaataattcttgggatggtcaaattaaaaccgaccatgaagtgggtgataagttggatgatgaaattggagataatgaaaatgttgatgatgaatatggtaatggtgtctctaatattgagtacgatagtgatgatatcgatgattatgtttccggttcagatgaagatgagaagagccatgaagcacgcaaggagagcaagtggttctattttttttttgaaagtttagagaaactgacagttgaggagattctttctccggttcggcggtggcactgtccagcatgtcaaggtgggccaggagccatcaactggtaccgaggtgtgcaacccttattgactcattccatgactaaaacaacacggagagctaagctgcatcgtgtatttgctggacttttggttgaggagatgcgcaggagaggagctttcattaaaccagtcaatgatgcatttggcaggtgggaagggctgactgatagagttgcagatcacgagatagtttggcctccaatggttatcattatgaatacaagatatgaacaggatgaaaacggcaaggtactatatggctatcatctttgttttcagagatcttattttccttattttcccctggtttcaagcaaaatgttaccactttttcagtaaaatatcttgtaaaagaaaacccaagaaaatgctacgtagcatttattgcttttttggtaaaatatctcttgtactcttgtattaatatactcttaatatctcttgtatcatttcatcagtggattggaatgggaaatcaagaacttctcaattacttcagctcgtatgctgcagtaaaagcaagacactcatatggtccacaagggcatcgggggatgagtcttctgatctttgagagctcagcagcgggatatttagagactgcacgcctgcataagcattttaaggagcaagggagggatagggatgcttgggattgttcacgggttccattctgtccaggtggcaagcgccaactctatggctacattgccatgaaagaagatctggatttatttaaccagcactctcaaggtcaaatcactctctctcctctcaaaatatcgtgtctatgtgtatacacttgtgcttgcatgtgctagataaagaaataaaaggaactccatagtagcaaggaattgaatgcctatacctttataatttttaaaggattaaatcacatttttatcattttttttgggggggtggggggtgggagtaactttgctatttgctaatgggaatattatttaatttgttaatataaaattttcaacttttggtgccattgcaaacttaaaaagatgatttgtagttcctttttcttttggcttctttgcaaagttttgattactttgatagtcacagccttacttgattatggagacaggaggtaatcctcaaaaacaactcttaccagttcgtgacagtttgttcttgtttaggataaagcgacattgccttaaattatactcttactttagtaagagaagtagttaaaacatgcatttaaatttgccgaattggctggtgttttgtttctataatttgttttaaaatttaaatatttccttttcttgaaagaaaaaatttaatgaatgattgatggtggaagatgcataatttaatctgtattggcaatgtagtttcctttttcagtcatgtttgatactctatgcgatcaagcaggaaagtccaagctgaaatttgagacgaggtcatatcaagagatggttgagagtcagataaagaagataaatgatgatagtcagcagcttaacctacttaaaaagaaggttgctcaagagcagcagcactcacaagtccttgcagagtctctaggacgattgagtgagaagctgcgccagacgacagaggaatatggtatcatgaggcagcaaactagattgcagcatgagcagaacaaagaagaggtagcatttttaaaactttgtattcctttacttttattgccaatcatggttgccaagttaggacaagaagggtgccctgggaccaccttctccatgtttcactatttggtaaaatggtgatcatactcagtggatgctattactgttgtcatgttgtttcttaataacttgtagggaggctgaacttaaggtaaatctaagaagtcagttcagaggcatgcttgtgcttgacattgaatcttctccatgttttataagtatatttaagttgacatcgaatcttctaatttgttatctcaatgcattgatttgcagttgggcgccaaagaacagtattttaaggagaaaattaatgttatttaccaagccataaagttgaaggaagataattttgagaagctgcagagggcagcgagggagagagttgagcggtcaaatgcaactctgataaataatgaagatcagcacaggtaacagttatgattcaaaatatctcgttttgtcacacatgacctacttcatgctgtaatgaagatttttcttttctgagatggaatgtctatacgatctgactaccttgagaaggtttttgttttctgctgacttgatactgctctgtccatcaaataaaatatctgtctctttatttttcctttaagtttctgtgtttgtcttatgcatatttagacataaaatgaggtatgatctttcgaacatatgcaaaacttagaaaaagattatttctataccagttttagatgcctactatataggactctaaacctccgaccgtgggtaattcaaggtcacttgctgctactagggtcttgttttgttgaaactgaaacttgttgactttatactgtaattatgatctgataatagttttcaacaaaatttgaacattcagtgctactgagttggaggaaaactcaaggtccataacaatccaggagaagaagatggaggaattcgaggcagagagggagaagctaatgaaaagtcatcaagatggaagattggcaatcacacagcggtactgggaagagctgattgagcttgaggaagggtttgaaaaagaattgaccctgcttatgggaaagtacaaccccgatcgcctcgaggaagagactactgacagccttgaaggacgagacaagagaggagcaagagatattgaaacagaatagacaacaatgatcctatttgtcgagggtaagaagcagcatattatgttttgggtaaaaggtatacaccagttttattaccaaagatacttcagttttggatatagagggctaaaagtgaagcctttctggatcggtacaaacattggaataatgaaacttcaagtgctttattattattattgaacatacatagctgaggattcttttgtgtttaagctgtcttgcaatgacaatttttgcagtggcatatatgtttgatgattcgatgtctgaatttccatgcaaaaagaaaacatttttgtttgctaagaaatcgacaaaaaaattggggtttctgca

SEQ ID NO: 517 - DNA, 4171 bp, Gossypium raimondii
ttaaattttatattgtatatatcataatattaatattttattatcaatgttctttaaaaaaatattgaaaaaaatagaaaataaagaaagtgaaaaaagcgggcatgcaatggactatctacgtggaagtaaatctgcgatatttatgtacttacagtcgtgaaaagggtccccattctcgactcagtggggggacgcggccgtctggtcatttccatcactcacaacgcgcgtgcgtctcacatcccttcttccatgattaatgatttctgagtttctcatttttagactctctcttgttctccacaggcacctgttctttttttttttcgctcttcaaactctatcctggtaaaaatacccaccttttttgttttggtaaaaagcatgtcttttgttaaatgttaatgtattcttccatgagagtttcaaagagaataaagagttgtttttacgtgatgatctcatgttcttaatggttgaaacttgaaatctttgtttgttttgcacatgaattgtttgtataaatgcatgtgttgatgtcatttgattggcttttgagttattcaaacaggatgaataaacggaggtattgttcttctttttttcggctgaataacttgtttattttcgtattttatgcattggaaaacgttacgttttgaaaagatcttacttttttccttattatatgcaagttttatgtttcttttttgagtactgatttacaattgttttaaattaaatctgccatagctactttgctgcttgttcttgctcatgattggctaaaagaaagataggtgggtttcgatttaaatcttactggtaagattccatgtaaattggaagtagctagctgattgatcctagagagaattatccaattcatttgatttcaaaacggtattgtttgaagtgcttaccatttgcatatatatatatatatatatatatttacaaataagttatcatttatttccgttttatctatttataatttttttagattcgtaactactcttctcaatatcaacatgtcgtgcaatccactatttacattttaagatccatattatatgttttgtttcatagattttctttctttaattatgacgcataaccttgacgttcaaaatataattttgaataatctaattcaattattcaaccatttcattatatcaaattttatattaatcgtattaattgatatttatatatttcggtacaataacaatatgttatttgtaacactagtcttattagtcagttaattgatcatattttgttcatgaaaaggggtttgattggtattagtgtggatacaacaaaatattaccgatctaataagcatcttgtattagaacttagaaaggaattaatcttatatgatatgaaattttgactattcatgagtgtgctcaatatggatataccccacagtgatccttggtagtaaataattttagctgatggaaaatcgtagcattttgttttgttcttccttggaaaagaagagtaacgtttggtctagtacttttaatgttgggacgttttactgtggaaattaaaaccacatggatagcttttatgcatcattaatccctcaacaactgagcatatatgtgatatttcttgtatatgtactgatataactaagcttcttgttgtaagaaaatcaccaatcttttcattcaatacagtgatctaggagtagatttcatggcagatgctactgacccatttcctgacttgggaagcgtgtataaagtttccggtcgttgtcaagtaaaccgggatgtagctgacatcaagcttgcttcttcagtggatggaagggagtctaaaaaccgagttgctgcaaattccgggttacataaagattctacatctaatgtatggggacatccaaatttgattcagaaacttaagatgcaaactacttccaatgtcaggccaactgtggatggttcttgtttgagttcgagaagacatggtagtgcatcgacccaacaaggtgctggaacttgccctgttcaagctggtttcactttgcctaacagttcagaaaatagagttgatgaatatgataacaatgaccctgatgttgtgtatgataacgatgatttggatgactatgacttcgattttgatgaagacgagaagagtcatgaagcacgcaagaagagcaaatggttcaatgcattctttgaacgtttagagaaattgactgttgaggagatcatttcaccagctcagcaatggcactgccctgcatgtcaaggtggaccgggagccattgattggtatcgaggtgtacagcctctaatgactcattccatgactaaaatgacacggagagctaagatgcatcgtgtattcgcggaacttttggtcgaggagatgcgtaggagaggaactttcattaaaccggccaacgatgctgttggcaaatgggaagggcttaatgttagagttgcagatcatgaaatagtttggccaccaatggttatcattatgaatacaaaatatgaacaggacgaaaccggcaaggtactttactgctcttggatagtaaactatctctattactaatatactgctaattgctttgtactgactgttatttcattagtggagtgggatgggaaatcaagagcttctcaattacttcagctcatatgctgcgataaaagcgagacattcgtatggtccacaaggtcaccgcgggatgagtgtgttgatctttgagagttcagcagcagggtatttagaggctgttcgtttgcataaacattttaaagaacaaggaagggatagggatgcttgggatcattcacaggtcccattctgtcctggtggaaaacgccaactttacggctacattgccatcaaagaagacttggatgtatttaaccgacactctcaaggtctaatacgctgcaatcacttttgttaaatcgttgtttttgaacttttcttgtgaatgatacaatctatgcgatcaaacagggaattccaagctgaaattcgagctgagatcataccaagagatggttgagagccaaataaagaagataaacgacaatagtcagcaacttacccgacttaaaaagaaggttgctcaagaacagcaacattcacaagtccttgcagagtctctaggccgattgagtgagaagctccaccagacaatagagccgaaaaatcatatcgtgaggcaacgagctatattgcagcatgaacagaacaaagaagaggtagcattttttaactttattgctgcaatttcagtgttctatagctagatatctcttccttattgcaatgcaatggttttccagttgatagctaaagaacaatatttcaaggagaaaatcaatactatttaccaatccatagactgtaaggaagataatttcgagaagctgcaaagggctgcaagtgagagagttaagcaatcaaatatgaatccgatacatgataaagatgaatgcaggtgacattctatctacttaaagctgtaacaacatttattttcttgttctatgttgtgaagagaatttttaacatgtttttgaatgttcagtgccattgagcttcatgagaaaaacataggagagttcaatgcagagagggagaagctgatgaaaagtcgtcaagatagaaggttaacaatcacactacggtattgggaagatcttgtcaagctcgaggaagggtttgaaaaagaatttaccttgcttatggaaaagtacacccacagaatattgcattgaggaacaatagaccactaaatagacaagacatgaacaagagataaggaaatagaagacacaataccaccatgaccattaccattggcacagtgaacagaagcaagacaaacacttgtttgataggtaaatataaaccagttttgttacttgatacacgtttaagttttggaaagagaaaaatggtttatgagggagggaagtttgggtttcatggtgaacactgaaatagtgaaacttcaagtaatgttttttatgcatttttgtttcagatttttggcatttgcccatggtattgtcaacttcaccataaattttttattgtgattttatttatacaataaaatctatactactatatatgtatacatcaaaaaatagttggaaaaagt

SEQ ID NO: 518 - DNA, 5281 bp, Gossypium raimondii
ataaatcctatttaattagtttacctcaatgggaagttttgtatgctttcgtcacgagttttgatccgtgacccgtaacactaatgacaacttttaattatacactaactttaatctaatgtgtaatattatgcaaaaattttgattttatttaattttcaccaattactaacacaaatattgatagaacaccattttaagtttgcacattacataaacaaataattatatttatctaatataaaattaaattaatatatttatttatttaaatatataaagttaaattaaaattaaagttttacgtacacatttatagaaataaaacaatatataaaatagtttattttttaaataaaataataatatcatgacttaaataaatataaagaattctatataatttaaaatttcacactcttatgtatgttaagttttgaatgaaaatttataaaggtttaatagtatgataatgatattaaattaaattgaaatcatataataaatatgaattatatcgataaaataataaccgacaaaatattaatggcacaaaatttataaaaaaatataaaatattttaattttatattgaaataattttgatacatcatgagtacataaattttatgcaccatcaataaataataacattgttgacagtgtaggaagatgtaggtttgagtgcgctgaagcgtattatcctcctatttatgaattgaggaggggttatagatagttctaggcattgataggaggataatatatttcagcgcattcgaacttacgtcctcttgtattgataataatacgcatttcaatcgagctaaaactcaatcaacgtatctctattattttttgttttctttaatgataacatattatattattattaatcatcaaatattctccctatgaataattataaagattataacgactacaagtctgaacgtgattcatgcaaacgaagcagaaaatgaaaggaagctcctgtttctatcatcaattaaaacgagtatcacatatctttcacatgaaaaaaagaatatattgaaaataaactataataaatatatatacagacccacacttccggccaaaatattttttacgcataaataaaattaaataatggctttaagaatatttaaaatttatattaattatttaaattttatattgtatatatcataatattaatattttattatcaatgttctttaaaaaaatattgaaaaaaatagaaaataaagaaagtgaaaaaagcgggcatgcaatggactatctacgtggaagtaaatctgcgatatttatgtacttacagtcgtgaaaagggtccccattctcgactcagtggggggacgcggccgtctggtcatttccatcactcacaacgcgcgtgcgtctcacatcccttcttccatgattaatgatttctgagtttctcatttttagactctctcttgttctccacaggcacctgttctttttttttttcgctcttcaaactctatcctggtaaaaatacccaccttttttgttttggtaaaaagcatgtcttttgttaaatgttaatgtattcttccatgagagtttcaaagagaataaagagttgtttttacgtgatgatctcatgttcttaatggttgaaacttgaaatctttgtttgttttgcacatgaattgtttgtataaatgcatgtgttgatgtcatttgattggcttttgagttattcaaacaggatgaataaacggaggtattgttcttctttttttcggctgaataacttgtttattttcgtattttatgcattggaaaacgttacgttttgaaaagatcttacttttttccttattatatgcaagttttatgtttcttttttgagtactgatttacaattgttttaaattaaatctgccatagctactttgctgcttgttcttgctcatgattggctaaaagaaagataggtgggtttcgatttaaatcttactggtaagattccatgtaaattggaagtagctagctgattgatcctagagagaattatccaattcatttgatttcaaaacggtattgtttgaagtgcttaccatttgcatatatatatatatatatatatatttacaaataagttatcatttatttccgttttatctatttataatttttttagattcgtaactactcttctcaatatcaacatgtcgtgcaatccactatttacattttaagatccatattatatgttttgtttcatagattttctttctttaattatgacgcataaccttgacgttcaaaatataattttgaataatctaattcaattattcaaccatttcattatatcaaattttatattaatcgtattaattgatatttatatatttcggtacaataacaatatgttatttgtaacactagtcttattagtcagttaattgatcatattttgttcatgaaaaggggtttgattggtattagtgtggatacaacaaaatattaccgatctaataagcatcttgtattagaacttagaaaggaattaatcttatatgatatgaaattttgactattcatgagtgtgctcaatatggatataccccacagtgatccttggtagtaaataattttagctgatggaaaatcgtagcattttgttttgttcttccttggaaaagaagagtaacgtttggtctagtacttttaatgttgggacgttttactgtggaaattaaaaccacatggatagcttttatgcatcattaatccctcaacaactgagcatatatgtgatatttcttgtatatgtactgatataactaagcttcttgttgtaagaaaatcaccaatcttttcattcaatacagtgatctaggagtagatttcatggcagatgctactgacccatttcctgacttgggaagcgtgtataaagtttccggtcgttgtcaagtaaaccgggatgtagctgacatcaagcttgcttcttcagtggatggaagggagtctaaaaaccgagttgctgcaaattccgggttacataaagattctacatctaatgtatggggacatccaaatttgattcagaaacttaagatgcaaactacttccaatgtcaggccaactgtggatggttcttgtttgagttcgagaagacatggtagtgcatcgacccaacaaggtgctggaacttgccctgttcaagctggtttcactttgcctaacagttcagaaaatagagttgatgaatatgataacaatgaccctgatgttgtgtatgataacgatgatttggatgactatgacttcgattttgatgaagacgagaagagtcatgaagcacgcaagaagagcaaatggttcaatgcattctttgaacgtttagagaaattgactgttgaggagatcatttcaccagctcagcaatggcactgccctgcatgtcaaggtggaccgggagccattgattggtatcgaggtgtacagcctctaatgactcattccatgactaaaatgacacggagagctaagatgcatcgtgtattcgcggaacttttggtcgaggagatgcgtaggagaggaactttcattaaaccggccaacgatgctgttggcaaatgggaagggcttaatgttagagttgcagatcatgaaatagtttggccaccaatggttatcattatgaatacaaaatatgaacaggacgaaaccggcaaggtactttactgctcttggatagtaaactatctctattactaatatactgctaattgctttgtactgactgttatttcattagtggagtgggatgggaaatcaagagcttctcaattacttcagctcatatgctgcgataaaagcgagacattcgtatggtccacaaggtcaccgcgggatgagtgtgttgatctttgagagttcagcagcagggtatttagaggctgttcgtttgcataaacattttaaagaacaaggaagggatagggatgcttgggatcattcacaggtcccattctgtcctggtggaaaacgccaactttacggctacattgccatcaaagaagacttggatgtatttaaccgacactctcaaggtctaatacgctgcaatcacttttgttaaatcgttgtttttgaacttttcttgtgaatgatacaatctatgcgatcaaacagggaattccaagctgaaattcgagctgagatcataccaagagatggttgagagccaaataaagaagataaacgacaatagtcagcaacttacccgacttaaaaagaaggttgctcaagaacagcaacattcacaagtccttgcagagtctctaggccgattgagtgagaagctccaccagacaatagagccgaaaaatcatatcgtgaggcaacgagctatattgcagcatgaacagaacaaagaagaggtagcattttttaactttattgctgcaatttcagtgttctatagctagatatctcttccttattgcaatgcaatggttttccagttgatagctaaagaacaatatttcaaggagaaaatcaatactatttaccaatccatagactgtaaggaagataatttcgagaagctgcaaagggctgcaagtgagagagttaagcaatcaaatatgaatccgatacatgataaagatgaatgcaggtgacattctatctacttaaagctgtaacaacatttattttcttgttctatgttgtgaagagaatttttaacatgtttttgaatgttcagtgccattgagcttcatgagaaaaacataggagagttcaatgcagagagggagaagctgatgaaaagtcgtcaagatagaaggttaacaatcacactacggtattgggaagatcttgtcaagctcgaggaagggtttgaaaaagaatttaccttgcttatggaaaagtacacccacagaatattgcattgaggaacaatagaccactaaatagacaagacatgaacaagagataaggaaatagaagacacaataccaccatgaccattaccattggcacagtgaacagaagcaagacaaacacttgtttgataggtaaatataaaccagttttgttacttgatacacgtttaagttttggaaagagaaaaatggtttatgagggagggaagtttgggtttcatggtgaacactgaaatagtgaaacttcaagtaatgttttttatgcatttttgtttcagatttttggcatttgcccatggtattgtcaacttcaccataaattttttattgtgatttta

SEQ ID NO: 519 - DNA, 3387 bp, Gossypium raimondii
  misc_feature (2303)..(2402): n is a, c, g, or t
tgtactactaaatgtcgattttatgacatcttactataggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataaggtactgcaatatcttttgcaatttttattttctgatatactaaaataatgaagctaattgtttctattttcagtggaaatactcgtttcctgtctcctgctctaacttttaactttttatttattgtattatacttcagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggttctctctatttaacagaagacaacgattatattacatgcagggataaaatgcaagatagctttaaatgcatgagatttttctgtatttttttcttcacaaataagtagccctgcagatacttaggcagttgactgacgtgctgtataactgatctgttgattaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagaggtaattacttcaaatcttcacatgcctgttgccggacatttggtcctggtgtattagttagtaaatttatactgtagtacatattagtaacctactggtttgggatatcttataggattgattaataatgcatgtttgccataatcaatatttgcttgctggccttccttttcctggatcatggtttttgggttgacatgctcagtatctgggactttcaaagttggcgtacctacatgccccttggtagcaacagcatgtcaagcgtccacttgcccttgggttccaaatccaggtgtttattttaggtggcacctatttttatggtattttttggtctggtttcgaaatttttaattcggtaactttatgcccatggtttcctgcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaagtagacgaagaagagcatgctattgtcctccctgggaattttctacttgatagaatagtaattcttgttctgcttcatgttaactgtgtttcttcttttgccctttccagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcaggtacataattttgatacttctgtgaatttccttgtgtaatttgattgatactggtaatcttacagtatatgaccgtttcacattaaaacagatggtttaatctcataagatgaaatgctgctagatatctcttttctgtttacctgttgaagttatatgagatatttgtgtatttttcttttcatatcttttgaaaaattatttgtagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcctaaaatagtatgttaaaagattggaatatatgggtaaaaaaaagttaaatctaaagttgcatctatggtttattatgcttgtgttgtttgcttagacatggttcaaataagaacttggaatgaatctacgatttctttcctaatatgttgcaa

SEQ ID NO: 520 - DNA, 5959 bp, Gossypium raimondii
taatttgaattgaaggaaatcatttttgcttaaagtattgttttattttggtttagcctttcgaaaattagtttggggtttgagtttcaaaacccgttttgacttaaattagtttggagtttgtattaggggtgtgtaaaattcggataaaaccgaaaaaattcggttaaccgaccgattccgaaaaaattcgattaaccgaccgaattaggttaatcggtcggttaaccaaattttttcggtcgggggtcggttaattattttttgatttttcagttaacggttaattcgcttcgaaaccagtcggttaaccgaattttttcagtttaaccgaaaaattaataaataaaattataatatataaataggtccactattcacctaaacccaatccaaacccaagtattcaacctaacccaattacccaacccaacacaatcataaaaagaacaaataatttaataaataaaaataaaattctaaaacaaaaactaaaactaaagtctaaaagtctaaaaataatttaattatgtagtgattcaattcggttaattctggtaattcggttaattcgggtaattcggttaatttttgatcaaaaataaaaaatatataattttcggttcggttaattttttttgaaaaaatttcggttcggttaaaggttaaaaattttgaaaggtcggttaattcagttaatattattttggggtggttaaccggtcggttaaccgaatgaacacccctagtttataccgtgaaaagtgtaagtttccataattaatataaattcctgttttttaatcttgtaattaccctaaactaataaatttgatataactcctaatttttttttaaaaaagaagttatataaaactatattggttaagttaatttgacatttcatgatgttttccttacactttaatgggttaaccgctcaaaattttcaattataagctgcgaaaattcgtgtgaaatttaacaaaaatttcaaaataaaaatgactagttaaaattgatattatataggtcttttgttcgtactacttataccaattgaaagctctcttctcttctattattcaatattttcattaaacagttttggatgtcacgaatctacaaacatataatctttttctccaacttccgacactaatcatcaaatcaacttggatttaaataatgttcttctactcattgataggaactaatttaccgaacagattgccgaattgtaatttagagctctttggtaaaactttttaaaaaaaacttaacctaataactcaaataaaaacttttgagtagttcagtgacttaaatgaaaattttgaaataattcagcgagcaaattataacctttgtaattaagtaaccaaaacaaaaatttagccataatttagtgactaattccgtagtttatccaaatttatatttattatcaattcaacacccgtcgatgttattggtgatacaaatgaaatgacgcttaaaatgctttccagatactagctaacccaaaaactttcctgctcatttcattttccaagccgacactcactctccactctcatactgtcgctactctgctctactccacaaccctgtctcgccttaccggccccgcacctccacacgctctatgcttacactgcgccccctgcgtctaccctattattagaggtaaatttattggcttttcactgtttttgtgaggtaaccctagttttttttttcttagatgtggggtaaattattttctgagtttcttaattatattgcttggttttttatttaacggtttctctgtctcattatggcattgttgttgttattgttgccgctgcagttcgtgctatcatttttgctgttgctctcatttttttttacaggttagccatgtttttcgtgttaatcttgtcatgccctgccatacccatacctaagagttctaacttcaaacagactggcgttgtcaatgatgtattgtggcgtgtagtttgtcttgtttctgtctaaaatttgacatgtttaaaatttcgtgccatgttcatgttttagacttttagttatttcaatcatgtttgagttgagatataacacggatacaccgattgctagctctattttgaggccaacccagtgcattgtgtaaatgttttgatctttgcaagtaaaggttgactgaaatatccttcgtaaggcaacagctttgacgattagggtatagtgatcgtacaaccaatttatagcttgagacacttgctgacaacaccatctacaggcattttcatagttagttgttgtcgatcttgtttatttttaagactatgtactactaaatgtcgattttatgacatcttactataggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataaggtactgcaatatcttttgcaatttttattttctgatatactaaaataatgaagctaattgtttctattttcagtggaaatactcgtttcctgtctcctgctctaacttttaactttttatttattgtattatacttcagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggttctctctatttaacagaagacaacgattatattacatgcagggataaaatgcaagatagctttaaatgcatgagatttttctgtatttttttcttcacaaataagtagccctgcagatacttaggcagttgactgacgtgctgtataactgatctgttgattaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagaggtaattacttcaaatcttcacatgcctgttgccggacatttggtcctggtgtattagttagtaaatttatactgtagtacatattagtaacctactggtttgggatatcttataggattgattaataatgcatgtttgccataatcaatattgcttgctgtcttcctttcctggatcatggtttttggttgacatgctcagtatctggacttcaaagttgcgtactacatgcccttgtagcacagcatgtcagcgtcactgccttggttcaatcagttgttatttagtgcactatttatgtattttgtctgttcgaattttattcggtacttatgccatgtttctgccaatccctaattattactagtaaaagatggtggtggtgatcataaaagttgctgcgtatctaaaatgaaagttccaattggcatttgcatattattactacaaccaatgcttacagggtaaatctagctatttgctaggctcgcatttaaggtatttagtcagactatgagcaacttcggcttgatatagattcatgtgcttaaccatctgttgcatgttggctgatgttcaagtagacgaagaagagcatgctattgtcctccctgggaattttctacttgatagaatagtaattcttgttctgcttcatgttaactgtgtttcttcttttgccctttccagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcaggtacataattttgatacttctgtgaatttccttgtgtaatttgattgatactggtaatcttacagtatatgaccgtttcacattaaaacagatggtttaatctcataagatgaaatgctgctagatatctcttttctgtttacctgttgaagttatatgagatatttgtgtatttttcttttcatatcttttgaaaaattatttgtagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggctcggtacgagggctgaaaatttttgggg

SEQ ID NO: 521 - DNA, 6074 bp, Gossypium raimondii
acaaatgacaagcgatagaaaaactaaatctcttctctttgatttatcgaatcatagagtggctagccattaatttgaattgaaggaaatcatttttgcttaaagtattgttttattttggtttagcctttcgaaaattagtttggggtttgagtttcaaaacccgttttgacttaaattagtttggagtttgtattaggggtgtgtaaaattcggataaaaccgaaaaaattcggttaaccgaccgattccgaaaaaattcgattaaccgaccgaattaggttaatcggtcggttaaccaaattttttcggtcgggggtcggttaattattttttgatttttcagttaacggttaattcgcttcgaaaccagtcggttaaccgaattttttcagtttaaccgaaaaattaataaataaaattataatatataaataggtccactattcacctaaacccaatccaaacccaagtattcaacctaacccaattacccaacccaacacaatcataaaaagaacaaataatttaataaataaaaataaaattctaaaacaaaaactaaaactaaagtctaaaagtctaaaaataatttaattatgtagtgattcaattcggttaattctggtaattcggttaattcgggtaattcggttaatttttgatcaaaaataaaaaatatataattttcggttcggttaattttttttgaaaaaatttcggttcggttaaaggttaaaaattttgaaaggtcggttaattcagttaatattattttggggtggttaaccggtcggttaaccgaatgaacacccctagtttataccgtgaaaagtgtaagtttccataattaatataaattcctgttttttaatcttgtaattaccctaaactaataaatttgatataactcctaatttttttttaaaaaagaagttatataaaactatattggttaagttaatttgacatttcatgatgttttccttacactttaatgggttaaccgctcaaaattttcaattataagctgcgaaaattcgtgtgaaatttaacaaaaatttcaaaataaaaatgactagttaaaattgatattatataggtcttttgttcgtactacttataccaattgaaagctctcttctcttctattattcaatattttcattaaacagttttggatgtcacgaatctacaaacatataatctttttctccaacttccgacactaatcatcaaatcaacttggatttaaataatgttcttctactcattgataggaactaatttaccgaacagattgccgaattgtaatttagagctctttggtaaaactttttaaaaaaaacttaacctaataactcaaataaaaacttttgagtagttcagtgacttaaatgaaaattttgaaataattcagcgagcaaattataacctttgtaattaagtaaccaaaacaaaaatttagccataatttagtgactaattccgtagtttatccaaatttatatttattatcaattcaacacccgtcgatgttattggtgatacaaatgaaatgacgcttaaaatgctttccagatactagctaacccaaaaactttcctgctcatttcattttccaagccgacactcactctccactctcatactgtcgctactctgctctactccacaaccctgtctcgccttaccggccccgcacctccacacgctctatgcttacactgcgccccctgcgtctaccctattattagaggtaaatttattggcttttcactgtttttgtgaggtaaccctagttttttttttcttagatgtggggtaaattattttctgagtttcttaattatattgcttggttttttatttaacggtttctctgtctcattatggcattgttgttgttattgttgccgctgcagttcgtgctatcatttttgctgttgctctcatttttttttacaggttagccatgtttttcgtgttaatcttgtcatgccctgccatacccatacctaagagttctaacttcaaacagactggcgttgtcaatgatgtattgtggcgtgtagtttgtcttgtttctgtctaaaatttgacatgtttaaaatttcgtgccatgttcatgttttagacttttagttatttcaatcatgtttgagttgagatataacacggatacaccgattgctagctctattttgaggccaacccagtgcattgtgtaaatgttttgatctttgcaagtaaaggttgactgaaatatccttcgtaaggcaacagctttgacgattagggtatagtgatcgtacaaccaatttatagcttgagacacttgctgacaacaccatctacaggcattttcatagttagttgttgtcgatcttgtttatttttaagactatgtactactaaatgtcgattttatgacatcttactataggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataaggtactgcaatatcttttgcaatttttattttctgatatactaaaataatgaagctaattgtttctattttcagtggaaatactcgtttcctgtctcctgctctaacttttaactttttatttattgtattatacttcagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggttctctctatttaacagaagacaacgattatattacatgcagggataaaatgcaagatagctttaaatgcatgagatttttctgtatttttttcttcacaaataagtagccctgcagatacttaggcagttgactgacgtgctgtataactgatctgttgattaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagaggtaattacttcaaatcttcacatgcctgttgccggacatttggtcctggtgtattagttagtaaatttatactgtagtacatattagtaacctactggtttgggatatcttataggattgattaataatgcatgtttgccataatcaatattgcttgctgtcttcctttcctggatcatggtttttggttgacatgctcagtatctggacttcaaagttgcgtactacatgcccttgtagcacagcatgtcagcgtcactgccttggttcaatcagttgttatttagtgcactatttatgtattttgtctgttcgaattttattcggtacttatgccatgtttctgccaatccctaattattactagtaaaagatggtggtggtgatcataaaagttgctgcgtatctaaaatgaaagttccaattggcatttgcatattattactacaaccaatgcttacagggtaaatctagctatttgctaggctcgcatttaaggtatttagtcagactatgagcaacttcggcttgatatagattcatgtgcttaaccatctgttgcatgttggctgatgttcaagtagacgaagaagagcatgctattgtcctccctgggaattttctacttgatagaatagtaattcttgttctgcttcatgttaactgtgtttcttcttttgccctttccagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcaggtacataattttgatacttctgtgaatttccttgtgtaatttgattgatactggtaatcttacagtatatgaccgtttcacattaaaacagatggtttaatctcataagatgaaatgctgctagatatctcttttctgtttacctgttgaagttatatgagatatttgtgtatttttcttttcatatcttttgaaaaattatttgtagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggctcggtacgagggctgaaaatttttgggggtgtagctaactgtcagagtttcgaaaaatattgttttttgcacg

SEQ ID NO: 522 - DNA, 5968 bp, Gossypium raimondii
ctctttgatttatcgaatcatagagtggctagccattaatttgaattgaaggaaatcatttttgcttaaagtattgttttattttggtttagcctttcgaaaattagtttggggtttgagtttcaaaacccgttttgacttaaattagtttggagtttgtattaggggtgtgtaaaattcggataaaaccgaaaaaattcggttaaccgaccgattccgaaaaaattcgattaaccgaccgaattaggttaatcggtcggttaaccaaattttttcggtcgggggtcggttaattattttttgatttttcagttaacggttaattcgcttcgaaaccagtcggttaaccgaattttttcagtttaaccgaaaaattaataaataaaattataatatataaataggtccactattcacctaaacccaatccaaacccaagtattcaacctaacccaattacccaacccaacacaatcataaaaagaacaaataatttaataaataaaaataaaattctaaaacaaaaactaaaactaaagtctaaaagtctaaaaataatttaattatgtagtgattcaattcggttaattctggtaattcggttaattcgggtaattcggttaatttttgatcaaaaataaaaaatatataattttcggttcggttaattttttttgaaaaaatttcggttcggttaaaggttaaaaattttgaaaggtcggttaattcagttaatattattttggggtggttaaccggtcggttaaccgaatgaacacccctagtttataccgtgaaaagtgtaagtttccataattaatataaattcctgttttttaatcttgtaattaccctaaactaataaatttgatataactcctaatttttttttaaaaaagaagttatataaaactatattggttaagttaatttgacatttcatgatgttttccttacactttaatgggttaaccgctcaaaattttcaattataagctgcgaaaattcgtgtgaaatttaacaaaaatttcaaaataaaaatgactagttaaaattgatattatataggtcttttgttcgtactacttataccaattgaaagctctcttctcttctattattcaatattttcattaaacagttttggatgtcacgaatctacaaacatataatctttttctccaacttccgacactaatcatcaaatcaacttggatttaaataatgttcttctactcattgataggaactaatttaccgaacagattgccgaattgtaatttagagctctttggtaaaactttttaaaaaaaacttaacctaataactcaaataaaaacttttgagtagttcagtgacttaaatgaaaattttgaaataattcagcgagcaaattataacctttgtaattaagtaaccaaaacaaaaatttagccataatttagtgactaattccgtagtttatccaaatttatatttattatcaattcaacacccgtcgatgttattggtgatacaaatgaaatgacgcttaaaatgctttccagatactagctaacccaaaaactttcctgctcatttcattttccaagccgacactcactctccactctcatactgtcgctactctgctctactccacaaccctgtctcgccttaccggccccgcacctccacacgctctatgcttacactgcgccccctgcgtctaccctattattagaggtaaatttattggcttttcactgtttttgtgaggtaaccctagttttttttttcttagatgtggggtaaattattttctgagtttcttaattatattgcttggttttttatttaacggtttctctgtctcattatggcattgttgttgttattgttgccgctgcagttcgtgctatcatttttgctgttgctctcatttttttttacaggttagccatgtttttcgtgttaatcttgtcatgccctgccatacccatacctaagagttctaacttcaaacagactggcgttgtcaatgatgtattgtggcgtgtagtttgtcttgtttctgtctaaaatttgacatgtttaaaatttcgtgccatgttcatgttttagacttttagttatttcaatcatgtttgagttgagatataacacggatacaccgattgctagctctattttgaggccaacccagtgcattgtgtaaatgttttgatctttgcaagtaaaggttgactgaaatatccttcgtaaggcaacagctttgacgattagggtatagtgatcgtacaaccaatttatagcttgagacacttgctgacaacaccatctacaggcattttcatagttagttgttgtcgatcttgtttatttttaagactatgtactactaaatgtcgattttatgacatcttactataggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataaggtactgcaatatcttttgcaatttttattttctgatatactaaaataatgaagctaattgtttctattttcagtggaaatactcgtttcctgtctcctgctctaacttttaactttttatttattgtattatacttcagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggttctctctatttaacagaagacaacgattatattacatgcagggataaaatgcaagatagctttaaatgcatgagatttttctgtatttttttcttcacaaataagtagccctgcagatacttaggcagttgactgacgtgctgtataactgatctgttgattaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagaggtaattacttcaaatcttcacatgcctgttgccggacatttggtcctggtgtattagttagtaaatttatactgtagtacatattagtaacctactggtttgggatatcttataggattgattaataatgcatgtttgccataatcaatattgcttgctgtcttcctttcctggatcatggtttttggttgacatgctcagtatctggacttcaaagttgcgtactacatgcccttgtagcacagcatgtcagcgtcactgccttggttcaatcagttgttatttagtgcactatttatgtattttgtctgttcgaattttattcggtacttatgccatgtttctgccaatccctaattattactagtaaaagatggtggtggtgatcataaaagttgctgcgtatctaaaatgaaagttccaattggcatttgcatattattactacaaccaatgcttacagggtaaatctagctatttgctaggctcgcatttaaggtatttagtcagactatgagcaacttcggcttgatatagattcatgtgcttaaccatctgttgcatgttggctgatgttcaagtagacgaagaagagcatgctattgtcctccctgggaattttctacttgatagaatagtaattcttgttctgcttcatgttaactgtgtttcttcttttgccctttccagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcaggtacataattttgatacttctgtgaatttccttgtgtaatttgattgatactggtaatcttacagtatatgaccgtttcacattaaaacagatggtttaatctcataagatgaaatgctgctagatatctcttttctgtttacctgttgaagttatatgagatatttgtgtatttttcttttcatatcttttgaaaaattatttgtagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggct

SEQ ID NO: 523 - DNA, 6040 bp, Gossypium raimondii
ctctttgatttatcgaatcatagagtggctagccattaatttgaattgaaggaaatcatttttgcttaaagtattgttttattttggtttagcctttcgaaaattagtttggggtttgagtttcaaaacccgttttgacttaaattagtttggagtttgtattaggggtgtgtaaaattcggataaaaccgaaaaaattcggttaaccgaccgattccgaaaaaattcgattaaccgaccgaattaggttaatcggtcggttaaccaaattttttcggtcgggggtcggttaattattttttgatttttcagttaacggttaattcgcttcgaaaccagtcggttaaccgaattttttcagtttaaccgaaaaattaataaataaaattataatatataaataggtccactattcacctaaacccaatccaaacccaagtattcaacctaacccaattacccaacccaacacaatcataaaaagaacaaataatttaataaataaaaataaaattctaaaacaaaaactaaaactaaagtctaaaagtctaaaaataatttaattatgtagtgattcaattcggttaattctggtaattcggttaattcgggtaattcggttaatttttgatcaaaaataaaaaatatataattttcggttcggttaattttttttgaaaaaatttcggttcggttaaaggttaaaaattttgaaaggtcggttaattcagttaatattattttggggtggttaaccggtcggttaaccgaatgaacacccctagtttataccgtgaaaagtgtaagtttccataattaatataaattcctgttttttaatcttgtaattaccctaaactaataaatttgatataactcctaatttttttttaaaaaagaagttatataaaactatattggttaagttaatttgacatttcatgatgttttccttacactttaatgggttaaccgctcaaaattttcaattataagctgcgaaaattcgtgtgaaatttaacaaaaatttcaaaataaaaatgactagttaaaattgatattatataggtcttttgttcgtactacttataccaattgaaagctctcttctcttctattattcaatattttcattaaacagttttggatgtcacgaatctacaaacatataatctttttctccaacttccgacactaatcatcaaatcaacttggatttaaataatgttcttctactcattgataggaactaatttaccgaacagattgccgaattgtaatttagagctctttggtaaaactttttaaaaaaaacttaacctaataactcaaataaaaacttttgagtagttcagtgacttaaatgaaaattttgaaataattcagcgagcaaattataacctttgtaattaagtaaccaaaacaaaaatttagccataatttagtgactaattccgtagtttatccaaatttatatttattatcaattcaacacccgtcgatgttattggtgatacaaatgaaatgacgcttaaaatgctttccagatactagctaacccaaaaactttcctgctcatttcattttccaagccgacactcactctccactctcatactgtcgctactctgctctactccacaaccctgtctcgccttaccggccccgcacctccacacgctctatgcttacactgcgccccctgcgtctaccctattattagaggtaaatttattggcttttcactgtttttgtgaggtaaccctagttttttttttcttagatgtggggtaaattattttctgagtttcttaattatattgcttggttttttatttaacggtttctctgtctcattatggcattgttgttgttattgttgccgctgcagttcgtgctatcatttttgctgttgctctcatttttttttacaggttagccatgtttttcgtgttaatcttgtcatgccctgccatacccatacctaagagttctaacttcaaacagactggcgttgtcaatgatgtattgtggcgtgtagtttgtcttgtttctgtctaaaatttgacatgtttaaaatttcgtgccatgttcatgttttagacttttagttatttcaatcatgtttgagttgagatataacacggatacaccgattgctagctctattttgaggccaacccagtgcattgtgtaaatgttttgatctttgcaagtaaaggttgactgaaatatccttcgtaaggcaacagctttgacgattagggtatagtgatcgtacaaccaatttatagcttgagacacttgctgacaacaccatctacaggcattttcatagttagttgttgtcgatcttgtttatttttaagactatgtactactaaatgtcgattttatgacatcttactataggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataaggtactgcaatatcttttgcaatttttattttctgatatactaaaataatgaagctaattgtttctattttcagtggaaatactcgtttcctgtctcctgctctaacttttaactttttatttattgtattatacttcagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggttctctctatttaacagaagacaacgattatattacatgcagggataaaatgcaagatagctttaaatgcatgagatttttctgtatttttttcttcacaaataagtagccctgcagatacttaggcagttgactgacgtgctgtataactgatctgttgattaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagaggtaattacttcaaatcttcacatgcctgttgccggacatttggtcctggtgtattagttagtaaatttatactgtagtacatattagtaacctactggtttgggatatcttataggattgattaataatgcatgtttgccataatcaatattgcttgctgtcttcctttcctggatcatggtttttggttgacatgctcagtatctggacttcaaagttgcgtactacatgcccttgtagcacagcatgtcagcgtcactgccttggttcaatcagttgttatttagtgcactatttatgtattttgtctgttcgaattttattcggtacttatgccatgtttctgccaatccctaattattactagtaaaagatggtggtggtgatcataaaagttgctgcgtatctaaaatgaaagttccaattggcatttgcatattattactacaaccaatgcttacagggtaaatctagctatttgctaggctcgcatttaaggtatttagtcagactatgagcaacttcggcttgatatagattcatgtgcttaaccatctgttgcatgttggctgatgttcaagtagacgaagaagagcatgctattgtcctccctgggaattttctacttgatagaatagtaattcttgttctgcttcatgttaactgtgtttcttcttttgccctttccagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcaggtacataattttgatacttctgtgaatttccttgtgtaatttgattgatactggtaatcttacagtatatgaccgtttcacattaaaacagatggtttaatctcataagatgaaatgctgctagatatctcttttctgtttacctgttgaagttatatgagatatttgtgtatttttcttttcatatcttttgaaaaattatttgtagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggctcggtacgagggctgaaaatttttgggggtgtagctaactgtcagagtttcgaaaaatattgttttttgcacg

SEQ ID NO: 524 - DNA, 5726 bp, Gossypium raimondii
aacggttaattcgcttcgaaaccagtcggttaaccgaattttttcagtttaaccgaaaaattaataaataaaattataatatataaataggtccactattcacctaaacccaatccaaacccaagtattcaacctaacccaattacccaacccaacacaatcataaaaagaacaaataatttaataaataaaaataaaattctaaaacaaaaactaaaactaaagtctaaaagtctaaaaataatttaattatgtagtgattcaattcggttaattctggtaattcggttaattcgggtaattcggttaatttttgatcaaaaataaaaaatatataattttcggttcggttaattttttttgaaaaaatttcggttcggttaaaggttaaaaattttgaaaggtcggttaattcagttaatattattttggggtggttaaccggtcggttaaccgaatgaacacccctagtttataccgtgaaaagtgtaagtttccataattaatataaattcctgttttttaatcttgtaattaccctaaactaataaatttgatataactcctaatttttttttaaaaaagaagttatataaaactatattggttaagttaatttgacatttcatgatgttttccttacactttaatgggttaaccgctcaaaattttcaattataagctgcgaaaattcgtgtgaaatttaacaaaaatttcaaaataaaaatgactagttaaaattgatattatataggtcttttgttcgtactacttataccaattgaaagctctcttctcttctattattcaatattttcattaaacagttttggatgtcacgaatctacaaacatataatctttttctccaacttccgacactaatcatcaaatcaacttggatttaaataatgttcttctactcattgataggaactaatttaccgaacagattgccgaattgtaatttagagctctttggtaaaactttttaaaaaaaacttaacctaataactcaaataaaaacttttgagtagttcagtgacttaaatgaaaattttgaaataattcagcgagcaaattataacctttgtaattaagtaaccaaaacaaaaatttagccataatttagtgactaattccgtagtttatccaaatttatatttattatcaattcaacacccgtcgatgttattggtgatacaaatgaaatgacgcttaaaatgctttccagatactagctaacccaaaaactttcctgctcatttcattttccaagccgacactcactctccactctcatactgtcgctactctgctctactccacaaccctgtctcgccttaccggccccgcacctccacacgctctatgcttacactgcgccccctgcgtctaccctattattagaggtaaatttattggcttttcactgtttttgtgaggtaaccctagttttttttttcttagatgtggggtaaattattttctgagtttcttaattatattgcttggttttttatttaacggtttctctgtctcattatggcattgttgttgttattgttgccgctgcagttcgtgctatcatttttgctgttgctctcatttttttttacaggttagccatgtttttcgtgttaatcttgtcatgccctgccatacccatacctaagagttctaacttcaaacagactggcgttgtcaatgatgtattgtggcgtgtagtttgtcttgtttctgtctaaaatttgacatgtttaaaatttcgtgccatgttcatgttttagacttttagttatttcaatcatgtttgagttgagatataacacggatacaccgattgctagctctattttgaggccaacccagtgcattgtgtaaatgttttgatctttgcaagtaaaggttgactgaaatatccttcgtaaggcaacagctttgacgattagggtatagtgatcgtacaaccaatttatagcttgagacacttgctgacaacaccatctacaggcattttcatagttagttgttgtcgatcttgtttatttttaagactatgtactactaaatgtcgattttatgacatcttactataggattgtgttagaggatgagttcaagaaaagggaatgggaatccttttgtttctggtggtattaacaacccatcgtccaaggggaaagacatatctggatcctctagctccaaggttgagcagctaagccagggtgtagcagacatgaacctgggtttgcctcaagacgatggtgagtgggaggttattcaaaggaagcctaagaatagaactggaagcagtgctgcaagaccttggggtcctcaaaattccaatggtaaaccgcggggagcgatgcggactaatgctgtatcaggaagagcctctggcaatgcttgggatgctcataatactgattctaggatggcaactggcagaggaaatgcaagaccccaaacatgcaacaaggctattgagaacaacaatgtgccaccacatcctgtcattcgcccaccccttcagtatggatggaattggcaatctagaactggttccaatccatcgggggggttacaagatgatcatggaaaaaacaatgtcaacactgaggttgaagaggtcaatgatattgatgatgttgaggatgactcggatgataatgctattgatgattctgatgatgaacttctaaccgatgactttgattcagattcaagtcaaaagagccacgagacaagaaagaataatagatggtttaagaagtttttctcgagtttagatgcattgagaattgaggaaatcaacgacccagcaaggcagtggcactgcccagcatgccagggtggtcctggtgccattgactggtataggggccttcagcctctgatgacacatgccaaaacaaaaggagcaaaaagggtgaaactccatcgtgaacttgctgaactcttggatgaggaattgtgtagaaggggtacttcagttattccttcaggtgaagcttttggcaaatggaagggtttaaaagatgaagaaaaagatcatgaaatagtctggccacctatggttatgataatgaacacaaggctggaacaagatgagaacgataaggtactgcaatatcttttgcaatttttattttctgatatactaaaataatgaagctaattgtttctattttcagtggaaatactcgtttcctgtctcctgctctaacttttaactttttatttattgtattatacttcagtggattggtatgggaaaccaagagcttcttgattatttcagctcatatgctgctgtgaaggctcgccactcgtatggtccacaggggcatcgtgggatgagtgttctgatttttgagagcacagctaggggttatttagaagctgaacggctacataagcattttgctgagcaaggaacgcatagggaggcttgggaacgacgtagggtcttattttatccaggcgggaagcgccaactttatggttatatggctatgaaggaagacctagacagcttcaaccagcattctcaaggttctctctatttaacagaagacaacgattatattacatgcagggataaaatgcaagatagctttaaatgcatgagatttttctgtatttttttcttcacaaataagtagccctgcagatacttaggcagttgactgacgtgctgtataactgatctgttgattaggcaaatctaggctgaaatttgagatgagatcctatcaagagatggttgttaagcagatcaggcaaatgagtgaggacaaccagcagcttattttttacaagaacaaggttgcaaaagaacaaaggcaaaaagttgctcttgaagagtcttttggtattgtgagtgagaggctccggaagacaatggaggagaacaggattgtaagacaaagaaccaaaatgcagcatgaacagaataaagaagaggtaattacttcaaatcttcacatgcctgttgccggacatttggtcctggtgtattagttagtaaatttatactgtagtacatattagtaacctactggtttgggatatcttataggattgattaataatgcatgtttgccataatcaatattgcttgctgtcttcctttcctggatcatggtttttggttgacatgctcagtatctggacttcaaagttgcgtactacatgcccttgtagcacagcatgtcagcgtcactgccttggttcaatcagttgttatttagtgcactatttatgtattttgtctgttcgaattttattcggtacttatgccatgtttctgccaatccctaattattactagtaaaagatggtggtggtgatcataaaagttgctgcgtatctaaaatgaaagttccaattggcatttgcatattattactacaaccaatgcttacagggtaaatctagctatttgctaggctcgcatttaaggtatttagtcagactatgagcaacttcggcttgatatagattcatgtgcttaaccatctgttgcatgttggctgatgttcaagtagacgaagaagagcatgctattgtcctccctgggaattttctacttgatagaatagtaattcttgttctgcttcatgttaactgtgtttcttcttttgccctttccagatggatttccaagagcaattcttcaaggaacgaatcaaatttatccatgaagccagggatgagaaggaagagagttttgagaagctgcagcagcaacagcgtgagaaggtcaagcagtctaaccccaatccttcaaatacagaggaatacaggcgcaggtacataattttgatacttctgtgaatttccttgtgtaatttgattgatactggtaatcttacagtatatgaccgtttcacattaaaacagatggtttaatctcataagatgaaatgctgctagatatctcttttctgtttacctgttgaagttatatgagatatttgtgtatttttcttttcatatcttttgaaaaattatttgtagggcggatgaaattgcaaaattcataaagttccaggatgaagagatgcaggcttttgtggcagagagggacaagctgatcaaagcacacgaagagaagatggttggcatgagagagaggcattggcaggaagaagttgagcttgaaaaggagtttgatgctgaattgagccacctcatggagaagtacactccggatggctcaaaagtcaaccccggcaatacttgattgtggaattgtaggggaatgcgatggtatgtacacatgtggtaaaaaagactttaatctctctgttccctgaggaaacttctgtgatgacactgaatatttctccatcttgagttacaactcttaaaatagtatgttaaaagattggaatatatgggtaaaaaaaagttaaatctaaagttgcatctatggttgccttattatgcttgtgttgtttgcttagacatggttcaaataagaacttggaatgaatctacgatttctttcctattatgttgcaatgttttggttaaatgacattgctctttctagattatgggctgcatctttcatgccacttgaaaccaaagctaatcatatgttttgtaaagaaggaaatagaaataatgttatttttggctcggtacgagggctgaaaatttttgggggtgtagctaactgtcagagtttcgaaaaatattgttttttgcacg

SEQ ID NO: 525 - DNA, 4795 bp, Gossypium raimondii
ataattacgaattaacatctaattaatcaataatacgaatagtttaagaaattattttaataatataatattaaataatataataaaaactattttagtggataaatttcaccataatatatgtctcaatttatttgtgctttgtgtgcagatatatattttttaatgtggttttaagataaacggtaaatttattgaaaataaagctatataaatattgaaaacatattaatatgaatattatactatttagttaaaaattttatttaattttgattcatgcatcaaactccttcaaatacaatatatatagttttatatgaattgatatcaatgataaaattaaaaaaaatttataaaacacaattatcttttagatttatattatattaatattttaaagtaatttatatttaatataatattaatttcataaaaaattaataatattgataattttcaaaaagagaatttaatgaaataattgcactagacatcttttaattatgactcgaattcttttcattaaaaaaattaaaagaaatcatggaaacctaaaaaggagataaataacaaagaaaaaaaagggttatatcaaaaaaaaattttaacttagtaacttttttatattagggctgaatttttttttgtgttcaagttaagtcctgagctttataaatactttcatatcgaagtttgaattttttctttttagttaagttaatccttgaaaacttcaatataaaaatagttgttaagctcgagtttcaaatagtgatttaaaaagatgtcatgatcttggtaccctaaaaatttgatgagaacaaagaaaaagaaaatgacaaacaaataaacaaaccacacatgatctcgagacattttcaattgtgtttcccagagtcacttatcactaaatcagaatcaatttttaaattgatcattatatttcaaagcaatttaattgagtttttaaaatattattatcgcatcaatcatgtcattttcttagcttaccgttaacgtgagtcttaaatgtgagttcaattgatgttgagcatatttaaaacacacaaatcaaatgttaaacacattatatctgttatataaacaatttgaatttaacgtgctaactaaaatatattatatcattaaaatcaaaatgacttttttaataagtcaaaatacaagagttaatttgtaaatttatcattttaagggccacctaccattggtgtcaccctcacattaaatctaagctataaatgtcatatatgtgaacatattttaaatttgatccacatattttgaatatgtacaccacgtcatatttgagttgacatttaaaattacgcttaacaattaagttaacaaaaagatccgattgatacgagacagatatttttaaattcaattaaaacattttgaaattaattttaaatttaaatatgtcattggtgacatatgctatataaatatattaattttagaaaatactaaggccttggctttcaaaatttttcttcttgaaggaaaaaaaagaaaaagaaaataaaaactgtcttatttggctctcgaatccctcccattttccgccatggaagcaccttgagaaaccctaactggatccctttcacgttcttcgctaagctcaagcaaacggcaaatgggttctcttgtgcctttccaagacctcaatctctgcccggaaccaccgctaccagccaccgtgaacatctccacctccgccacacctagcgccaccatcaacaggacaaccaccttcaatttcttaacaccgaagattgaacctaagcaagagcctttcgacgaaccaacaccaacacagactattcaccaacaagaaaactttctcttctctgtttccaattctacccctgatttcatccctaatcccgaaactacccctccggctaacgcttcctcttcagccgatgaccaaaacgctctctactccgaatatttccgaatctccgagcttttccgctctgcttttgctaaaaggatacaaaaatacggcgatgtcgaagtacttgacccggattctcgggccatcgtacccgtacccgaacagtctcaactaacccccgaaactagcccaaccgacggttccaacctggaacgagctttatccgtcgtcgtttcgcgtaagaaggcgggaagatccaatgagctggttcgggttacgaatttgggaatcgatgaccagaggcattttcgtgaccttgttcgaagaacccgaatgatgtacgattccctccgcgttttagtcatttcggaggaagaaaagagaaccggaccgggaaacggtcgacgggctcgcggagatttgagggcagctgccgtcatgagggatcgagaactgtggttgaatcgcgataaaaggatagtgggtgcaatcccaggtattgaaattggtgatgtattcttctttagaatggagctttgtgtggtggggttacatggacaaattcaagctgggattgatacattgcctgctagccaaagctcgagcggagagccaattgcaactagcattattatttccggtgggtacgaggatgatgaagattccggtgactcgataatatataccggccaaggtgggcaagataaatttggaaagcaatgtatgcatcagaagcttgaaggagggaatttggcactagaaaggagtatgcattatgggattgaggtaagagtgattagagggtttaaatatgagaatcgagtttcgggcaaagtgtatgtttatgacggtttatataagattcttgattgttggtttgatgtgggaaagtcagggtttggggtttacaagtttaggttgtcgagaattgaagggcaacctgagatgggtagttcgataatgaagtttgctgagagtcttaggactaagcctttgtctactaggccaatggggtatttgactcttgatatttccatgaaaaaggagagagttccgatctttctttataatgatattgataatgatcatgatcctatgtattatgattaccttgtgaacactgtgttccctcttaatgtatttggtcaagggagtaatagtactggatgtgattgtgtttcggggtgcacggaagggtgtttctgtgctatgaagaatgggggtgattttgcttatgattatggtggaattctcttgagagggaaaccggtgatatttgaatgtggaaacttctgtcaatgcccaccatcttgtcggaaccgtgttgcacaacatgggcttagaaacagattggaaatatttaggtcaagggaaacgggttggggagtgaggtccttggacttgatacaagcaggtgcttttatatgtgaatatgcaggggttgttctcacaagggaccaagcggaagttttcaagatgaacggtgatactttgatttaccccaatcgtttttctgaacgatgggccgaatggggggatttgtctaggatatttccagagtacgtgtgtccatcatatccctcaatcccacctttggattttgcaatggatgtatcaaggatgaggaatgctgcttgttatattagccatagttccagtccgaatgtgctggtgcagtgtgtgttgtatgatcacaacaacttgatgttccctcaccttatgctttttgcaatggagaatatccctcctatgagagagcttagcatagattatggtgtagccgacgaatggactgggaagctttctatctgtaactaaatatcttaagaggaatattttggattttgatgtggtgcagccgggcagtgagacatgataaactgaggtgagcttaacttccaagcatttccaattgtatatatatttatttaaaatcataataatttgtggtgtggccttcctatatttagatattgatttttgattttgtatttctcatgctttcttgtagtctagttgcctgccatgcctgtttgtaggagctaggaatgttattcctttgtgcaacttcatggtgtatacctcaagtagtcagccatatgcaggaggatggaacatttggcacttatagttctaaatgaatgcagttgcttatctcctaagtgcatgttttgttctccagagcaatgtactttctttttttttttgtaatatatatgttgttgtattagcccacatcttgtttcgccttccctgtccaactctactgtttatgtctgcctcaattctatgaatttattcttttcaattgttcctgctcgtaaattttaagtgccgtgatcaacaaagttgttatttggttagttcattattggattcttccttgactagccaaacaggtcattcggttttacaagagtttgtgacaaattgatttgtcatctgtaagggaggactttagctgaaggtagcctcataaagtttaaacaaaatttgagtgtttaaagcttcagtactgcttaagaaacatagggttttatgcaacagccttttccaccctgaataatgccattggcaatgtgctattgttactttgttttgattccttgtcctagaattttttgaatctctacaaagttattcatagattagaacaaatcttcatcagttgccttatgagtaaaatgccataggcttgtatctcatgtttatcataaactatctgtttaaaagccataggaacgtgcttatattcagatcttttcctgtttactaagttgatgctataattaaccacatatagtattagagattccacatgttctgttaatttggaaagtgagctgtcgtaaaacgtctgataccggg

SEQ ID NO: 526 - DNA, 14377 bp, Gossypium raimondii
aaattatattaataattatcgatttaaattcgtaatatataaacattaaaaggcaattagtaacgatattcaatgatcatatattctcattgaaaatcaatatataattaataacaatattaaaaaaaataaaaaagtaaaaaaatagcaaaaaaactgacttccggacgcgaccctccaaattcgtcacccagtaaggtacgactaagggacgattttcatcaatgttgacgttgtgcaaaagagttggactcatccatagtttcctcaataatgagggcaaattcgtcatctagagatttcactcaattagatatcctggatcgcgctaccgccaactcggcgggtcaagttcggttatgtttgtattcttcaacctgcttatttattcttcaccaaccatttagttgttaattagtttttaaataatatataatttttttgaataaataatatataaatttaaaattatataaaaagataaaaaataatattaattttaaaaaataaaaagtatcctaaattatatacataaaaataccaatgataatatacaaacaatgttataaaataatatataataatataagcagtattttgcataaatatatacaaaaaatatatcataataaataaataaaattatcatggttagatatatatattattttgtaaatcgataattatgaataaatcatatttatattatatacagaggcgaatttaggatgcttgcataagcccagcccaacccccctaaaatgaaaaattactatttagatcatttaatttttttaattttaaattaataaagataaaattgcacattaactcgtataaaattaaaaaaaatttgatttaatcttttaaaagttataaagatatagactataaaaaattaaaatttcgttcagcccctttaaagaattgttctggcttcgccactggttgtatatattaatcatatcaaccatacatccataaaaagcaatatacatcatatacatacgtcaaaattactattttttattataatatttatttcaaataataaataataaataataaaattaaaattattatgattatcacaaatttgttttaattataactattatcatattttttgatttttttaaaattaataattatttttaaatgtaaatttagtaatataatgaaaaataaaatatattttggtaagttccaaattcgtgcttatatattacagttaaataatattttatttaattttaaatttaatatttatttacaaattaacacaaagaataaagaatagaaaaaagagaggataaaaatgaaaacaaatcgggtattttctaaacgaaaaaggggtcagttcgggtttattttttacacccgaacccggcatgattcactaaaagagcgtgtccatttttacacgtccccgaacattgcgtcatcatctgcttctattataaaatgggctcattcattcctagcctctctgtactcaagagtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgtaactttctttctcgcatgtctccctatttgattttaagcctgtattttttctcgacatttttggcttgttgttctaatcggttttttttttttatatttgttaaaattttctttcttttttgcttgtatatgtctgcttccttccttttgacctatctatggatttaagttttcagtaattactttgaaaaaccgagggaaaccttcactgttaatggcttgcttaaacgaattccacttgtttagatcatattttttgaattctaatgttttcatgtttctgttctcttattcatttaccttgttcatccctgatacttgcattttcttctccaatattttaatcgctagttttccttgtcatttttctgccttgttttaatcgttttatattttggcacttcttagagctctgttttttatccgactttactatacactgaaggttttagtagttgcttttccttaaaaaaacccaagggaaagtttaactgttaatgatttgcttgactgagttgggctttttgttatttattgtctcgttaaattttattttcattggattttaatgtgtattttactcatctgttttcttatttatttacttgtctctttgtccatctctgttacttgcatcttcttctcgtctcttttgatggcctttggtgcttcattgcttataggttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcatgacattttacattttatccgatgtcattattgcttacctgtgatctttctggttgcctgtcactgcaggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacgtaactgcctgttgattgctgttaaacattgcttgctgttaaattgctgaaaccattttatatgacatcaaattaatacatttgaaacatcatttggcagatatactgaggtgggaaggtcttttttccatacatcattaggtcctagaggagaacttggtaatggaatagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgcgaaacatttccgacgatcaaacctgtcaaagccgctgtctgatcaagatcgtattaaagtattattacactgttttcttgcccttcgtatatattgaattcagtgtttattaatcaaaacttgcagaatatttttggaatgcttcttttgctgtattctttaggtgaaaaaggccttgaagggagtaagagttaagctcatctacatggattatgccaaaacttgcaagattattggagtatctagagaccctataagccagttgacgtgagtttgttgttataatactatacgtgctcaaaaatatttttagtaagctacttttatgtggcctgtgtggtagaattgtttttgggttatttgtagtcttgtattcactacttatctaagttccatcttcaaattgagttggtttttttttttttttttgtggttgacagtttttagtatttggcttggttatgtcttgttctaaaatattgtttatgcttgtgcatttgtaaaatcttgtgctatggtatatttgtcccattctgtctcattatgcttctgttcaatttttggcttttttagatttactcatgatgataagagaacaaatgtctctgtggtcaagtatttccgtgagaaatacaatgttgtgcttaaatatccatccttgcctgcacttcaaagtggaagcgaagctagacctgtctacctgccaatggaggtttttactttatatcaagatcttgttttttgttttctttttgtttgttactgattctcttgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaatttgttgataagatgagaattgtgattcatttggcatttcatgtttctgcagatggtccaggtcaataattttgaggtggaggagcttgttactaaagaatttggaatgcatgttcgcaaagaacttgcattgattaatgcacgagttctaaatcctccagtggtacttatatgccaatatgttatattttcaaggatactgtccgtcttataataagattaatgtcggttttggttgctgcagctaaagtatcacgatagtggacgtgacaaaattgttaatcctagctgtgggcaatggaacatgatcaacaaggtgatttttttttcttcccctcttattctttgaagtggcattatttgtaaaatttaaggaattagacctgtctcttcagtctcctcttgttccagagttcttgttcattttttttcaattcatttttaaggtttgcagcgtctcttctttgcagtttagtgtagctgtaagtcttttgggaaaattttgctaggttttaaggttcaacattttttttgcagaaaatggtcaatgggggtaaagttgatttctggtcttgtgtgaacttctcctctgaatataggaatatgtcagaagacttctgtgcggggctggtgaatatgtgtaacagcaaaggaatggtatgctgtgtggtttttttagtgtaggtggatggtacatctgttatttattcatcactagcttgatttccgattttgttactctaggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggtaagaaattctgatgttttgtaaataggtaattcctggggtttctttgcgcaactctaatctttttgtttgcaggaaaaataaagcgaatttgtgagacggagctaggtattgtttcacaatgttgtaagcctgcgcaagcttcaaagtttagcaaccaatattttgaaaatgttgctctcaagatcaatgctaaggtatctgttttgcctcactggtggtgatttgatatagtggtttcttgtcttgctatcttcttttaaatcatttgagaattgtaaattctgtaggttggggggagaaatactgtgctgaacgatgctgttttaaggagaattccgcttgtgactgatgtccctacaatcatttttggggcagatgtcactcatccgccgcctggcgaagactctagttcttctatagctgcagtaagcatattcattattctctatcatccccattttgttacttgatcatatttaagaggttattggctggctgcaggtcgttgcttcaatggattggcctgaggtaaccaagtatcgtggaattgtctctgcacagactcaccgggtggaaataatcgaggatctttataaacaaactagggatccacagaagggtttagttgagggtggaatggttaggtagggagatagatttatttcaggcttaaatttttagtttcttctggaagtgctctactttcttaacatttcaagttctctgcagggagttgcttcttgctttctacaggtcaacgaaacaaaagccttctagaattatcttctataggtaatgtttgcttttgaccatccaaatctatgtatatatttctagcagcagtgctgatatctgatttttgatgtgtggcagagatggtgttagtgaaggacaattcagccaagttttgctttatgaaatggatgcgattcggaaggtattgaaatcactgtataatttctattatagttagttcactgtataatggatgcaatgatttttggtgtttgggccttctgacccccgcagttttcttccttccaggcttgttcctcgctacaggaaggatatatgcctcgggttacatttgttgtggttcaaaagaggcatcatactcgcttattccctactgatcgcaacaaaactgataggagtggcaacatattaccaggtgattctaatcttataatagggatttgatcgtattctcttgatcttcattttgttagcatattttaatgtagccaataacttttaggtactgttgtggatactagcatctgtcatccaactgagtttgatttttatctcaatagtcatgctggaatccaggtaaaatgaggccttcccttgaagtgtgatggtttttatgttaattttgtccgatctgatattgatattgatgttgttgtgtaggggacaagcaagcccacacattaccacgttttgttggatgaaaatggcttcagtgctgacatcttgcaagtgctcacaaacaatttatgttacacgtatgtgtttactcctttctctataatcttgaaatggggtgaataaataatgctttagatcagcactagcaattatatagtaataattttactttgtggacaggtatgcgaggtgtaccaagtccgtttccataggtttgtgatgatgtttttttgtcttgttaaatttgttgactaaggttggttttgacagtaatatttggattatatgtttgcagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggagtctaattttggagtttttgttttggtggttgagcgacttgttgtctgaagtttgaattattataaatcacacactgtttgtggattacgaaaattacataaatgttctttatttttaagacatgttcttagaaaggagttttggtatcattcttaagcttcttttatatcaccgattaatacaagagacgatgaaattttagagaataatgtctttttattaagagtttttaaatgttcagtacacaaatggtaagatacgctcggaaatcctcactgctcctccttgcaactccaatgaataaaaaagcaaacctaatcaatttactttttaatttaccattttaataaacatagtaaatacaattttattaacttattaaataattttataaatttacatatttttaataatttcataaaagtgtgataattttaaaaacttttattatatataatttttaatctaatgttttcaatagttatattttattatcatatcactttacaattacgtttgaaattaaatatacacctcaccactgtttttattctcactgctattgctgtttttaactttaccgaagataaatgtatcgtccatcccaattaaaccttagtccatttatagtggtttttttacttcgttaaagctagacaaactatgccattaaaattttaatagcttaagtttagattggatgagcgatgcgtttattttcggtgagattaaaaacaacaatggtagttaaattagttactgtagcgatgaaattagatactgtagtagtgatattagaaattgcggtaaggtgtgtgtttagattcaaacgcaactataacgatgagttgagaatagaaaataactattaaagacattagatttatgagttctctctcctttcatcttttttttcacccttaaattctgttgatgaataaaaaatattctttaaatatcaaaggaaagctctcatttaatcctctcatctgattgtatgaaaacagttttgttcattcgtcagttattctgctctatcattgcttttatctgtttcatttttttccaatctaaaactaaaaaataagcaccatcttttccattcatgatgacacagaaggtgaagaaaattataaattttgattcatcaatgggtatgggtggttaaccaaaatagagaagataaaaaaagaagaagcaatgtttaaaataaaagtcattttcctttttttaaaaatatggatgattgataattttaaaaataattttcattattttcaccaaaatgttttgtagaattaaaaaagacgagaacaagagttttttaattttaaatgaacgagttcacaatgggttcaaatccatataaacacaaaaaaataattatttttcaacagtttttttttctaatattgaattcgataccctgatttgaatccatataaatacaaaatttattttattttattaaaacatgtttttatttctatttatcaattttaaaaaaaatagaaaatgaaaatcatgtttctatttaccaaatatttcacaaattaaactgactttaattgtttaaaaaaaagaaaaaaaattctattattttctggtgaagtagaaattaggaaagggaagggatgcttgctatggaaattgtggatggaaaaaaggaagttgtcaataaagaaaaaaaaaaatttttggtatttttttatgtccgttttattgtttatgtttggggttcgtggttgttcttctcaacaatgtcatcttcaatgtttaaatctatgtctcaaattaagaatacaatgtgccttaccattacacccaacacttgttggtaaaaaaaaagtttaaaatttatatgatattttaaaaacatatagataatttaatggtaaaattataattttatttttttgaaggataatgctaatattgtaattatatttattattgtaattttacataaaaattaaattaattaacttgtaacatcaactaagttaaatatttctttaagtattaaattatgtaaaaaatatattaataaataggtgaaatgaggttttggttgaacctgatttcttaagtttaacccttactaccctaactcaacgacattattttttgaaagaactcgatcaagattgctttttccgtagttacttttccttaaaaaaacccaagggaaagtttaactgttaatgatttgcttaaatgagttgggctttttgttatttattgtctcgttaatttttattttcattggattttaatgtgtattttccttttctgttttcttatttatttacttgtctctttgtccatctctgttacttgcatcttcttctcgtctcttttgatggcctttggtgcttcattgcttataggttactgtaacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcttgacattttacattatatccgatgtcataattgcttacctctgatctttctggttgcctgtcactgcaggaaggagcgacaatttaaggttgcaatcaaactggcctccaagccagaccttcattatctcagggagtttttgagcagaaagcattttgaatgtcctcaagaagctattcaagttctggatgttgttcttagagctaaaccatctcagatgtaactgcctgttgattaatgttaaacatttctggctattaaattgttgaaaccattttatatgacatcaaattaatacatttgaaacatcatttggcagatatactgaggtgggaaggtcttttttctatacatcattaggtcctagaggagaacttggtaatggaacagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgtgaaacatttccgacgatcaaacctgtcaaagccgctgtctgatcaagatcgtattaaagtacgtatatattgaattcagtgtttattaatcaaaacttgcagaatttttttgcaatgcttcttttgccgtattttttaggtgaaaaaggccttgaagggagtaagagttaggctcatctacatggattatgccaaaacttgcaagattattggagtatctagagaccctataagccagttgacgtgagtttgttgttataatactatacctgctcataaatatttttagtaagctacttttatgtggcctgtgtggtagaattgtttttgggttatttgtagtcttgtattcactacttatctaagttacatcttaaaattgagttggttttatttttattttttgcagttgacagtttttagtatttggcttggttatgtcttgttctaaaatattgtttatgcttatacatttgtaaaatcttgtgcttatggtacatttgtaccattctgtctcattatgtttctgttcaatttttggctgttttagatttcctcttgatgataagagaacaaatgtctctgtggtcaagtatttccgtgagaaatacaatgttgtgcttaaatatccatccttgcctgcacttcaaagtggaagtgaagctagacctgtctacctgccaatggaggtttttactttatatcaagatgatcttgtttttgttttctttttgtttgttactgattctcctgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaattggttgataagatgagaattttgattcattggcatttcatgtttctgcagatggtccaggtcaataattttgaggtggaggagcttgttactaaagaatttggaatgcatgttcgcaaagaacttgcattgattaatgcacaagttctaaatcctccagtggtacttttaagccaatatgttatattttcaaggatactgtcagtcttataatacgattaatgtctgttttggttgctgcagctaaagtatcacgatagtggacgtgacaaaatcgttaatcctagttgcgggcaatggaacatgatcaacaaggtggtatttttttttcttcccctcttctttgaagtggcattgtttgtaaaatttaaggaatcagacctgtctcttcagtctcctcttgttccagagttcttgttcattttttcaattcatttttaaggtagctataagtcttttgggaaaattttgataggttttaaggttcaacagttttttttttttttttgcagaaaatggtcaattggggtaaagtcgatttctggtcttgtgtgaacttctcctcggaatattggaatatgtcagaagagttctgtgcggagctggtgaatatgtgtaacaacaaaggaatggtatgctgtgtggttttttttagtgtaggtggatggtatatctgttatttatttatcactagcatgatttcccattttgtgactctaggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggtaagaaattctgatgttttgtaaataggtaattcctggggtttctttgcgcgactcaaatctttttgcttgcaggaaaaataaagcgaatttgtgagacggagctaggtattgtttcacaatgttgtaagcctgtgcaagctgcaaagtttagcaaccaatattttgaaaatgttgctctcaagatcaatgctaaggtatgtgttttgcctcactggtggtgatttgatatagtgttttcttgtcttgttatcttaattcatttgagaattgtaaattctgtaggttggggggcgaaatactgtgctgaacgatgctattttaaggagaattccgcttgtgactgatgtccctacaatcatttttggggcagatgtcactcatccgccgcctggcgaagactctagttcttctatagctgcagtaagcatattcattgttctctacatccccattttgttacttgatcatatttaagaggttattggctggatgcaggtcgttgcttcaatggattggcctgaggtaaccaagtatcgtggaattgtctctgcacagactcaccggatggaaataatccaggatctttataaacaaacaaaggatccacagaagggtttagttgagggtggaatggttaggtagggagatagatttatttcgggcttaattttttagtttcttctggacgtgctctactttcttaacatttcaagttctctgcagggaattgcttgttgctttcttcaagtcaacaagacaaaagccttctagaattatcttctataggtaatgtttgcttttgaccatccaaatatatgtatatacttctagcagcagtgctgacatctgatttttgatgtggcagaggtggtgttagtgaaggacaattcagccaagttttgctttatgaaatggatgcgatttggaaggtattgaaatcactgtataatgtctattatagttggttcactgtataatggatgcttctgacccctgcagttttcttccttccaggcttgttcctcgctacaggaaggatatatgcctcgggttacatttgttgtggttcaaaagaggcatcatactcgcttattccctactgatcgcaacaaaactgatgggagtggcaacatattaccaggtgattctaatcttataatagggatttgatcgtattctcttgatcttcattttgttagcatattttaatgtagccaataaattttaggtactgttgtggatactagcatctgtcatccaaccgagtttgatttttatctcaatagtcatgctggaatcctggttaaatgaggcttcccttgaagtgtgatggtttttatgttaattttgtccgatctgatactgatgttgttgtgtaggggacaagcaaggccacacgttaccacgttttgtttgatgaaaatggcttcagtgctgacatcttgcaagtgctcacaaacagtttatgttacacgtatgtgtttactcctttctctataatcctgtaatggggtgaataaataatgctttagatcagcactagtaattatatagtaataattttactttgtggataggtatgcgaggtgtaccaagtccgtttccataggtttgtgatgatgtttttttgtcttgttaaatttgttaacttaaggttggttttgacagtgaatatttgaattatatgtttgcagtgcctccggcatactatgctcacctcgctgcttatagggcacgctattatattgaggatgagatgtcggatagtgggtctactggtggaggccgaaagccgaaagacaaggttgtagagtttaggccgctccccagcataaaggacaatgtgaaggaagtgtttggttggtggaaagttgcgcaagtatagttgcacagtttgtggatgatggtggagtcttgttgattccattggtggactttgtaattatttaatttt

SEQ ID NO: 527 - DNA, 7706 bp, Gossypium raimondii
taaaataaaaaagatattaaattaattgactctaattgaattattataaaaattatattaataattatcgatttaaattcgtaatatataaacattaaaaggcaattagtaacgatattcaatgatcatatattctcattgaaaatcaatatataattaataacaatattaaaaaaaataaaaaagtaaaaaaatagcaaaaaaactgacttccggacgcgaccctccaaattcgtcacccagtaaggtacgactaagggacgattttcatcaatgttgacgttgtgcaaaagagttggactcatccatagtttcctcaataatgagggcaaattcgtcatctagagatttcactcaattagatatcctggatcgcgctaccgccaactcggcgggtcaagttcggttatgtttgtattcttcaacctgcttatttattcttcaccaaccatttagttgttaattagtttttaaataatatataatttttttgaataaataatatataaatttaaaattatataaaaagataaaaaataatattaattttaaaaaataaaaagtatcctaaattatatacataaaaataccaatgataatatacaaacaatgttataaaataatatataataatataagcagtattttgcataaatatatacaaaaaatatatcataataaataaataaaattatcatggttagatatatatattattttgtaaatcgataattatgaataaatcatatttatattatatacagaggcgaatttaggatgcttgcataagcccagcccaacccccctaaaatgaaaaattactatttagatcatttaatttttttaattttaaattaataaagataaaattgcacattaactcgtataaaattaaaaaaaatttgatttaatcttttaaaagttataaagatatagactataaaaaattaaaatttcgttcagcccctttaaagaattgttctggcttcgccactggttgtatatattaatcatatcaaccatacatccataaaaagcaatatacatcatatacatacgtcaaaattactattttttattataatatttatttcaaataataaataataaataataaaattaaaattattatgattatcacaaatttgttttaattataactattatcatattttttgatttttttaaaattaataattatttttaaatgtaaatttagtaatataatgaaaaataaaatatattttggtaagttccaaattcgtgcttatatattacagttaaataatattttatttaattttaaatttaatatttatttacaaattaacacaaagaataaagaatagaaaaaagagaggataaaaatgaaaacaaatcgggtattttctaaacgaaaaaggggtcagttcgggtttattttttacacccgaacccggcatgattcactaaaagagcgtgtccatttttacacgtccccgaacattgcgtcatcatctgcttctattataaaatgggctcattcattcctagcctctctgtactcaagagtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgtaactttctttctcgcatgtctccctatttgattttaagcctgtattttttctcgacatttttggcttgttgttctaatcggttttttttttttatatttgttaaaattttctttcttttttgcttgtatatgtctgcttccttccttttgacctatctatggatttaagttttcagtaattactttgaaaaaccgagggaaaccttcactgttaatggcttgcttaaacgaattccacttgtttagatcatattttttgaattctaatgttttcatgtttctgttctcttattcatttaccttgttcatccctgatacttgcattttcttctccaatattttaatcgctagttttccttgtcatttttctgccttgttttaatcgttttatattttggcacttcttagagctctgttttttatccgactttactatacactgaaggttttagtagttgcttttccttaaaaaaacccaagggaaagtttaactgttaatgatttgcttgactgagttgggctttttgttatttattgtctcgttaaattttattttcattggattttaatgtgtattttactcatctgttttcttatttatttacttgtctctttgtccatctctgttacttgcatcttcttctcgtctcttttgatggcctttggtgcttcattgcttataggttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcatgacattttacattttatccgatgtcattattgcttacctgtgatctttctggttgcctgtcactgcaggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacgtaactgcctgttgattgctgttaaacattgcttgctgttaaattgctgaaaccattttatatgacatcaaattaatacatttgaaacatcatttggcagatatactgaggtgggaaggtcttttttccatacatcattaggtcctagaggagaacttggtaatggaatagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgcgaaacatttccgacgatcaaacctgtcaaagccgctgtctgatcaagatcgtattaaagtattattacactgttttcttgcccttcgtatatattgaattcagtgtttattaatcaaaacttgcagaatatttttggaatgcttcttttgctgtattctttaggtgaaaaaggccttgaagggagtaagagttaagctcatctacatggattatgccaaaacttgcaagattattggagtatctagagaccctataagccagttgacgtgagtttgttgttataatactatacgtgctcaaaaatatttttagtaagctacttttatgtggcctgtgtggtagaattgtttttgggttatttgtagtcttgtattcactacttatctaagttccatcttcaaattgagttggtttttttttttttttttgtggttgacagtttttagtatttggcttggttatgtcttgttctaaaatattgtttatgcttgtgcatttgtaaaatcttgtgctatggtatatttgtcccattctgtctcattatgcttctgttcaatttttggcttttttagatttactcatgatgataagagaacaaatgtctctgtggtcaagtatttccgtgagaaatacaatgttgtgcttaaatatccatccttgcctgcacttcaaagtggaagcgaagctagacctgtctacctgccaatggaggtttttactttatatcaagatcttgttttttgttttctttttgtttgttactgattctcttgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaatttgttgataagatgagaattgtgattcatttggcatttcatgtttctgcagatggtccaggtcaataattttgaggtggaggagcttgttactaaagaatttggaatgcatgttcgcaaagaacttgcattgattaatgcacgagttctaaatcctccagtggtacttatatgccaatatgttatattttcaaggatactgtccgtcttataataagattaatgtcggttttggttgctgcagctaaagtatcacgatagtggacgtgacaaaattgttaatcctagctgtgggcaatggaacatgatcaacaaggtgatttttttttcttcccctcttattctttgaagtggcattatttgtaaaatttaaggaattagacctgtctcttcagtctcctcttgttccagagttcttgttcattttttttcaattcatttttaaggtttgcagcgtctcttctttgcagtttagtgtagctgtaagtcttttgggaaaattttgctaggttttaaggttcaacattttttttgcagaaaatggtcaatgggggtaaagttgatttctggtcttgtgtgaacttctcctctgaatataggaatatgtcagaagacttctgtgcggggctggtgaatatgtgtaacagcaaaggaatggtatgctgtgtggtttttttagtgtaggtggatggtacatctgttatttattcatcactagcttgatttccgattttgttactctaggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggtaagaaattctgatgttttgtaaataggtaattcctggggtttctttgcgcaactctaatctttttgtttgcaggaaaaataaagcgaatttgtgagacggagctaggtattgtttcacaatgttgtaagcctgcgcaagcttcaaagtttagcaaccaatattttgaaaatgttgctctcaagatcaatgctaaggtatctgttttgcctcactggtggtgatttgatatagtggtttcttgtcttgctatcttcttttaaatcatttgagaattgtaaattctgtaggttggggggagaaatactgtgctgaacgatgctgttttaaggagaattccgcttgtgactgatgtccctacaatcatttttggggcagatgtcactcatccgccgcctggcgaagactctagttcttctatagctgcagtaagcatattcattattctctatcatccccattttgttacttgatcatatttaagaggttattggctggctgcaggtcgttgcttcaatggattggcctgaggtaaccaagtatcgtggaattgtctctgcacagactcaccgggtggaaataatcgaggatctttataaacaaactagggatccacagaagggtttagttgagggtggaatggttaggtagggagatagatttatttcaggcttaaatttttagtttcttctggaagtgctctactttcttaacatttcaagttctctgcagggagttgcttcttgctttctacaggtcaacgaaacaaaagccttctagaattatcttctataggtaatgtttgcttttgaccatccaaatctatgtatatatttctagcagcagtgctgatatctgatttttgatgtgtggcagagatggtgttagtgaaggacaattcagccaagttttgctttatgaaatggatgcgattcggaaggtattgaaatcactgtataatttctattatagttagttcactgtataatggatgcaatgatttttggtgtttgggccttctgacccccgcagttttcttccttccaggcttgttcctcgctacaggaaggatatatgcctcgggttacatttgttgtggttcaaaagaggcatcatactcgcttattccctactgatcgcaacaaaactgataggagtggcaacatattaccaggtgattctaatcttataatagggatttgatcgtattctcttgatcttcattttgttagcatattttaatgtagccaataacttttaggtactgttgtggatactagcatctgtcatccaactgagtttgatttttatctcaatagtcatgctggaatccaggtaaaatgaggccttcccttgaagtgtgatggtttttatgttaattttgtccgatctgatattgatattgatgttgttgtgtaggggacaagcaagcccacacattaccacgttttgttggatgaaaatggcttcagtgctgacatcttgcaagtgctcacaaacaatttatgttacacgtatgtgtttactcctttctctataatcttgaaatggggtgaataaataatgctttagatcagcactagcaattatatagtaataattttactttgtggacaggtatgcgaggtgtaccaagtccgtttccataggtttgtgatgatgtttttttgtcttgttaaatttgttgactaaggttggttttgacagtaatatttggattatatgtttgcagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggagtctaattttggagtttttgttttggtggttgagcgacttgttgtctgaagtttgaattattataaatcacacactgtttgtggattacgaaaattacataaatgttctttatttttaagacatgttcttagaaaggagttttggtatcattcttaagcttcttttatatcaccgattaatacaagagacgatgaaattttagagaataatgtctttttattaagagtttttaaatgttcagtacacaaatggtaa

SEQ ID NO: 528 - DNA, 7610 bp, Gossypium raimondii
aaattatattaataattatcgatttaaattcgtaatatataaacattaaaaggcaattagtaacgatattcaatgatcatatattctcattgaaaatcaatatataattaataacaatattaaaaaaaataaaaaagtaaaaaaatagcaaaaaaactgacttccggacgcgaccctccaaattcgtcacccagtaaggtacgactaagggacgattttcatcaatgttgacgttgtgcaaaagagttggactcatccatagtttcctcaataatgagggcaaattcgtcatctagagatttcactcaattagatatcctggatcgcgctaccgccaactcggcgggtcaagttcggttatgtttgtattcttcaacctgcttatttattcttcaccaaccatttagttgttaattagtttttaaataatatataatttttttgaataaataatatataaatttaaaattatataaaaagataaaaaataatattaattttaaaaaataaaaagtatcctaaattatatacataaaaataccaatgataatatacaaacaatgttataaaataatatataataatataagcagtattttgcataaatatatacaaaaaatatatcataataaataaataaaattatcatggttagatatatatattattttgtaaatcgataattatgaataaatcatatttatattatatacagaggcgaatttaggatgcttgcataagcccagcccaacccccctaaaatgaaaaattactatttagatcatttaatttttttaattttaaattaataaagataaaattgcacattaactcgtataaaattaaaaaaaatttgatttaatcttttaaaagttataaagatatagactataaaaaattaaaatttcgttcagcccctttaaagaattgttctggcttcgccactggttgtatatattaatcatatcaaccatacatccataaaaagcaatatacatcatatacatacgtcaaaattactattttttattataatatttatttcaaataataaataataaataataaaattaaaattattatgattatcacaaatttgttttaattataactattatcatattttttgatttttttaaaattaataattatttttaaatgtaaatttagtaatataatgaaaaataaaatatattttggtaagttccaaattcgtgcttatatattacagttaaataatattttatttaattttaaatttaatatttatttacaaattaacacaaagaataaagaatagaaaaaagagaggataaaaatgaaaacaaatcgggtattttctaaacgaaaaaggggtcagttcgggtttattttttacacccgaacccggcatgattcactaaaagagcgtgtccatttttacacgtccccgaacattgcgtcatcatctgcttctattataaaatgggctcattcattcctagcctctctgtactcaagagtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgtaactttctttctcgcatgtctccctatttgattttaagcctgtattttttctcgacatttttggcttgttgttctaatcggttttttttttttatatttgttaaaattttctttcttttttgcttgtatatgtctgcttccttccttttgacctatctatggatttaagttttcagtaattactttgaaaaaccgagggaaaccttcactgttaatggcttgcttaaacgaattccacttgtttagatcatattttttgaattctaatgttttcatgtttctgttctcttattcatttaccttgttcatccctgatacttgcattttcttctccaatattttaatcgctagttttccttgtcatttttctgccttgttttaatcgttttatattttggcacttcttagagctctgttttttatccgactttactatacactgaaggttttagtagttgcttttccttaaaaaaacccaagggaaagtttaactgttaatgatttgcttgactgagttgggctttttgttatttattgtctcgttaaattttattttcattggattttaatgtgtattttactcatctgttttcttatttatttacttgtctctttgtccatctctgttacttgcatcttcttctcgtctcttttgatggcctttggtgcttcattgcttataggttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcatgacattttacattttatccgatgtcattattgcttacctgtgatctttctggttgcctgtcactgcaggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacgtaactgcctgttgattgctgttaaacattgcttgctgttaaattgctgaaaccattttatatgacatcaaattaatacatttgaaacatcatttggcagatatactgaggtgggaaggtcttttttccatacatcattaggtcctagaggagaacttggtaatggaatagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgcgaaacatttccgacgatcaaacctgtcaaagccgctgtctgatcaagatcgtattaaagtattattacactgttttcttgcccttcgtatatattgaattcagtgtttattaatcaaaacttgcagaatatttttggaatgcttcttttgctgtattctttaggtgaaaaaggccttgaagggagtaagagttaagctcatctacatggattatgccaaaacttgcaagattattggagtatctagagaccctataagccagttgacgtgagtttgttgttataatactatacgtgctcaaaaatatttttagtaagctacttttatgtggcctgtgtggtagaattgtttttgggttatttgtagtcttgtattcactacttatctaagttccatcttcaaattgagttggtttttttttttttttttgtggttgacagtttttagtatttggcttggttatgtcttgttctaaaatattgtttatgcttgtgcatttgtaaaatcttgtgctatggtatatttgtcccattctgtctcattatgcttctgttcaatttttggcttttttagatttactcatgatgataagagaacaaatgtctctgtggtcaagtatttccgtgagaaatacaatgttgtgcttaaatatccatccttgcctgcacttcaaagtggaagcgaagctagacctgtctacctgccaatggaggtttttactttatatcaagatcttgttttttgttttctttttgtttgttactgattctcttgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaatttgttgataagatgagaattgtgattcatttggcatttcatgtttctgcagatggtccaggtcaataattttgaggtggaggagcttgttactaaagaatttggaatgcatgttcgcaaagaacttgcattgattaatgcacgagttctaaatcctccagtggtacttatatgccaatatgttatattttcaaggatactgtccgtcttataataagattaatgtcggttttggttgctgcagctaaagtatcacgatagtggacgtgacaaaattgttaatcctagctgtgggcaatggaacatgatcaacaaggtgatttttttttcttcccctcttattctttgaagtggcattatttgtaaaatttaaggaattagacctgtctcttcagtctcctcttgttccagagttcttgttcattttttttcaattcatttttaaggtttgcagcgtctcttctttgcagtttagtgtagctgtaagtcttttgggaaaattttgctaggttttaaggttcaacattttttttgcagaaaatggtcaatgggggtaaagttgatttctggtcttgtgtgaacttctcctctgaatataggaatatgtcagaagacttctgtgcggggctggtgaatatgtgtaacagcaaaggaatggtatgctgtgtggtttttttagtgtaggtggatggtacatctgttatttattcatcactagcttgatttccgattttgttactctaggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggtaagaaattctgatgttttgtaaataggtaattcctggggtttctttgcgcaactctaatctttttgtttgcaggaaaaataaagcgaatttgtgagacggagctaggtattgtttcacaatgttgtaagcctgcgcaagcttcaaagtttagcaaccaatattttgaaaatgttgctctcaagatcaatgctaaggtatctgttttgcctcactggtggtgatttgatatagtggtttcttgtcttgctatcttcttttaaatcatttgagaattgtaaattctgtaggttggggggagaaatactgtgctgaacgatgctgttttaaggagaattccgcttgtgactgatgtccctacaatcatttttggggcagatgtcactcatccgccgcctggcgaagactctagttcttctatagctgcagtaagcatattcattattctctatcatccccattttgttacttgatcatatttaagaggttattggctggctgcaggtcgttgcttcaatggattggcctgaggtaaccaagtatcgtggaattgtctctgcacagactcaccgggtggaaataatcgaggatctttataaacaaactagggatccacagaagggtttagttgagggtggaatggttaggtagggagatagatttatttcaggcttaaatttttagtttcttctggaagtgctctactttcttaacatttcaagttctctgcagggagttgcttcttgctttctacaggtcaacgaaacaaaagccttctagaattatcttctataggtaatgtttgcttttgaccatccaaatctatgtatatatttctagcagcagtgctgatatctgatttttgatgtgtggcagagatggtgttagtgaaggacaattcagccaagttttgctttatgaaatggatgcgattcggaaggtattgaaatcactgtataatttctattatagttagttcactgtataatggatgcaatgatttttggtgtttgggccttctgacccccgcagttttcttccttccaggcttgttcctcgctacaggaaggatatatgcctcgggttacatttgttgtggttcaaaagaggcatcatactcgcttattccctactgatcgcaacaaaactgataggagtggcaacatattaccaggtgattctaatcttataatagggatttgatcgtattctcttgatcttcattttgttagcatattttaatgtagccaataacttttaggtactgttgtggatactagcatctgtcatccaactgagtttgatttttatctcaatagtcatgctggaatccaggtaaaatgaggccttcccttgaagtgtgatggtttttatgttaattttgtccgatctgatattgatattgatgttgttgtgtaggggacaagcaagcccacacattaccacgttttgttggatgaaaatggcttcagtgctgacatcttgcaagtgctcacaaacaatttatgttacacgtatgtgtttactcctttctctataatcttgaaatggggtgaataaataatgctttagatcagcactagcaattatatagtaataattttactttgtggacaggtatgcgaggtgtaccaagtccgtttccataggtttgtgatgatgtttttttgtcttgttaaatttgttgactaaggttggttttgacagtaatatttggattatatgtttgcagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggagtctaattttggagtttttgttttggtggttgagcgacttgttgtctgaagtttgaattattataaatcacacactgtttgtggattacgaaaattacataaatgttctttatttttaagacatgttcttagaaaggagttttggtatcattcttaagcttcttttatatcaccgattaatacaagagacgatgaaattttagagaata

SEQ ID NO: 529 - DNA, 7610 bp, Gossypium raimondii; identical to SEQ ID NO: 528

SEQ ID NO: 530 - DNA, 14610 bp, Gossypium raimondii
ttaaattaattgactctaattgaattattataaaaattatattaataattatcgatttaaattcgtaatatataaacattaaaaggcaattagtaacgatattcaatgatcatatattctcattgaaaatcaatatataattaataacaatattaaaaaaaataaaaaagtaaaaaaatagcaaaaaaactgacttccggacgcgaccctccaaattcgtcacccagtaaggtacgactaagggacgattttcatcaatgttgacgttgtgcaaaagagttggactcatccatagtttcctcaataatgagggcaaattcgtcatctagagatttcactcaattagatatcctggatcgcgctaccgccaactcggcgggtcaagttcggttatgtttgtattcttcaacctgcttatttattcttcaccaaccatttagttgttaattagtttttaaataatatataatttttttgaataaataatatataaatttaaaattatataaaaagataaaaaataatattaattttaaaaaataaaaagtatcctaaattatatacataaaaataccaatgataatatacaaacaatgttataaaataatatataataatataagcagtattttgcataaatatatacaaaaaatatatcataataaataaataaaattatcatggttagatatatatattattttgtaaatcgataattatgaataaatcatatttatattatatacagaggcgaatttaggatgcttgcataagcccagcccaacccccctaaaatgaaaaattactatttagatcatttaatttttttaattttaaattaataaagataaaattgcacattaactcgtataaaattaaaaaaaatttgatttaatcttttaaaagttataaagatatagactataaaaaattaaaatttcgttcagcccctttaaagaattgttctggcttcgccactggttgtatatattaatcatatcaaccatacatccataaaaagcaatatacatcatatacatacgtcaaaattactattttttattataatatttatttcaaataataaataataaataataaaattaaaattattatgattatcacaaatttgttttaattataactattatcatattttttgatttttttaaaattaataattatttttaaatgtaaatttagtaatataatgaaaaataaaatatattttggtaagttccaaattcgtgcttatatattacagttaaataatattttatttaattttaaatttaatatttatttacaaattaacacaaagaataaagaatagaaaaaagagaggataaaaatgaaaacaaatcgggtattttctaaacgaaaaaggggtcagttcgggtttattttttacacccgaacccggcatgattcactaaaagagcgtgtccatttttacacgtccccgaacattgcgtcatcatctgcttctattataaaatgggctcattcattcctagcctctctgtactcaagagtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgtaactttctttctcgcatgtctccctatttgattttaagcctgtattttttctcgacatttttggcttgttgttctaatcggttttttttttttatatttgttaaaattttctttcttttttgcttgtatatgtctgcttccttccttttgacctatctatggatttaagttttcagtaattactttgaaaaaccgagggaaaccttcactgttaatggcttgcttaaacgaattccacttgtttagatcatattttttgaattctaatgttttcatgtttctgttctcttattcatttaccttgttcatccctgatacttgcattttcttctccaatattttaatcgctagttttccttgtcatttttctgccttgttttaatcgttttatattttggcacttcttagagctctgttttttatccgactttactatacactgaaggttttagtagttgcttttccttaaaaaaacccaagggaaagtttaactgttaatgatttgcttgactgagttgggctttttgttatttattgtctcgttaaattttattttcattggattttaatgtgtattttactcatctgttttcttatttatttacttgtctctttgtccatctctgttacttgcatcttcttctcgtctcttttgatggcctttggtgcttcattgcttataggttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcatgacattttacattttatccgatgtcattattgcttacctgtgatctttctggttgcctgtcactgcaggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacgtaactgcctgttgattgctgttaaacattgcttgctgttaaattgctgaaaccattttatatgacatcaaattaatacatttgaaacatcatttggcagatatactgaggtgggaaggtcttttttccatacatcattaggtcctagaggagaacttggtaatggaatagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgcgaaacatttccgacgatcaaacctgtcaaagccgctgtctgatcaagatcgtattaaagtattattacactgttttcttgcccttcgtatatattgaattcagtgtttattaatcaaaacttgcagaatatttttggaatgcttcttttgctgtattctttaggtgaaaaaggccttgaagggagtaagagttaagctcatctacatggattatgccaaaacttgcaagattattggagtatctagagaccctataagccagttgacgtgagtttgttgttataatactatacgtgctcaaaaatatttttagtaagctacttttatgtggcctgtgtggtagaattgtttttgggttatttgtagtcttgtattcactacttatctaagttccatcttcaaattgagttggtttttttttttttttttgtggttgacagtttttagtatttggcttggttatgtcttgttctaaaatattgtttatgcttgtgcatttgtaaaatcttgtgctatggtatatttgtcccattctgtctcattatgcttctgttcaatttttggcttttttagatttactcatgatgataagagaacaaatgtctctgtggtcaagtatttccgtgagaaatacaatgttgtgcttaaatatccatccttgcctgcacttcaaagtggaagcgaagctagacctgtctacctgccaatggaggtttttactttatatcaagatcttgttttttgttttctttttgtttgttactgattctcttgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaatttgttgataagatgagaattgtgattcatttggcatttcatgtttctgcagatggtccaggtcaataattttgaggtggaggagcttgttactaaagaatttggaatgcatgttcgcaaagaacttgcattgattaatgcacgagttctaaatcctccagtggtacttatatgccaatatgttatattttcaaggatactgtccgtcttataataagattaatgtcggttttggttgctgcagctaaagtatcacgatagtggacgtgacaaaattgttaatcctagctgtgggcaatggaacatgatcaacaaggtgatttttttttcttcccctcttattctttgaagtggcattatttgtaaaatttaaggaattagacctgtctcttcagtctcctcttgttccagagttcttgttcattttttttcaattcatttttaaggtttgcagcgtctcttctttgcagtttagtgtagctgtaagtcttttgggaaaattttgctaggttttaaggttcaacattttttttgcagaaaatggtcaatgggggtaaagttgatttctggtcttgtgtgaacttctcctctgaatataggaatatgtcagaagacttctgtgcggggctggtgaatatgtgtaacagcaaaggaatggtatgctgtgtggtttttttagtgtaggtggatggtacatctgttatttattcatcactagcttgatttccgattttgttactctaggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggtaagaaattctgatgttttgtaaataggtaattcctggggtttctttgcgcaactctaatctttttgtttgcaggaaaaataaagcgaatttgtgagacggagctaggtattgtttcacaatgttgtaagcctgcgcaagcttcaaagtttagcaaccaatattttgaaaatgttgctctcaagatcaatgctaaggtatctgttttgcctcactggtggtgatttgatatagtggtttcttgtcttgctatcttcttttaaatcatttgagaattgtaaattctgtaggttggggggagaaatactgtgctgaacgatgctgttttaaggagaattccgcttgtgactgatgtccctacaatcatttttggggcagatgtcactcatccgccgcctggcgaagactctagttcttctatagctgcagtaagcatattcattattctctatcatccccattttgttacttgatcatatttaagaggttattggctggctgcaggtcgttgcttcaatggattggcctgaggtaaccaagtatcgtggaattgtctctgcacagactcaccgggtggaaataatcgaggatctttataaacaaactagggatccacagaagggtttagttgagggtggaatggttaggtagggagatagatttatttcaggcttaaatttttagtttcttctggaagtgctctactttcttaacatttcaagttctctgcagggagttgcttcttgctttctacaggtcaacgaaacaaaagccttctagaattatcttctataggtaatgtttgcttttgaccatccaaatctatgtatatatttctagcagcagtgctgatatctgatttttgatgtgtggcagagatggtgttagtgaaggacaattcagccaagttttgctttatgaaatggatgcgattcggaaggtattgaaatcactgtataatttctattatagttagttcactgtataatggatgcaatgatttttggtgtttgggccttctgacccccgcagttttcttccttccaggcttgttcctcgctacaggaaggatatatgcctcgggttacatttgttgtggttcaaaagaggcatcatactcgcttattccctactgatcgcaacaaaactgataggagtggcaacatattaccaggtgattctaatcttataatagggatttgatcgtattctcttgatcttcattttgttagcatattttaatgtagccaataacttttaggtactgttgtggatactagcatctgtcatccaactgagtttgatttttatctcaatagtcatgctggaatccaggtaaaatgaggccttcccttgaagtgtgatggtttttatgttaattttgtccgatctgatattgatattgatgttgttgtgtaggggacaagcaagcccacacattaccacgttttgttggatgaaaatggcttcagtgctgacatcttgcaagtgctcacaaacaatttatgttacacgtatgtgtttactcctttctctataatcttgaaatggggtgaataaataatgctttagatcagcactagcaattatatagtaataattttactttgtggacaggtatgcgaggtgtaccaagtccgtttccataggtttgtgatgatgtttttttgtcttgttaaatttgttgactaaggttggttttgacagtaatatttggattatatgtttgcagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggagtctaattttggagtttttgttttggtggttgagcgacttgttgtctgaagtttgaattattataaatcacacactgtttgtggattacgaaaattacataaatgttctttatttttaagacatgttcttagaaaggagttttggtatcattcttaagcttcttttatatcaccgattaatacaagagacgatgaaattttagagaataatgtctttttattaagagtttttaaatgttcagtacacaaatggtaagatacgctcggaaatcctcactgctcctccttgcaactccaatgaataaaaaagcaaacctaatcaatttactttttaatttaccattttaataaacatagtaaatacaattttattaacttattaaataattttataaatttacatatttttaataatttcataaaagtgtgataattttaaaaacttttattatatataatttttaatctaatgttttcaatagttatattttattatcatatcactttacaattacgtttgaaattaaatatacacctcaccactgtttttattctcactgctattgctgtttttaactttaccgaagataaatgtatcgtccatcccaattaaaccttagtccatttatagtggtttttttacttcgttaaagctagacaaactatgccattaaaattttaatagcttaagtttagattggatgagcgatgcgtttattttcggtgagattaaaaacaacaatggtagttaaattagttactgtagcgatgaaattagatactgtagtagtgatattagaaattgcggtaaggtgtgtgtttagattcaaacgcaactataacgatgagttgagaatagaaaataactattaaagacattagatttatgagttctctctcctttcatcttttttttcacccttaaattctgttgatgaataaaaaatattctttaaatatcaaaggaaagctctcatttaatcctctcatctgattgtatgaaaacagttttgttcattcgtcagttattctgctctatcattgcttttatctgtttcatttttttccaatctaaaactaaaaaataagcaccatcttttccattcatgatgacacagaaggtgaagaaaattataaattttgattcatcaatgggtatgggtggttaaccaaaatagagaagataaaaaaagaagaagcaatgtttaaaataaaagtcattttcctttttttaaaaatatggatgattgataattttaaaaataattttcattattttcaccaaaatgttttgtagaattaaaaaagacgagaacaagagttttttaattttaaatgaacgagttcacaatgggttcaaatccatataaacacaaaaaaataattatttttcaacagtttttttttctaatattgaattcgataccctgatttgaatccatataaatacaaaatttattttattttattaaaacatgtttttatttctatttatcaattttaaaaaaaatagaaaatgaaaatcatgtttctatttaccaaatatttcacaaattaaactgactttaattgtttaaaaaaaagaaaaaaaattctattattttctggtgaagtagaaattaggaaagggaagggatgcttgctatggaaattgtggatggaaaaaaggaagttgtcaataaagaaaaaaaaaaatttttggtatttttttatgtccgttttattgtttatgtttggggttcgtggttgttcttctcaacaatgtcatcttcaatgtttaaatctatgtctcaaattaagaatacaatgtgccttaccattacacccaacacttgttggtaaaaaaaaagtttaaaatttatatgatattttaaaaacatatagataatttaatggtaaaattataattttatttttttgaaggataatgctaatattgtaattatatttattattgtaattttacataaaaattaaattaattaacttgtaacatcaactaagttaaatatttctttaagtattaaattatgtaaaaaatatattaataaataggtgaaatgaggttttggttgaacctgatttcttaagtttaacccttactaccctaactcaacgacattattttttgaaagaactcgatcaagattgctttttccgtagttacttttccttaaaaaaacccaagggaaagtttaactgttaatgatttgcttaaatgagttgggctttttgttatttattgtctcgttaatttttattttcattggattttaatgtgtattttccttttctgttttcttatttatttacttgtctctttgtccatctctgttacttgcatcttcttctcgtctcttttgatggcctttggtgcttcattgcttataggttactgtaacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcttgacattttacattatatccgatgtcataattgcttacctctgatctttctggttgcctgtcactgcaggaaggagcgacaatttaaggttgcaatcaaactggcctccaagccagaccttcattatctcagggagtttttgagcagaaagcattttgaatgtcctcaagaagctattcaagttctggatgttgttcttagagctaaaccatctcagatgtaactgcctgttgattaatgttaaacatttctggctattaaattgttgaaaccattttatatgacatcaaattaatacatttgaaacatcatttggcagatatactgaggtgggaaggtcttttttctatacatcattaggtcctagaggagaacttggtaatggaacagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgtgaaacatttccgacgatcaaacctgtcaaagccgctgtctgatcaagatcgtattaaagtacgtatatattgaattcagtgtttattaatcaaaacttgcagaatttttttgcaatgcttcttttgccgtattttttaggtgaaaaaggccttgaagggagtaagagttaggctcatctacatggattatgccaaaacttgcaagattattggagtatctagagaccctataagccagttgacgtgagtttgttgttataatactatacctgctcataaatatttttagtaagctacttttatgtggcctgtgtggtagaattgtttttgggttatttgtagtcttgtattcactacttatctaagttacatcttaaaattgagttggttttatttttattttttgcagttgacagtttttagtatttggcttggttatgtcttgttctaaaatattgtttatgcttatacatttgtaaaatcttgtgcttatggtacatttgtaccattctgtctcattatgtttctgttcaatttttggctgttttagatttcctcttgatgataagagaacaaatgtctctgtggtcaagtatttccgtgagaaatacaatgttgtgcttaaatatccatccttgcctgcacttcaaagtggaagtgaagctagacctgtctacctgccaatggaggtttttactttatatcaagatgatcttgtttttgttttctttttgtttgttactgattctcctgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaattggttgataagatgagaattttgattcattggcatttcatgtttctgcagatggtccaggtcaataattttgaggtggaggagcttgttactaaagaatttggaatgcatgttcgcaaagaacttgcattgattaatgcacaagttctaaatcctccagtggtacttttaagccaatatgttatattttcaaggatactgtcagtcttataatacgattaatgtctgttttggttgctgcagctaaagtatcacgatagtggacgtgacaaaatcgttaatcctagttgcgggcaatggaacatgatcaacaaggtggtatttttttttcttcccctcttctttgaagtggcattgtttgtaaaatttaaggaatcagacctgtctcttcagtctcctcttgttccagagttcttgttcattttttcaattcatttttaaggtagctataagtcttttgggaaaattttgataggttttaaggttcaacagttttttttttttttttgcagaaaatggtcaattggggtaaagtcgatttctggtcttgtgtgaacttctcctcggaatattggaatatgtcagaagagttctgtgcggagctggtgaatatgtgtaacaacaaaggaatggtatgctgtgtggttttttttagtgtaggtggatggtatatctgttatttatttatcactagcatgatttcccattttgtgactctaggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggtaagaaattctgatgttttgtaaataggtaattcctggggtttctttgcgcgactcaaatctttttgcttgcaggaaaaataaagcgaatttgtgagacggagctaggtattgtttcacaatgttgtaagcctgtgcaagctgcaaagtttagcaaccaatattttgaaaatgttgctctcaagatcaatgctaaggtatgtgttttgcctcactggtggtgatttgatatagtgttttcttgtcttgttatcttaattcatttgagaattgtaaattctgtaggttggggggcgaaatactgtgctgaacgatgctattttaaggagaattccgcttgtgactgatgtccctacaatcatttttggggcagatgtcactcatccgccgcctggcgaagactctagttcttctatagctgcagtaagcatattcattgttctctacatccccattttgttacttgatcatatttaagaggttattggctggatgcaggtcgttgcttcaatggattggcctgaggtaaccaagtatcgtggaattgtctctgcacagactcaccggatggaaataatccaggatctttataaacaaacaaaggatccacagaagggtttagttgagggtggaatggttaggtagggagatagatttatttcgggcttaattttttagtttcttctggacgtgctctactttcttaacatttcaagttctctgcagggaattgcttgttgctttcttcaagtcaacaagacaaaagccttctagaattatcttctataggtaatgtttgcttttgaccatccaaatatatgtatatacttctagcagcagtgctgacatctgatttttgatgtggcagaggtggtgttagtgaaggacaattcagccaagttttgctttatgaaatggatgcgatttggaaggtattgaaatcactgtataatgtctattatagttggttcactgtataatggatgcttctgacccctgcagttttcttccttccaggcttgttcctcgctacaggaaggatatatgcctcgggttacatttgttgtggttcaaaagaggcatcatactcgcttattccctactgatcgcaacaaaactgatgggagtggcaacatattaccaggtgattctaatcttataatagggatttgatcgtattctcttgatcttcattttgttagcatattttaatgtagccaataaattttaggtactgttgtggatactagcatctgtcatccaaccgagtttgatttttatctcaatagtcatgctggaatcctggttaaatgaggcttcccttgaagtgtgatggtttttatgttaattttgtccgatctgatactgatgttgttgtgtaggggacaagcaaggccacacgttaccacgttttgtttgatgaaaatggcttcagtgctgacatcttgcaagtgctcacaaacagtttatgttacacgtatgtgtttactcctttctctataatcctgtaatggggtgaataaataatgctttagatcagcactagtaattatatagtaataattttactttgtggataggtatgcgaggtgtaccaagtccgtttccataggtttgtgatgatgtttttttgtcttgttaaatttgttaacttaaggttggttttgacagtgaatatttgaattatatgtttgcagtgcctccggcatactatgctcacctcgctgcttatagggcacgctattatattgaggatgagatgtcggatagtgggtctactggtggaggccgaaagccgaaagacaaggttgtagagtttaggccgctccccagcataaaggacaatgtgaaggaagtgtttggttggtggaaagttgcgcaagtatagttgcacagtttgtggatgatggtggagtcttgttgattccattggtggactttgtaattatttaattttggagtttctgttttggtggttgagcgaattgtcgtctgaagtttggattaccataatgcacacactgtttgtggattacgaaaatttcagaaatgtcctgtattttcaagaaaagttcttagaaaggatttttagtattatttttaagtttcttttagatcaccaattaatacaagtgatgatgaaattttaaagaataa

SEQ ID NO: 531 - DNA, 14580 bp, Gossypium raimondii
aaattatattaataattatcgatttaaattcgtaatatataaacattaaaaggcaattagtaacgatattcaatgatcatatattctcattgaaaatcaatatataattaataacaatattaaaaaaaataaaaaagtaaaaaaatagcaaaaaaactgacttccggacgcgaccctccaaattcgtcacccagtaaggtacgactaagggacgattttcatcaatgttgacgttgtgcaaaagagttggactcatccatagtttcctcaataatgagggcaaattcgtcatctagagatttcactcaattagatatcctggatcgcgctaccgccaactcggcgggtcaagttcggttatgtttgtattcttcaacctgcttatttattcttcaccaaccatttagttgttaattagtttttaaataatatataatttttttgaataaataatatataaatttaaaattatataaaaagataaaaaataatattaattttaaaaaataaaaagtatcctaaattatatacataaaaataccaatgataatatacaaacaatgttataaaataatatataataatataagcagtattttgcataaatatatacaaaaaatatatcataataaataaataaaattatcatggttagatatatatattattttgtaaatcgataattatgaataaatcatatttatattatatacagaggcgaatttaggatgcttgcataagcccagcccaacccccctaaaatgaaaaattactatttagatcatttaatttttttaattttaaattaataaagataaaattgcacattaactcgtataaaattaaaaaaaatttgatttaatcttttaaaagttataaagatatagactataaaaaattaaaatttcgttcagcccctttaaagaattgttctggcttcgccactggttgtatatattaatcatatcaaccatacatccataaaaagcaatatacatcatatacatacgtcaaaattactattttttattataatatttatttcaaataataaataataaataataaaattaaaattattatgattatcacaaatttgttttaattataactattatcatattttttgatttttttaaaattaataattatttttaaatgtaaatttagtaatataatgaaaaataaaatatattttggtaagttccaaattcgtgcttatatattacagttaaataatattttatttaattttaaatttaatatttatttacaaattaacacaaagaataaagaatagaaaaaagagaggataaaaatgaaaacaaatcgggtattttctaaacgaaaaaggggtcagttcgggtttattttttacacccgaacccggcatgattcactaaaagagcgtgtccatttttacacgtccccgaacattgcgtcatcatctgcttctattataaaatgggctcattcattcctagcctctctgtactcaagagtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgtaactttctttctcgcatgtctccctatttgattttaagcctgtattttttctcgacatttttggcttgttgttctaatcggttttttttttttatatttgttaaaattttctttcttttttgcttgtatatgtctgcttccttccttttgacctatctatggatttaagttttcagtaattactttgaaaaaccgagggaaaccttcactgttaatggcttgcttaaacgaattccacttgtttagatcatattttttgaattctaatgttttcatgtttctgttctcttattcatttaccttgttcatccctgatacttgcattttcttctccaatattttaatcgctagttttccttgtcatttttctgccttgttttaatcgttttatattttggcacttcttagagctctgttttttatccgactttactatacactgaaggttttagtagttgcttttccttaaaaaaacccaagggaaagtttaactgttaatgatttgcttgactgagttgggctttttgttatttattgtctcgttaaattttattttcattggattttaatgtgtattttactcatctgttttcttatttatttacttgtctctttgtccatctctgttacttgcatcttcttctcgtctcttttgatggcctttggtgcttcattgcttataggttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcatgacattttacattttatccgatgtcattattgcttacctgtgatctttctggttgcctgtcactgcaggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacgtaactgcctgttgattgctgttaaacattgcttgctgttaaattgctgaaaccattttatatgacatcaaattaatacatttgaaacatcatttggcagatatactgaggtgggaaggtcttttttccatacatcattaggtcctagaggagaacttggtaatggaatagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgcgaaacatttccgacgatcaaacctgtcaaagccgctgtctgatcaagatcgtattaaagtattattacactgttttcttgcccttcgtatatattgaattcagtgtttattaatcaaaacttgcagaatatttttggaatgcttcttttgctgtattctttaggtgaaaaaggccttgaagggagtaagagttaagctcatctacatggattatgccaaaacttgcaagattattggagtatctagagaccctataagccagttgacgtgagtttgttgttataatactatacgtgctcaaaaatatttttagtaagctacttttatgtggcctgtgtggtagaattgtttttgggttatttgtagtcttgtattcactacttatctaagttccatcttcaaattgagttggtttttttttttttttttgtggttgacagtttttagtatttggcttggttatgtcttgttctaaaatattgtttatgcttgtgcatttgtaaaatcttgtgctatggtatatttgtcccattctgtctcattatgcttctgttcaatttttggcttttttagatttactcatgatgataagagaacaaatgtctctgtggtcaagtatttccgtgagaaatacaatgttgtgcttaaatatccatccttgcctgcacttcaaagtggaagcgaagctagacctgtctacctgccaatggaggtttttactttatatcaagatcttgttttttgttttctttttgtttgttactgattctcttgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaatttgttgataagatgagaattgtgattcatttggcatttcatgtttctgcagatggtccaggtcaataattttgaggtggaggagcttgttactaaagaatttggaatgcatgttcgcaaagaacttgcattgattaatgcacgagttctaaatcctccagtggtacttatatgccaatatgttatattttcaaggatactgtccgtcttataataagattaatgtcggttttggttgctgcagctaaagtatcacgatagtggacgtgacaaaattgttaatcctagctgtgggcaatggaacatgatcaacaaggtgatttttttttcttcccctcttattctttgaagtggcattatttgtaaaatttaaggaattagacctgtctcttcagtctcctcttgttccagagttcttgttcattttttttcaattcatttttaaggtttgcagcgtctcttctttgcagtttagtgtagctgtaagtcttttgggaaaattttgctaggttttaaggttcaacattttttttgcagaaaatggtcaatgggggtaaagttgatttctggtcttgtgtgaacttctcctctgaatataggaatatgtcagaagacttctgtgcggggctggtgaatatgtgtaacagcaaaggaatggtatgctgtgtggtttttttagtgtaggtggatggtacatctgttatttattcatcactagcttgatttccgattttgttactctaggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggtaagaaattctgatgttttgtaaataggtaattcctggggtttctttgcgcaactctaatctttttgtttgcaggaaaaataaagcgaatttgtgagacggagctaggtattgtttcacaatgttgtaagcctgcgcaagcttcaaagtttagcaaccaatattttgaaaatgttgctctcaagatcaatgctaaggtatctgttttgcctcactggtggtgatttgatatagtggtttcttgtcttgctatcttcttttaaatcatttgagaattgtaaattctgtaggttggggggagaaatactgtgctgaacgatgctgttttaaggagaattccgcttgtgactgatgtccctacaatcatttttggggcagatgtcactcatccgccgcctggcgaagactctagttcttctatagctgcagtaagcatattcattattctctatcatccccattttgttacttgatcatatttaagaggttattggctggctgcaggtcgttgcttcaatggattggcctgaggtaaccaagtatcgtggaattgtctctgcacagactcaccgggtggaaataatcgaggatctttataaacaaactagggatccacagaagggtttagttgagggtggaatggttaggtagggagatagatttatttcaggcttaaatttttagtttcttctggaagtgctctactttcttaacatttcaagttctctgcagggagttgcttcttgctttctacaggtcaacgaaacaaaagccttctagaattatcttctataggtaatgtttgcttttgaccatccaaatctatgtatatatttctagcagcagtgctgatatctgatttttgatgtgtggcagagatggtgttagtgaaggacaattcagccaagttttgctttatgaaatggatgcgattcggaaggtattgaaatcactgtataatttctattatagttagttcactgtataatggatgcaatgatttttggtgtttgggccttctgacccccgcagttttcttccttccaggcttgttcctcgctacaggaaggatatatgcctcgggttacatttgttgtggttcaaaagaggcatcatactcgcttattccctactgatcgcaacaaaactgataggagtggcaacatattaccaggtgattctaatcttataatagggatttgatcgtattctcttgatcttcattttgttagcatattttaatgtagccaataacttttaggtactgttgtggatactagcatctgtcatccaactgagtttgatttttatctcaatagtcatgctggaatccaggtaaaatgaggccttcccttgaagtgtgatggtttttatgttaattttgtccgatctgatattgatattgatgttgttgtgtaggggacaagcaagcccacacattaccacgttttgttggatgaaaatggcttcagtgctgacatcttgcaagtgctcacaaacaatttatgttacacgtatgtgtttactcctttctctataatcttgaaatggggtgaataaataatgctttagatcagcactagcaattatatagtaataattttactttgtggacaggtatgcgaggtgtaccaagtccgtttccataggtttgtgatgatgtttttttgtcttgttaaatttgttgactaaggttggttttgacagtaatatttggattatatgtttgcagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggagtctaattttggagtttttgttttggtggttgagcgacttgttgtctgaagtttgaattattataaatcacacactgtttgtggattacgaaaattacataaatgttctttatttttaagacatgttcttagaaaggagttttggtatcattcttaagcttcttttatatcaccgattaatacaagagacgatgaaattttagagaataatgtctttttattaagagtttttaaatgttcagtacacaaatggtaagatacgctcggaaatcctcactgctcctccttgcaactccaatgaataaaaaagcaaacctaatcaatttactttttaatttaccattttaataaacatagtaaatacaattttattaacttattaaataattttataaatttacatatttttaataatttcataaaagtgtgataattttaaaaacttttattatatataatttttaatctaatgttttcaatagttatattttattatcatatcactttacaattacgtttgaaattaaatatacacctcaccactgtttttattctcactgctattgctgtttttaactttaccgaagataaatgtatcgtccatcccaattaaaccttagtccatttatagtggtttttttacttcgttaaagctagacaaactatgccattaaaattttaatagcttaagtttagattggatgagcgatgcgtttattttcggtgagattaaaaacaacaatggtagttaaattagttactgtagcgatgaaattagatactgtagtagtgatattagaaattgcggtaaggtgtgtgtttagattcaaacgcaactataacgatgagttgagaatagaaaataactattaaagacattagatttatgagttctctctcctttcatcttttttttcacccttaaattctgttgatgaataaaaaatattctttaaatatcaaaggaaagctctcatttaatcctctcatctgattgtatgaaaacagttttgttcattcgtcagttattctgctctatcattgcttttatctgtttcatttttttccaatctaaaactaaaaaataagcaccatcttttccattcatgatgacacagaaggtgaagaaaattataaattttgattcatcaatgggtatgggtggttaaccaaaatagagaagataaaaaaagaagaagcaatgtttaaaataaaagtcattttcctttttttaaaaatatggatgattgataattttaaaaataattttcattattttcaccaaaatgttttgtagaattaaaaaagacgagaacaagagttttttaattttaaatgaacgagttcacaatgggttcaaatccatataaacacaaaaaaataattatttttcaacagtttttttttctaatattgaattcgataccctgatttgaatccatataaatacaaaatttattttattttattaaaacatgtttttatttctatttatcaattttaaaaaaaatagaaaatgaaaatcatgtttctatttaccaaatatttcacaaattaaactgactttaattgtttaaaaaaaagaaaaaaaattctattattttctggtgaagtagaaattaggaaagggaagggatgcttgctatggaaattgtggatggaaaaaaggaagttgtcaataaagaaaaaaaaaaatttttggtatttttttatgtccgttttattgtttatgtttggggttcgtggttgttcttctcaacaatgtcatcttcaatgtttaaatctatgtctcaaattaagaatacaatgtgccttaccattacacccaacacttgttggtaaaaaaaaagtttaaaatttatatgatattttaaaaacatatagataatttaatggtaaaattataattttatttttttgaaggataatgctaatattgtaattatatttattattgtaattttacataaaaattaaattaattaacttgtaacatcaactaagttaaatatttctttaagtattaaattatgtaaaaaatatattaataaataggtgaaatgaggttttggttgaacctgatttcttaagtttaacccttactaccctaactcaacgacattattttttgaaagaactcgatcaagattgctttttccgtagttacttttccttaaaaaaacccaagggaaagtttaactgttaatgatttgcttaaatgagttgggctttttgttatttattgtctcgttaatttttattttcattggattttaatgtgtattttccttttctgttttcttatttatttacttgtctctttgtccatctctgttacttgcatcttcttctcgtctcttttgatggcctttggtgcttcattgcttataggttactgtaacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcttgacattttacattatatccgatgtcataattgcttacctctgatctttctggttgcctgtcactgcaggaaggagcgacaatttaaggttgcaatcaaactggcctccaagccagaccttcattatctcagggagtttttgagcagaaagcattttgaatgtcctcaagaagctattcaagttctggatgttgttcttagagctaaaccatctcagatgtaactgcctgttgattaatgttaaacatttctggctattaaattgttgaaaccattttatatgacatcaaattaatacatttgaaacatcatttggcagatatactgaggtgggaaggtcttttttctatacatcattaggtcctagaggagaacttggtaatggaacagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgtgaaacatttccgacgatcaaacctgtcaaagccgctgtctgatcaagatcgtattaaagtacgtatatattgaattcagtgtttattaatcaaaacttgcagaatttttttgcaatgcttcttttgccgtattttttaggtgaaaaaggccttgaagggagtaagagttaggctcatctacatggattatgccaaaacttgcaagattattggagtatctagagaccctataagccagttgacgtgagtttgttgttataatactatacctgctcataaatatttttagtaagctacttttatgtggcctgtgtggtagaattgtttttgggttatttgtagtcttgtattcactacttatctaagttacatcttaaaattgagttggttttatttttattttttgcagttgacagtttttagtatttggcttggttatgtcttgttctaaaatattgtttatgcttatacatttgtaaaatcttgtgcttatggtacatttgtaccattctgtctcattatgtttctgttcaatttttggctgttttagatttcctcttgatgataagagaacaaatgtctctgtggtcaagtatttccgtgagaaatacaatgttgtgcttaaatatccatccttgcctgcacttcaaagtggaagtgaagctagacctgtctacctgccaatggaggtttttactttatatcaagatgatcttgtttttgttttctttttgtttgttactgattctcctgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaattggttgataagatgagaattttgattcattggcatttcatgtttctgcagatggtccaggtcaataattttgaggtggaggagcttgttactaaagaatttggaatgcatgttcgcaaagaacttgcattgattaatgcacaagttctaaatcctccagtggtacttttaagccaatatgttatattttcaaggatactgtcagtcttataatacgattaatgtctgttttggttgctgcagctaaagtatcacgatagtggacgtgacaaaatcgttaatcctagttgcgggcaatggaacatgatcaacaaggtggtatttttttttcttcccctcttctttgaagtggcattgtttgtaaaatttaaggaatcagacctgtctcttcagtctcctcttgttccagagttcttgttcattttttcaattcatttttaaggtagctataagtcttttgggaaaattttgataggttttaaggttcaacagttttttttttttttttgcagaaaatggtcaattggggtaaagtcgatttctggtcttgtgtgaacttctcctcggaatattggaatatgtcagaagagttctgtgcggagctggtgaatatgtgtaacaacaaaggaatggtatgctgtgtggttttttttagtgtaggtggatggtatatctgttatttatttatcactagcatgatttcccattttgtgactctaggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggtaagaaattctgatgttttgtaaataggtaattcctggggtttctttgcgcgactcaaatctttttgcttgcaggaaaaataaagcgaatttgtgagacggagctaggtattgtttcacaatgttgtaagcctgtgcaagctgcaaagtttagcaaccaatattttgaaaatgttgctctcaagatcaatgctaaggtatgtgttttgcctcactggtggtgatttgatatagtgttttcttgtcttgttatcttaattcatttgagaattgtaaattctgtaggttggggggcgaaatactgtgctgaacgatgctattttaaggagaattccgcttgtgactgatgtccctacaatcatttttggggcagatgtcactcatccgccgcctggcgaagactctagttcttctatagctgcagtaagcatattcattgttctctacatccccattttgttacttgatcatatttaagaggttattggctggatgcaggtcgttgcttcaatggattggcctgaggtaaccaagtatcgtggaattgtctctgcacagactcaccggatggaaataatccaggatctttataaacaaacaaaggatccacagaagggtttagttgagggtggaatggttaggtagggagatagatttatttcgggcttaattttttagtttcttctggacgtgctctactttcttaacatttcaagttctctgcagggaattgcttgttgctttcttcaagtcaacaagacaaaagccttctagaattatcttctataggtaatgtttgcttttgaccatccaaatatatgtatatacttctagcagcagtgctgacatctgatttttgatgtggcagaggtggtgttagtgaaggacaattcagccaagttttgctttatgaaatggatgcgatttggaaggtattgaaatcactgtataatgtctattatagttggttcactgtataatggatgcttctgacccctgcagttttcttccttccaggcttgttcctcgctacaggaaggatatatgcctcgggttacatttgttgtggttcaaaagaggcatcatactcgcttattccctactgatcgcaacaaaactgatgggagtggcaacatattaccaggtgattctaatcttataatagggatttgatcgtattctcttgatcttcattttgttagcatattttaatgtagccaataaattttaggtactgttgtggatactagcatctgtcatccaaccgagtttgatttttatctcaatagtcatgctggaatcctggttaaatgaggcttcccttgaagtgtgatggtttttatgttaattttgtccgatctgatactgatgttgttgtgtaggggacaagcaaggccacacgttaccacgttttgtttgatgaaaatggcttcagtgctgacatcttgcaagtgctcacaaacagtttatgttacacgtatgtgtttactcctttctctataatcctgtaatggggtgaataaataatgctttagatcagcactagtaattatatagtaataattttactttgtggataggtatgcgaggtgtaccaagtccgtttccataggtttgtgatgatgtttttttgtcttgttaaatttgttaacttaaggttggttttgacagtgaatatttgaattatatgtttgcagtgcctccggcatactatgctcacctcgctgcttatagggcacgctattatattgaggatgagatgtcggatagtgggtctactggtggaggccgaaagccgaaagacaaggttgtagagtttaggccgctccccagcataaaggacaatgtgaaggaagtgtttggttggtggaaagttgcgcaagtatagttgcacagtttgtggatgatggtggagtcttgttgattccattggtggactttgtaattatttaattttggagtttctgttttggtggttgagcgaattgtcgtctgaagtttggattaccataatgcacacactgtttgtggattacgaaaatttcagaaatgtcctgtattttcaagaaaagttcttagaaaggatttttagtattatttttaagtttcttttagatcaccaattaatacaagtgatgatgaaattttaaagaataatgt

SEQ ID NO: 532 - DNA, 14580 bp, Gossypium raimondii; identical to SEQ ID NO: 531

SEQ ID NO: 533 - DNA, 14580 bp, Gossypium raimondii; identical to SEQ ID NO: 531

SEQ ID NO: 534 - DNA, 14234 bp, Gossypium raimondii
aaattatattaataattatcgatttaaattcgtaatatataaacattaaaaggcaattagtaacgatattcaatgatcatatattctcattgaaaatcaatatataattaataacaatattaaaaaaaataaaaaagtaaaaaaatagcaaaaaaactgacttccggacgcgaccctccaaattcgtcacccagtaaggtacgactaagggacgattttcatcaatgttgacgttgtgcaaaagagttggactcatccatagtttcctcaataatgagggcaaattcgtcatctagagatttcactcaattagatatcctggatcgcgctaccgccaactcggcgggtcaagttcggttatgtttgtattcttcaacctgcttatttattcttcaccaaccatttagttgttaattagtttttaaataatatataatttttttgaataaataatatataaatttaaaattatataaaaagataaaaaataatattaattttaaaaaataaaaagtatcctaaattatatacataaaaataccaatgataatatacaaacaatgttataaaataatatataataatataagcagtattttgcataaatatatacaaaaaatatatcataataaataaataaaattatcatggttagatatatatattattttgtaaatcgataattatgaataaatcatatttatattatatacagaggcgaatttaggatgcttgcataagcccagcccaacccccctaaaatgaaaaattactatttagatcatttaatttttttaattttaaattaataaagataaaattgcacattaactcgtataaaattaaaaaaaatttgatttaatcttttaaaagttataaagatatagactataaaaaattaaaatttcgttcagcccctttaaagaattgttctggcttcgccactggttgtatatattaatcatatcaaccatacatccataaaaagcaatatacatcatatacatacgtcaaaattactattttttattataatatttatttcaaataataaataataaataataaaattaaaattattatgattatcacaaatttgttttaattataactattatcatattttttgatttttttaaaattaataattatttttaaatgtaaatttagtaatataatgaaaaataaaatatattttggtaagttccaaattcgtgcttatatattacagttaaataatattttatttaattttaaatttaatatttatttacaaattaacacaaagaataaagaatagaaaaaagagaggataaaaatgaaaacaaatcgggtattttctaaacgaaaaaggggtcagttcgggtttattttttacacccgaacccggcatgattcactaaaagagcgtgtccatttttacacgtccccgaacattgcgtcatcatctgcttctattataaaatgggctcattcattcctagcctctctgtactcaagagtcaagagtgtcgtttgtttcattttttgtcccttctgttttggagtttttgaaattttcatctgtttgcttagttttccaaatttccggcaatgtctggccgaggcggtggtgaacgtggcagtggtcggggtggtggtcgacgtggccgggggcagggccgtggtcgcggtcaaccttcgcagtcttcctctcgcggcggcggcggtagagcaagaggccgtggatcatctggttctactgcaacttataatccccctcctcctcaaatggctccggctcagccacctcctcaaatggctgtagctacgccagttcctccatcgggggcccctttttctcatccttcttcaagttctggtgtaggatcactttccagagaggtatcggagaagcttacaatggagccggtggctgtgactacggcgcctcctcttcctccgtcgtcgtcaaaggcgattaggttccctccaagaccggggttcggcacggtcggtacaaagtgtgtggttagggccaaccattttctcgtagatgttgctaatgccgatcttcatcactacgatgtaactttctttctcgcatgtctccctatttgattttaagcctgtattttttctcgacatttttggcttgttgttctaatcggttttttttttttatatttgttaaaattttctttcttttttgcttgtatatgtctgcttccttccttttgacctatctatggatttaagttttcagtaattactttgaaaaaccgagggaaaccttcactgttaatggcttgcttaaacgaattccacttgtttagatcatattttttgaattctaatgttttcatgtttctgttctcttattcatttaccttgttcatccctgatacttgcattttcttctccaatattttaatcgctagttttccttgtcatttttctgccttgttttaatcgttttatattttggcacttcttagagctctgttttttatccgactttactatacactgaaggttttagtagttgcttttccttaaaaaaacccaagggaaagtttaactgttaatgatttgcttgactgagttgggctttttgttatttattgtctcgttaaattttattttcattggattttaatgtgtattttactcatctgttttcttatttatttacttgtctctttgtccatctctgttacttgcatcttcttctcgtctcttttgatggcctttggtgcttcattgcttataggttactataacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcatgacattttacattttatccgatgtcattattgcttacctgtgatctttctggttgcctgtcactgcaggaaggagcgacaatttaaggttgcaatcaaattggcctccaagccagaccttcattatctgagggagtttctgagcagaaagcattttgaatgccctcaagaagctattcaagttctggatgttgttcttagagctaaaccatctcagacgtaactgcctgttgattgctgttaaacattgcttgctgttaaattgctgaaaccattttatatgacatcaaattaatacatttgaaacatcatttggcagatatactgaggtgggaaggtcttttttccatacatcattaggtcctagaggagaacttggtaatggaatagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgcgaaacatttccgacgatcaaacctgtcaaagccgctgtctgatcaagatcgtattaaagtattattacactgttttcttgcccttcgtatatattgaattcagtgtttattaatcaaaacttgcagaatatttttggaatgcttcttttgctgtattctttaggtgaaaaaggccttgaagggagtaagagttaagctcatctacatggattatgccaaaacttgcaagattattggagtatctagagaccctataagccagttgacgtgagtttgttgttataatactatacgtgctcaaaaatatttttagtaagctacttttatgtggcctgtgtggtagaattgtttttgggttatttgtagtcttgtattcactacttatctaagttccatcttcaaattgagttggtttttttttttttttttgtggttgacagtttttagtatttggcttggttatgtcttgttctaaaatattgtttatgcttgtgcatttgtaaaatcttgtgctatggtatatttgtcccattctgtctcattatgcttctgttcaatttttggcttttttagatttactcatgatgataagagaacaaatgtctctgtggtcaagtatttccgtgagaaatacaatgttgtgcttaaatatccatccttgcctgcacttcaaagtggaagcgaagctagacctgtctacctgccaatggaggtttttactttatatcaagatcttgttttttgttttctttttgtttgttactgattctcttgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaatttgttgataagatgagaattgtgattcatttggcatttcatgtttctgcagatggtccaggtcaataattttgaggtggaggagcttgttactaaagaatttggaatgcatgttcgcaaagaacttgcattgattaatgcacgagttctaaatcctccagtggtacttatatgccaatatgttatattttcaaggatactgtccgtcttataataagattaatgtcggttttggttgctgcagctaaagtatcacgatagtggacgtgacaaaattgttaatcctagctgtgggcaatggaacatgatcaacaaggtgatttttttttcttcccctcttattctttgaagtggcattatttgtaaaatttaaggaattagacctgtctcttcagtctcctcttgttccagagttcttgttcattttttttcaattcatttttaaggtttgcagcgtctcttctttgcagtttagtgtagctgtaagtcttttgggaaaattttgctaggttttaaggttcaacattttttttgcagaaaatggtcaatgggggtaaagttgatttctggtcttgtgtgaacttctcctctgaatataggaatatgtcagaagacttctgtgcggggctggtgaatatgtgtaacagcaaaggaatggtatgctgtgtggtttttttagtgtaggtggatggtacatctgttatttattcatcactagcttgatttccgattttgttactctaggtgtttcgccaaactccttcaattgcaatgcgatcagctcgtgctgatcgaattgatcagactctcatggatgtatacaaagagtctgcaggcttgaataagccacttaagttgttgataattatcttacctgatcagactggctcatatggtaagaaattctgatgttttgtaaataggtaattcctggggtttctttgcgcaactctaatctttttgtttgcaggaaaaataaagcgaatttgtgagacggagctaggtattgtttcacaatgttgtaagcctgcgcaagcttcaaagtttagcaaccaatattttgaaaatgttgctctcaagatcaatgctaaggtatctgttttgcctcactggtggtgatttgatatagtggtttcttgtcttgctatcttcttttaaatcatttgagaattgtaaattctgtaggttggggggagaaatactgtgctgaacgatgctgttttaaggagaattccgcttgtgactgatgtccctacaatcatttttggggcagatgtcactcatccgccgcctggcgaagactctagttcttctatagctgcagtaagcatattcattattctctatcatccccattttgttacttgatcatatttaagaggttattggctggctgcaggtcgttgcttcaatggattggcctgaggtaaccaagtatcgtggaattgtctctgcacagactcaccgggtggaaataatcgaggatctttataaacaaactagggatccacagaagggtttagttgagggtggaatggttaggtagggagatagatttatttcaggcttaaatttttagtttcttctggaagtgctctactttcttaacatttcaagttctctgcagggagttgcttcttgctttctacaggtcaacgaaacaaaagccttctagaattatcttctataggtaatgtttgcttttgaccatccaaatctatgtatatatttctagcagcagtgctgatatctgatttttgatgtgtggcagagatggtgttagtgaaggacaattcagccaagttttgctttatgaaatggatgcgattcggaaggtattgaaatcactgtataatttctattatagttagttcactgtataatggatgcaatgatttttggtgtttgggccttctgacccccgcagttttcttccttccaggcttgttcctcgctacaggaaggatatatgcctcgggttacatttgttgtggttcaaaagaggcatcatactcgcttattccctactgatcgcaacaaaactgataggagtggcaacatattaccaggtgattctaatcttataatagggatttgatcgtattctcttgatcttcattttgttagcatattttaatgtagccaataacttttaggtactgttgtggatactagcatctgtcatccaactgagtttgatttttatctcaatagtcatgctggaatccaggtaaaatgaggccttcccttgaagtgtgatggtttttatgttaattttgtccgatctgatattgatattgatgttgttgtgtaggggacaagcaagcccacacattaccacgttttgttggatgaaaatggcttcagtgctgacatcttgcaagtgctcacaaacaatttatgttacacgtatgtgtttactcctttctctataatcttgaaatggggtgaataaataatgctttagatcagcactagcaattatatagtaataattttactttgtggacaggtatgcgaggtgtaccaagtccgtttccataggtttgtgatgatgtttttttgtcttgttaaatttgttgactaaggttggttttgacagtaatatttggattatatgtttgcagttcctccggcgtactatgctcacctcgctgcttatagggcacgctattatattgaggatgagatgtcggatagtgggtctactggtggaggccgaaagccgaaagacaaggttgtagaggttaggccgctgcccagcataaaggataatgtgaaggaagtgatgttctacgtctgataaattatgtttggttgattgtgggaagttgcgcaagtatagttgcacagtttgtggatgatggtggagtctaattttggagtttttgttttggtggttgagcgacttgttgtctgaagtttgaattattataaatcacacactgtttgtggattacgaaaattacataaatgttctttatttttaagacatgttcttagaaaggagttttggtatcattcttaagcttcttttatatcaccgattaatacaagagacgatgaaattttagagaataatgtctttttattaagagtttttaaatgttcagtacacaaatggtaagatacgctcggaaatcctcactgctcctccttgcaactccaatgaataaaaaagcaaacctaatcaatttactttttaatttaccattttaataaacatagtaaatacaattttattaacttattaaataattttataaatttacatatttttaataatttcataaaagtgtgataattttaaaaacttttattatatataatttttaatctaatgttttcaatagttatattttattatcatatcactttacaattacgtttgaaattaaatatacacctcaccactgtttttattctcactgctattgctgtttttaactttaccgaagataaatgtatcgtccatcccaattaaaccttagtccatttatagtggtttttttacttcgttaaagctagacaaactatgccattaaaattttaatagcttaagtttagattggatgagcgatgcgtttattttcggtgagattaaaaacaacaatggtagttaaattagttactgtagcgatgaaattagatactgtagtagtgatattagaaattgcggtaaggtgtgtgtttagattcaaacgcaactataacgatgagttgagaatagaaaataactattaaagacattagatttatgagttctctctcctttcatcttttttttcacccttaaattctgttgatgaataaaaaatattctttaaatatcaaaggaaagctctcatttaatcctctcatctgattgtatgaaaacagttttgttcattcgtcagttattctgctctatcattgcttttatctgtttcatttttttccaatctaaaactaaaaaataagcaccatcttttccattcatgatgacacagaaggtgaagaaaattataaattttgattcatcaatgggtatgggtggttaaccaaaatagagaagataaaaaaagaagaagcaatgtttaaaataaaagtcattttcctttttttaaaaatatggatgattgataattttaaaaataattttcattattttcaccaaaatgttttgtagaattaaaaaagacgagaacaagagttttttaattttaaatgaacgagttcacaatgggttcaaatccatataaacacaaaaaaataattatttttcaacagtttttttttctaatattgaattcgataccctgatttgaatccatataaatacaaaatttattttattttattaaaacatgtttttatttctatttatcaattttaaaaaaaatagaaaatgaaaatcatgtttctatttaccaaatatttcacaaattaaactgactttaattgtttaaaaaaaagaaaaaaaattctattattttctggtgaagtagaaattaggaaagggaagggatgcttgctatggaaattgtggatggaaaaaaggaagttgtcaataaagaaaaaaaaaaatttttggtatttttttatgtccgttttattgtttatgtttggggttcgtggttgttcttctcaacaatgtcatcttcaatgtttaaatctatgtctcaaattaagaatacaatgtgccttaccattacacccaacacttgttggtaaaaaaaaagtttaaaatttatatgatattttaaaaacatatagataatttaatggtaaaattataattttatttttttgaaggataatgctaatattgtaattatatttattattgtaattttacataaaaattaaattaattaacttgtaacatcaactaagttaaatatttctttaagtattaaattatgtaaaaaatatattaataaataggtgaaatgaggttttggttgaacctgatttcttaagtttaacccttactaccctaactcaacgacattattttttgaaagaactcgatcaagattgctttttccgtagttacttttccttaaaaaaacccaagggaaagtttaactgttaatgatttgcttaaatgagttgggctttttgttatttattgtctcgttaatttttattttcattggattttaatgtgtattttccttttctgttttcttatttatttacttgtctctttgtccatctctgttacttgcatcttcttctcgtctcttttgatggcctttggtgcttcattgcttataggttactgtaacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcttgacattttacattatatccgatgtcataattgcttacctctgatctttctggttgcctgtcactgcaggaaggagcgacaatttaaggttgcaatcaaactggcctccaagccagaccttcattatctcagggagtttttgagcagaaagcattttgaatgtcctcaagaagctattcaagttctggatgttgttcttagagctaaaccatctcagatgtaactgcctgttgattaatgttaaacatttctggctattaaattgttgaaaccattttatatgacatcaaattaatacatttgaaacatcatttggcagatatactgaggtgggaaggtcttttttctatacatcattaggtcctagaggagaacttggtaatggaacagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgtgaaacatttccgacgatcaaacctgtcaaagccgctgtctgatcaagatcgtattaaagtacgtatatattgaattcagtgtttattaatcaaaacttgcagaatttttttgcaatgcttcttttgccgtattttttaggtgaaaaaggccttgaagggagtaagagttaggctcatctacatggattatgccaaaacttgcaagattattggagtatctagagaccctataagccagttgacgtgagtttgttgttataatactatacctgctcataaatatttttagtaagctacttttatgtggcctgtgtggtagaattgtttttgggttatttgtagtcttgtattcactacttatctaagttacatcttaaaattgagttggttttatttttattttttgcagttgacagtttttagtatttggcttggttatgtcttgttctaaaatattgtttatgcttatacatttgtaaaatcttgtgcttatggtacatttgtaccattctgtctcattatgtttctgttcaatttttggctgttttagatttcctcttgatgataagagaacaaatgtctctgtggtcaagtatttccgtgagaaatacaatgttgtgcttaaatatccatccttgcctgcacttcaaagtggaagtgaagctagacctgtctacctgccaatggaggtttttactttatatcaagatgatcttgtttttgttttctttttgtttgttactgattctcctgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaattggttgataagatgagaattttgattcattggcatttcatgtttctgcagatggtccaggtcaataattttgaggtggaggagcttgttactaaagaatttggaatgcatgttcgcaaagaacttgcattgattaatgcacaagttctaaatcctccagtggtacttttaagccaatatgttatattttcaaggatactgtcagtcttataatacgattaatgtctgttttggttgctgcagctaaagtatcacgatagtggacgtgacaaaatcgttaatcctagttgcgggcaatggaacatgatcaacaaggtggtatttttttttcttcccctcttctttgaagtggcattgtttgtaaaatttaaggaatcagacctgtctcttcagtctcctcttgttccagagttcttgttcattttttcaattcatttttaaggtagctataagtcttttgggaaaattttgataggttttaaggttcaacagttttttttttttttttgcagaaaatggtcaattggggtaaagtcgatttctggtcttgtgtgaacttctcctcggaatattggaatatgtcagaagagttctgtgcggagctggtgaatatgtgtaacaacaaaggaatggtatgctgtgtggttttttttagtgtaggtggatggtatatctgttatttatttatcactagcatgatttcccattttgtgactctaggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggtaagaaattctgatgttttgtaaataggtaattcctggggtttctttgcgcgactcaaatctttttgcttgcaggaaaaataaagcgaatttgtgagacggagctaggtattgtttcacaatgttgtaagcctgtgcaagctgcaaagtttagcaaccaatattttgaaaatgttgctctcaagatcaatgctaaggtatgtgttttgcctcactggtggtgatttgatatagtgttttcttgtcttgttatcttaattcatttgagaattgtaaattctgtaggttggggggcgaaatactgtgctgaacgatgctattttaaggagaattccgcttgtgactgatgtccctacaatcatttttggggcagatgtcactcatccgccgcctggcgaagactctagttcttctatagctgcagtaagcatattcattgttctctacatccccattttgttacttgatcatatttaagaggttattggctggatgcaggtcgttgcttcaatggattggcctgaggtaaccaagtatcgtggaattgtctctgcacagactcaccggatggaaataatccaggatctttataaacaaacaaaggatccacagaagggtttagttgagggtggaatggttaggtagggagatagatttatttcgggcttaattttttagtttcttctggacgtgctctactttcttaacatttcaagttctctgcagggaattgcttgttgctttcttcaagtcaacaagacaaaagccttctagaattatcttctataggtaatgtttgcttttgaccatccaaatatatgtatatacttctagcagcagtgctgacatctgatttttgatgtggcagaggtggtgttagtgaaggacaattcagccaagttttgctttatgaaatggatgcgatttggaaggtattgaaatcactgtataatgtctattatagttggttcactgtataatggatgcttctgacccctgcagttttcttccttccaggcttgttcctcgctacaggaaggatatatgcctcgggttacatttgttgtggttcaaaagaggcatcatactcgcttattccctactgatcgcaacaaaactgatgggagtggcaacatattaccaggtgattctaatcttataatagggatttgatcgtattctcttgatcttcattttgttagcatattttaatgtagccaataaattttaggtactgttgtggatactagcatctgtcatccaaccgagtttgatttttatctcaatagtcatgctggaatcctggttaaatgaggcttcccttgaagtgtgatggtttttatgttaattttgtccgatctgatactgatgttgttgtgtaggggacaagcaaggccacacgttaccacgttttgtttgatgaaaatggcttcagtgctgacatcttgcaagtgctcacaaacagtttatgttacacgtatgtgtttactcctttctctataatcctgtaatggggtgaataaataatgctttagatcagcactagtaattatatagtaataattttactttgtggataggtatgcgaggtgtaccaagtccgtttccataggtttgtgatgatgtttttttgtcttgttaaatttgttaacttaaggttggttttgacagtgaatatttgaattatatgtttgcagtgcctccggcatactatgctcacctcgctgcttatagggcacgctattatattgaggatgagatgtcggatagtgggtctactggtggaggccgaaagccgaaagacaaggttgtag

SEQ ID NO: 535 - DNA, 6579 bp, Gossypium raimondii
cgtccatcccaattaaaccttagtccatttatagtggtttttttacttcgttaaagctagacaaactatgccattaaaattttaatagcttaagtttagattggatgagcgatgcgtttattttcggtgagattaaaaacaacaatggtagttaaattagttactgtagcgatgaaattagatactgtagtagtgatattagaaattgcggtaaggtgtgtgtttagattcaaacgcaactataacgatgagttgagaatagaaaataactattaaagacattagatttatgagttctctctcctttcatcttttttttcacccttaaattctgttgatgaataaaaaatattctttaaatatcaaaggaaagctctcatttaatcctctcatctgattgtatgaaaacagttttgttcattcgtcagttattctgctctatcattgcttttatctgtttcatttttttccaatctaaaactaaaaaataagcaccatcttttccattcatgatgacacagaaggtgaagaaaattataaattttgattcatcaatgggtatgggtggttaaccaaaatagagaagataaaaaaagaagaagcaatgtttaaaataaaagtcattttcctttttttaaaaatatggatgattgataattttaaaaataattttcattattttcaccaaaatgttttgtagaattaaaaaagacgagaacaagagttttttaattttaaatgaacgagttcacaatgggttcaaatccatataaacacaaaaaaataattatttttcaacagtttttttttctaatattgaattcgataccctgatttgaatccatataaatacaaaatttattttattttattaaaacatgtttttatttctatttatcaattttaaaaaaaatagaaaatgaaaatcatgtttctatttaccaaatatttcacaaattaaactgactttaattgtttaaaaaaaagaaaaaaaattctattattttctggtgaagtagaaattaggaaagggaagggatgcttgctatggaaattgtggatggaaaaaaggaagttgtcaataaagaaaaaaaaaaatttttggtatttttttatgtccgttttattgtttatgtttggggttcgtggttgttcttctcaacaatgtcatcttcaatgtttaaatctatgtctcaaattaagaatacaatgtgccttaccattacacccaacacttgttggtaaaaaaaaagtttaaaatttatatgatattttaaaaacatatagataatttaatggtaaaattataattttatttttttgaaggataatgctaatattgtaattatatttattattgtaattttacataaaaattaaattaattaacttgtaacatcaactaagttaaatatttctttaagtattaaattatgtaaaaaatatattaataaataggtgaaatgaggttttggttgaacctgatttcttaagtttaacccttactaccctaactcaacgacattattttttgaaagaactcgatcaagattgctttttccgtagttacttttccttaaaaaaacccaagggaaagtttaactgttaatgatttgcttaaatgagttgggctttttgttatttattgtctcgttaatttttattttcattggattttaatgtgtattttccttttctgttttcttatttatttacttgtctctttgtccatctctgttacttgcatcttcttctcgtctcttttgatggcctttggtgcttcattgcttataggttactgtaacgcctgaggtaaccgcaaaaaaggttaacagagcaataatgaagcaacttattgatgtatacaaagagtcgcatcttggacgtcggtgtccagcttatgatggcaggaagagtttgtacactgctggtcctcttcccttcgagtcaaaggagcttgttatcaagctacctgaggaagatcgcagtgctggttcgtctaggcctgcgcggtaatattattgtatcctatgatggtctcttgacattttacattatatccgatgtcataattgcttacctctgatctttctggttgcctgtcactgcaggaaggagcgacaatttaaggttgcaatcaaactggcctccaagccagaccttcattatctcagggagtttttgagcagaaagcattttgaatgtcctcaagaagctattcaagttctggatgttgttcttagagctaaaccatctcagatgtaactgcctgttgattaatgttaaacatttctggctattaaattgttgaaaccattttatatgacatcaaattaatacatttgaaacatcatttggcagatatactgaggtgggaaggtcttttttctatacatcattaggtcctagaggagaacttggtaatggaacagaatactggtctggatattatcagagtcttcgacccactcagatgggtttatctcttaatattggtaggtactttgattgctcagtttgtgtagccactttgttcctaatgtttcagtatgaagatttactggttttgctttgcagatgtgtctgctcgatcattctatgagccaattttagtttcagagtttgttgtgaaacatttccgacgatcaaacctgtcaaagccgctgtctgatcaagatcgtattaaagtacgtatatattgaattcagtgtttattaatcaaaacttgcagaatttttttgcaatgcttcttttgccgtattttttaggtgaaaaaggccttgaagggagtaagagttaggctcatctacatggattatgccaaaacttgcaagattattggagtatctagagaccctataagccagttgacgtgagtttgttgttataatactatacctgctcataaatatttttagtaagctacttttatgtggcctgtgtggtagaattgtttttgggttatttgtagtcttgtattcactacttatctaagttacatcttaaaattgagttggttttatttttattttttgcagttgacagtttttagtatttggcttggttatgtcttgttctaaaatattgtttatgcttatacatttgtaaaatcttgtgcttatggtacatttgtaccattctgtctcattatgtttctgttcaatttttggctgttttagatttcctcttgatgataagagaacaaatgtctctgtggtcaagtatttccgtgagaaatacaatgttgtgcttaaatatccatccttgcctgcacttcaaagtggaagtgaagctagacctgtctacctgccaatggaggtttttactttatatcaagatgatcttgtttttgttttctttttgtttgttactgattctcctgtatgattttgttttacagctttgtagtatcgttgagggtcaaagatacacaaaaaaactaaatgaacaacaagttagatctctgctgagagcaacttgtcaacgtccgaacattagggaggggaatattacaaaggtactacagttttggatgcttattattttttaaattggttgataagatgagaattttgattcattggcatttcatgtttctgcagatggtccaggtcaataattttgaggtggaggagcttgttactaaagaatttggaatgcatgttcgcaaagaacttgcattgattaatgcacaagttctaaatcctccagtggtacttttaagccaatatgttatattttcaaggatactgtcagtcttataatacgattaatgtctgttttggttgctgcagctaaagtatcacgatagtggacgtgacaaaatcgttaatcctagttgcgggcaatggaacatgatcaacaaggtggtatttttttttcttcccctcttctttgaagtggcattgtttgtaaaatttaaggaatcagacctgtctcttcagtctcctcttgttccagagttcttgttcattttttcaattcatttttaaggtagctataagtcttttgggaaaattttgataggttttaaggttcaacagttttttttttttttttgcagaaaatggtcaattggggtaaagtcgatttctggtcttgtgtgaacttctcctcggaatattggaatatgtcagaagagttctgtgcggagctggtgaatatgtgtaacaacaaaggaatggtatgctgtgtggttttttttagtgtaggtggatggtatatctgttatttatttatcactagcatgatttcccattttgtgactctaggtgttttgccaaactccttcaattgcaatgcgatcagcttgtgctgaccgaattgatcagattctcatggatgtatacaaagagtctgcaggcttgaataagccacttcagttgttgataattatcttacctgatcagactggctcttacggtaagaaattctgatgttttgtaaataggtaattcctggggtttctttgcgcgactcaaatctttttgcttgcaggaaaaataaagcgaatttgtgagacggagctaggtattgtttcacaatgttgtaagcctgtgcaagctgcaaagtttagcaaccaatattttgaaaatgttgctctcaagatcaatgctaaggtatgtgttttgcctcactggtggtgatttgatatagtgttttcttgtcttgttatcttaattcatttgagaattgtaaattctgtaggttggggggcgaaatactgtgctgaacgatgctattttaaggagaattccgcttgtgactgatgtccctacaatcatttttggggcagatgtcactcatccgccgcctggcgaagactctagttcttctatagctgcagtaagcatattcattgttctctacatccccattttgttacttgatcatatttaagaggttattggctggatgcaggtcgttgcttcaatggattggcctgaggtaaccaagtatcgtggaattgtctctgcacagactcaccggatggaaataatccaggatctttataaacaaacaaaggatccacagaagggtttagttgagggtggaatggttaggtagggagatagatttatttcgggcttaattttttagtttcttctggacgtgctctactttcttaacatttcaagttctctgcagggaattgcttgttgctttcttcaagtcaacaagacaaaagccttctagaattatcttctataggtaatgtttgcttttgaccatccaaatatatgtatatacttctagcagcagtgctgacatctgatttttgatgtggcagaggtggtgttagtgaaggacaattcagccaagttttgctttatgaaatggatgcgatttggaaggtattgaaatcactgtataatgtctattatagttggttcactgtataatggatgcttctgacccctgcagttttcttccttccaggcttgttcctcgctacaggaaggatatatgcctcgggttacatttgttgtggttcaaaagaggcatcatactcgcttattccctactgatcgcaacaaaactgatgggagtggcaacatattaccaggtgattctaatcttataatagggatttgatcgtattctcttgatcttcattttgttagcatattttaatgtagccaataaattttaggtactgttgtggatactagcatctgtcatccaaccgagtttgatttttatctcaatagtcatgctggaatcctggttaaatgaggcttcccttgaagtgtgatggtttttatgttaattttgtccgatctgatactgatgttgttgtgtaggggacaagcaaggccacacgttaccacgttttgtttgatgaaaatggcttcagtgctgacatcttgcaagtgctcacaaacagtttatgttacacgtatgtgtttactcctttctctataatcctgtaatggggtgaataaataatgctttagatcagcactagtaattatatagtaataattttactttgtggataggtatgcgaggtgtaccaagtccgtttccataggtttgtgatgatgtttttttgtcttgttaaatttgttaacttaaggttggttttgacagtgaatatttgaattatatgtttgcagtgcctccggcatactatgctcacctcgctgcttatagggcacgctattatattgaggatgagatgtcggatagtgggtctactggtggaggccgaaagccgaaagacaaggttgtagagtttaggccgctccccagcataaaggacaatgtgaaggaagtgtttggttggtggaaagttgcgcaagtatagttgcacagtttgtggatgatggtggagtcttgttgattccattggtggactttgtaattatttaattttggagtttctgttttggtggttgagcgaattgtcgtctgaagtttggattaccataatgcacacactgtttgtggattacgaaaatttcagaaatgtcctgtattttcaagaaaagttcttagaaaggatttttagtattatttttaagtttcttttagatcaccaattaatacaagtgatgatgaaattttaaagaataa

SEQ ID NO: 536 - DNA, 2967 bp, Gossypium raimondii
atgggttttcaaatttttggatttcaaaaggttgtttttcaatatgtgaagtgttttgagatacttcttctgaaaagtgtggcacaccgagtctccggcgccgaattcgtaagtttctgaaactgttgtttgttttcattgaaaagcagtagatagagatactgtgattttttagacattagactgtattgctacacttaaacttacagcatgtttggttgggtgtattggcatactaatcagtgggccccacttaagacacctctattccgttgtttggttcatggtaatgctattacgcttgtaacacaatactaacctaatcggtgaaatccaccgatttgtaatacatcccatttgctcagattaggtgctgcatcgtttgccctccctgttttaccctcccgattggcttccccattgcgtctcctcttccttccttctaccttctgcccatttgctcaagtttcgatcgatttgctccctctgtctctcaaccttttcttttgtttttctttacaaccagtcactctttcttttctttttctctctgtcactccttcgattggccttctcaaccagtcgacctttttcttttctttttctctctgtcactctttcgattgctctcaattggtgggtttccaggttactgctactgaaaggtaaaggttactgccttgttagtgcattgacttcttcatcaattattgcagtgttaacctaatcagtttccccttttttgattacaggttcttcttcattgcactcttccccgatttgctcattacaggttagtttctccgattgcatgtttatcttcaactttttgagcttcgaagttgctggagttacggactaaagccaagatttttgttcaaaaaggaaggtctatgatgggatgtctggatgaaactagaaccttgaattatggccaagtttttgtgcagttttctggctctagatctaaccaacgtgatattgttcagggtaaggtaattgttgccaaaaacccctacttgcacccaggcgatgtacgtgtattaagggctgtcaatgtgcctgatttgcaccatatggtcgattgtgttgttttccatagaaaggaaccaggtacgtaaagggcatactctacgttttcttgctactttgagaaagtgtttgttcttcattatactttgcaaaagctgccttttattttgttcctatcgttttagtgtatgattctagcttcttcttttttgtcccttattggtggacttatcattgattgttatgcagtagtaaaatgcatgtttcttttcatcttggtggaacttgttgagcatttcctttacaagcagagtattattgaattgcagattagctatacttgtattcttttgcatatttgtgttaaatcctgcccaatttatggaagctatctggtgtttttcagtgtctttacacataataacaagatggtaggcttgattgtattctgtaatatttcacaatgcatggtgatttgctgacactaaatagaatcaaatttttagacctcatcccaatgaatgctctggaactgatctggatggtgatacttactttctctgttgggaccctgaattgattccatataagcaaatcgatgctatggattattcacccgctccaacaaccaaattggatcatgaagttaccattgaggtaatagctttttaggtattgaagtatttagttatattccacttgaatttatctaatagttatgacttttgattatcctcttctcttgttatagtttcttgatgctgaaatgcatgattcttgctctctcccccctccaacatttttttcggttccaagatgtcattggtttaacattcttctagattcttacaagtttattctgtcaattagcactcgtataatagttataatgacttgaactgtgtgttattttgagagttgttttcaacattatttttcgttgggtattttgtataaatccgcttggaatatgtgctgaaaagtttcttgatacttaagttcacattacgaaggctctaaactagtgaaatttttactcaggctcaagtttattatttgtatttgtattatgttgtaatccattctttgtgcttgcgtccttttttgaactgatatctattgggtttgctttactgtattttgttgggctgtgtagatataattatgagatttttgataattgctacatgttggtgtaggaaattgaagaatacttcacaaactacatagtcaatgacaatttgggaataatttcaaatgctcatactgcttttgctgatagagaacctgacaaagttgttttctattgcagttgactttccgaaaacgggtgtaccagctgaaataccacaagacttgagggtcaaagaatttccgaatttcatggagaaaccagacaagccaagttatcaatcacacaatgttattggaaagctttttcgagaggtgaagaaccttgcacccaatgaatgctcgattaagttcttaactcgggaaaagatgcagaggttttatgatcccgacatggaagttgaaggctttgaggattatatcgacgatgctttcttctacaaaagtaaatacgattacaaattggggaatttgatggactattgcagggtcaaaacggaggctgaaatactcagtgggggtatcatgaaaatgtcgagatcttttacgaagaaaagagatgcagaagcgatcagcatggcagtgagatcattgagaaaggaagctaggtcatggttcaatgaaaaaagaagtgagttggatgaagaaatagatgatgcatatgcaaaagcctcagcttggtactatgtcacatatcatccaagttattggggtcagtataatgagggaatgaatagggatcatttcttgagctttccttggtgtgtttatgacaagttggtccagatcaagaaagaaaatgca

SEQ ID NO: 537 - DNA, 6192 bp, Gossypium raimondii
aaacaaaatcgctgacgtggccaaaagccattcgctattagatagggaagccaatggaaaattggaaaaatatataataatttaatgttaaacgtgtgacgtggccagccgaagcgatttgcagaacatcctgcaatgtggggtgcgacggaggaaatcacggcatttttcttcgtctatttgagtaaattgactaaaatagttgacaatccaggattctaagtaaagttggagtcttttatgttactctcactctaatatcaatggagtttgggtttagttatcgttatgactgatcattcatcttcttcttctctttggtaaagcctctttcttttctttcttctcttaataatgattgaaactagacgttcaatttgaaactgagttacaatttatttttctttgataaacgttaaaatctttcttcttcatggatattgggcgcagcctttttctcttattctgctttttaaatactgatttccttttcttttttctgttttgaaagtgtttgtttgggcagagggactgcaaatcctcattcgcattcatgtaaaatccacatatgtctgtgctataaaatttatcttctagtgatttagccattagttatggtaccgtgttagataggagtgactgcccggcatgagttctgttgaaatccgtttaactatttgaatgtgatcctgtagttggtgaagttcgcttttatatatctggagaatattctatatccatatttcatttattaaggggtaggacttgtcaagatcgaacttaaatatatagttcaatatatatatatatatatatatatatatatgatatggataatttaggaaaaatgaaaaaaaaaatggataacataggccattacaggtaaaaagctttgattgttttgttgcttcttttccttgttctttatgaaagtttgattgttgtttctttgaacagcagcttaacttgtctcccatgttggtgcatttgaaggtttttatttatatattggtctctggtttttgcagttaattaattgtatgctgtaaggtggtaagagcacagagtgaattgagacaatgggtaagacgattcaggtttatgggttcctctcaaatgtgtctgcaggagaagtaaagacatttttagagggatatacgggcagagaaactgtttatgccctgaagatcaggcagcataaaaagggtggaagagcatatgctattgtgcagtttaccagaagctctgctgcagagctaattataaggttggctaatcaaaggctatactatgggagatcatatcttaaggctcgagaaatggagaccgacatcgtgccaaagccgagagcctttttgcacacaatggaacgtgttacggtgaattttggctgtcaagtctctgtagaaaaattttatgttctctggaaagcagaaaatgttactctaaattttgggactggaatgcggaaattggaatttctagtgtcgtattgtaggtcaaaatacaagcttgagctcttctatgagaacatctggcagattgagctgcgttgtcctgacagtcaaacctcaaagcatcttctgattcaggttgctttgctaaactttcatcataaattcatcattagtctctattgtattatccttgcttcctagaaataagagttcaacataacatcattgcttccagataacaggcgtcctcaatcagtcagctgcatatatcatatttcttttgctgatcattagtcttctattaaatcattgagatgccaacttggtaattggatgacattattatatccatgtaaattatatagagtttttcatttctgttgatctagggcgctagatctttttggcaatcgaaaactaataactggtgcaaatcaatatatactcgagaaggggtacagatcagcccatattttactgttaagattaataggcagttcaaaatggtgatagctagatggatttaatattgtcttatgaaacttgtctcatgcaaggttgttgatggactattcagtagccatacctgaggaactaacttcttcattgcaagaagtttctgctattcttttgatgctcaatgcaatttcttaaagttttatctcttacaaatgataattgcttgtgttgctttgtggtttccttttaatttttattttagttatttggcgctccccggatatatgagaaagaagtgcgtgcttctgaacttgtatttgatgatcccttgcttaactatttcaaggatgtgcctgatgatcaatgggtaaggacaacggatttcactcgttctaattgtattggacaatcttctgtattatgcttggagcttcctcacaacctccgacttccaaattttcgggagaactttgcttattacaaagaaaatgaaagcagattggttttggaaagtggttcttcttactcctgcaatcttagtctagtcccaattgtatgccctttgcgggtaattgacttgccatttgaaatcttgttcaaggttaatctgttggtgcaaaatgggtgcatcccaggaccagcacttgatgatactttttatcgattggttgatccttgtagaatggacaaagtctacatagaccatgcgctggagaaactttattatctaagagaatgctgctatgaaccttcgaggtggctctttgaggagtacaaaaatttctcaagatcgaggaaatatcaaggttcacctgctatatccttagatgaaggtttggtatatgtaagaagggttcagataacgccttctagggtctacttttgtggtcctgagattaatgtttcaaaccgtgtgctacgccaattccataatgatattgataattttcttcgcatcagttttgttgatgaagagttggagaagatccattcaataaatgtgcaggcaaggggtaggagaactagtatttacgaaaggattctttctactcttagaaatggcgtactgattggggataagagatttgaatttcttgccttttcatcaagtcaattacgggagaactcagcctggatgtttgcttcaagaaaggggctcactgcagcagatataaggtcatggatgggaaattttagtaaaataagaaatgtggcaaaatatgctgctagactgggccaatctttcagttcatcaactgaaactcttagtgtttctaaagatgaaatcaaccttattccagatatagaaattatgaaggatgggattaaatacgtcttttcagatggaattggaaaaatatcagctaaatttgctaagaaggtggcagctaaatgtcggttgaagggttgcactccatctgcctttcagattcggattggtggattcaagggtgttgtggctattgacccgacctcatcttggaaattatccctcagaaagagtatggaaaagtatgaatcagagaacactaaactggatgttttggcttggagtaagtatcagccatgttttctgaaccgccagttgattaccctgttatctactcttggagttccagaccgtgcttttgagaaaaaacaaagagaagtaattgagcaactcaatgctctcctgacggatcctttagaggctcaggaggctctggagttaatgtctccaggagaaaatactaacattctgaaggaaatgctcttgtgtggttataagcctgatgctgaaccattcctttcaatgatgttggaagcttttcgagcttcgaagttgctggagttgcggactaaagccaggatttttgttcaaaaaggaaggtctatgatgggatgtctggatgaaactagaaccttgaattatggccaagtttttgtgcagttttctggctctagatctgagcaacgttgtattgttcagggtaaggtaattgttgccaaaaacccctgcttgcacccaggcgatgtgcgtgtattaagggctgtcaatgtgcctgatttgcaccatatggtcgattgtgttgtttttccacagaaaggaaccaggtacgtaaagggcatactctaccttttcttgctactctgagaaagtgtttgttcttcattatactttgcaaaagctgccttttattttgtttctatcgttttagtgtatgattctagcttcttcttttttgtcccttattggtggagttatcattgattgttatgcagtagtaaaatgcatgtttcttttcttcttggtggaacttgttgagcatttcctttacaagcagagtattactgaattgcagatttgctatacctgtattcttttgcatatttgtgttaaatcctgcccaatttatggaagctatctggtgcttttcagtgtctttacacataataacaagatggtaggcttgattgtattctgtaatatttcacactgcatggtgatttgctgacactaaaatggaatcaaatttttagacctcatcccaatgaatgctctggaagtgatctggatggtgatatttactttgtctgttgggaccctgaattgattccatataagcaaatggatcctatggattattcacccgctccaacaaccatattggatcatgaagttaccattgaggtaatagtttttttaggtattgaaatattcagttatataccacttgaatttatctaatagttatgacttttgattatcttgttctcttgttatagtttcttgatgctgaaatgcatgattcttgctctctccccccctccaacatttttttcggttccaggatgtcattggtttaacattcttccagattcttacaagttcattctgtcaattggcactagtataatagttataatgacttgaactgtgtgttattttgagagctgttttcaacattatttttcgttgggtattttgtataaatccgcttggaatatgtgcagaaaagtttcttgatacttaagttcacattacgaaggttctaaactagtgaaatttttactcaggctcaagtttattatttgtatttgtattatgttgtaatccattccttgtgcttgcgaccttttttgaactgatatctattgggtttgctttactgtattttgttgggttgtgtagatataattatgagatttttgataattgctacatgctggtgcaggaaattgaagaatacttcacaaactacatagtcaatgacagtttgggaataatttcaaatgctcatactgcttttgctgatagagaacctggcaaagcaatgtgccacccgtgcctggagcttgcaaagctgttttcaattgcagttgactttccgaaaacgggtgtaccagctgaaataccacaagaactgagggtcaaagaatatccggatttcatggagaaaccagacaagccaagttatcaatcacacaatgttattggaaagcttttccgagaggtgaagaaccttgcacccaatgaatgctcgattaagttcttaactcgggaaaagatgcagaggttttatgatcccgacatggaagttgaaggctttgaggattatatcgacgatgctttcttccacaaaagtaaatacgattacaaattggggaatttgatggactattacggggtcaaaacggaggctgaaatactcagtgggggtatcttgaaaatgtcgagatcttttacgaagaaaagggatgcagaagcgatcagtatggcagtgagatcattgagaaaggaagctaggtcatggttcaatgaagaaagaagtgagttggatgaagaaatagatgatgcatatgcaaaagcctcagcttggtactatgtcacatatcatccaagttattggggtcagtataatgagggaatgaatagggatcatttcctgagctttccttggtgtgtttatgacaagttgatccagatcaagaaagaaaaagcagctgttcgggaagctttggatttgtcgtctctggaacatcgctttcaacgtagattgcatttgcattgaggtgttctggcttatgtttcctgtttactgtagtaggtaaatgtgggtagctcatgtttcctaacgacactgaatgttatatatataatgtataaacatatccagtttagtttggattgtgcatgttttggacctgttgtaaaaataagagatcggattagtttggttgaatcgaaaacgtgtgatctgcatatttagtgtgtatcatttaaaatcctttgaac

SEQ ID NO: 538 - DNA, 2242 bp, Gossypium raimondii
ttagtttctccgattgcatatttatcttcaacttttcgagcttcgaagttgctgaagttgcggactaaagccaggatttttgttcaaaaaggaaggtctatgatgggatgtctggatgaaactagaaccttgaattatggccaagtttttgtgcagttttctggctctagatctgaccaacgtgatattgttcagggtaaggtaattgttgccaaaaacccctgcttgcacccgggcgatgtgcgtgtattaagggctgtcaatgtgcctgatttgcaccatatggtcgattgtgttgtttttccatagaaaggaaccaggtacgtaaagggcatactctacgttttcttgctactctgagaaagtgtttgttcttcattatactttgcaaaagctgccttttattttgttcctatcattttagtgtatgattctagcttcttcttttttgtcccttattggtggacttatcattgattgttatgcagtagtaaaatgcatgtttcttttcttcttggtggaacttgttgagcatttcctttacaagcagagtattactgaattgcagattagctatacctgtgttcttttgcatatttgtgttaaatcctgcccaatttatagaagctatctggtgttttttagtgtctttacacataataacaagatggtaggcttgattgtattctgtaatatttcacaatgcatggtgatttgctgacactaaatagaatcaaatttttagacctcatcccaatgaatgctctggaagtgatctggatagtgatacttactttgtctgttgggaccctgaattgattccatataagcaaatcaatgctatggattattcacccgctccaacaaccaaattggatcatgaagttaccattgaggtaatagcttttcaggtattgaagtattcagttatattccacttgaatttatctaatagttatgacttttgattatcctcttctcttgttatagtttcttgatgctgaaatgcatgattcttgctttctccctcctccaacatttttttcggttccaggatgtcattggtttaacattcttctagattcttacaagttcattctgtcaattggcactagtataatagttataatgacttgaactgtgtgttattttgagagttgttttcaacattatttttcgttgggtattttgtataaatccgcttggaatatgtgcagaaaagtttcttgatacttaagttcacattacgaaggctctaagctagtgaaatttttactcaggctcaagtttattatttgtatttgtattatgttgtaatccattctttgtgcttgcgtccttttttgaactgatatctattgggtttgctttattgtattttgttgggctgtgtagatataattatgagatttttgataattgctacatgctggtgcaggaaattgaagaatacttcacaaactacatagtcaatgacagtttgggaataatttcaaatgctcatactgcttttgctgatagagaacctgacaaagctattttcaattgcagttgactttccgaaaacgggtgtaccagctgaaataccacaagacttgagggtcaaagaattttcggatttcatggagaaaccagacaagccaagttatcaatcacacaatgttattggaaagcttttccgagaggtgaagaaccttgcacccaatgaatgctcgattaagttcttaactcgggaaaagatgcagaggttttatgatcccgacatggaagttgaaggctttgaggattatattgacgatgctttcttctacaaaagtaaatacgattacaaattggggaatgtgatggactattacagggtcaaaacggaggctgaaatactcagtgggggtatcatgaaaatgtcgagatcttttacgaagaaaagagatgcagaagcgatcagcatagcagtgagatcattgagaaaggaagctgggtcatggttcaatgaaaaaggaagcgagttggatgaagaaatagatgatgcatatgcaaaagcctcagcttggtactatgtcacatatcatccaagttattggggtcagtataatgagggaatgaatagggatcattcctgagctttccttggtgtgtttatgacaagttggtccagataagaaagaaaatgcagctgtttcgggaagctttggatttgtcgtctccggaacatcgctttcaacatggattgcatttgcattga

SEQ ID NO: 539 - DNA, 15035 bp, Gossypium raimondii
tccgatggtgttcttcgagtcttttcttcaatcttctctgaatacccccttagatattcttctagttgatatttgtagactttagaatgttcaaaaagcctaaaaattagttttttccgcgtgtttgggaaatgaggtgcgatatcgacatgggctggcacatgggcgtgtggccagcccatgtggaagtgcccaggccgtgtggattctggaaacagctctatttgtccgattttttctcgtttttcgttccttttgctcccaaatgttctcctaagtatagaaacgtgaatttaagatattaggagcatcaaattcactaatttacattattaatcatccaaaaatgcattaaaaatgagattaaatatgttacttttatagcttatcaatttctctaagtccttggtgatttatggtccatagagtttctacaaaaactcgatttgtttggagctcttttgcatccgttgtttcaagtaagagatgtttccactaccacatgagcaatgatttgtatggagatttgctacatcgtgatttttattgatggttgagagtgtcgtttggctgaaagggttgtgataacatgccagcgtctttaattatttatgatttaaataaggaggccaaattcaaacaaagaaagcttgttttattcctcataaattttaagttatttttccttttggggctatgtttagttcgagaccgaaatctgcgactactttctccgttttatataactagatttttgactttgctggccattgtgtatacgatggcaaagttttctaactccacaaataaaaaaaactgctacttgtcttatttaattagtttttattttttaaagtatagttttattttttaaagtatcatataattatcgataaaaaatatttaaaagtaaagtaactttaggagttgtttaaattacaaattaagtaattgatttttaggttaaattttgctattaatcctcgtattttgtaaaagttatggattgagttctaatactttaatttgatcatttttaatttttatactttttaaaatttaaaattgatgataactgttaaattcattaagttaatttttattatttctaaaatttaatgcgctaaacataatatcacatgtgtaatgtcatgtcagcttgttattttcacatattgtttactaaaaatctagttaatggattaacaattgtcatttgggttgagattgaaattttaaaatttgcgatttagaatgattcaattgaaaaatatgaattaaatctataattgtagaagactaataattaaattgaaacaaataaatataatggttattatttaatttagactaaaatttcaaaattaaagaaaaaaataggggaatttaatatattgtttattaatttgttttagagaataaaagaaaccattctccactgtttaattttgattttatttatgaaatttcggatttccgagtgggagacgagattcggcagttcgactcattaataagcgaacaaatgtaatgataaaaaattgttggaagaggagttaccagatttgactttccattgaccgagcacaattcattacaagaaatcctaggagaccgctctgcttagtaaaccgaatgggatttcgacatctatttgtccatttgatcaaagcaaacaaaaatctttttttctttttgcttagcggttgagacttggaaaataagcaatttttaccagtcttctcaccgctgtggctataattccctcgttgatgccgggcggcgaattgtccaccgacgggaccgagccgttcatggcctctaaagttaaagccttttctactccgtcgccgatcgttgaaatcagccgaaaagatgaacctataatggaaaagaaagagaaggatccacgaaaaattgctagaaagttagtctctctttcacttccctatacatgtaaatatctatgcttatttgctccggttttttctttatgcaatgtggctttgccttggttctctttatttatttttttatttctttgcacgagttcagttaaattaaacgagagctatctgtttggcttgagggaagtgggaagatgggggaagggggttggagggaaaacatgaaaaataaaaaaccttgttagatgtttctgtttcaaaaacatcgaaagccaaaaaaaaaaaaaaatgcactgtttatttggagtgctgtttccgacaacctgtgagaagcttttatatatttaatttagtttttatatatttaaaaatcacgtcgggttttatgctttcatttaaggtatcaactggagttatgcaagaaagccatggaagagaacataattgtttatttggagactggttgtgggaagacccacatcgcagttctgcttatttatgagcttggccatttgatacggaaacctcagaatagggtatgcatttttcttgctcccacagtggctcttgttcagcaggtgagctactttctatgattttctgcattaatactctattgtcgggaattattagtttataatattgttttggctaagtttgggatttaggaaccaacttggatcatcattcgtcaattgtggattctttgcagcagtggaccatgcatggtttttaatggaatttgttattgttttatagcaagcccgggttatagaagattctcttgatttcaaggttgggacttattgtggtaactgcagacacttgaagaaccatcatgactgggaaatagagatcaaagaatatgaggttattatgttctttgattgacacaagtttataatttatccacgtgttgttcaacatcctatgttgtccacgtgtcattcgacatcctatgttgaaagcttaactataaagagatatgtcttatgaagtttaccaattttaatttattacacttgaccaaatatgttatcggtttttcttcctccacccccctcccccttatagaagatttttaattaggattatggaccctcgagctttcatcatcctcgccttatatttctattcatgttgaattttttgtacaggttcttgttatgactccccaaatactacttcgtagcttatatcactgcttcatcaggatggacttaatcgctcttctgatatttgatgagtgtcatcatgctcaaataaaaagcaaccatccttatgcagaaatcatgaaagtaaagtgctacatgaagtcacatttgtattctcaatgataaatttatattagtctttatcagttgatgtattttgattctgtagattacttgacaatcatgtaggttttttatgataaagctactgcatcaatgcttcctcgtatatttggaatgacagcatctcccgttgttggtaaaggtaattaaaaattgcatttcttttgaaacaaaagtctgaattattacatggatcagccatctccttttcaattcctttcggtacaaaaacttttcccattggaagtacgagaaattaaaggtgttttgaaatgtgttgtgtgtaaaggcagaatcaatcaagaaaataaattcgaatgcctacttttttatggaaaatgtgtttggtaaatgaaaaaaaatgttcttttctaaaaatgtccgtgaaatatgtttgatatcactaaacatttaaaaatgagaggaaaggttaaagaaataaataaaatatccaatgatattattcttgatttcaaatttctcaactttttcttttgtaattttataagcttttgttaaagagatttgagtagacaggaacaaatgagattgtaaatagttcaagatgcctctagagacaaaaaaggaaaaagaaagcagttaagggaataattactgctaatggcttctagttataaatattaacatatattattaattaatggcttcaaatagtgtttaattatgagtcaacttaacttgcaaagtgccaagcaaagaagtaatggacatcccgcgttttcaaaattgaaaagatgtcttttttttttggttgtttattctcatatttgaacccattttcattattgttttctaaaaacttgtttccgttttcaattatgctacgcttttcagtttatatgatacaaatatattggatgatattgcatcttgtagtgctcttcaatgatatattttcctctttaatcgataggctgttttagttattagttgttatctcatcttttgatagctacttctttgattaccttatcttacgcattcagatgcttccagtcaagtaaatttacctaaaagcatcaacagcctcgaaaacttgcttgatgctaaggtgagtctttgaaactttcactttgtgaaatctggtttggtgcaatctcttgttttccttctaaaaactaattatggttgaagatagggagctaagttcaatcataattcctacatgatgaataaaactcgtaaacagcatttcatgtatgtcatgggaagatgtttggtgcctaaacgtttccttgttaaattagaataaatgtagcttgtgaagatactattcttagtttatgtagctgggtttttgtaatgctgtttgaaaatgctatgcctacttaacttgtgtttgttagcctgaattgaggactttggttcagtcaaccttttccagactttcataagctggagtagtggcaggtcataattcatcttgatttagtgagtcaatgaggacaagaagatctatttggctttctgccttctcacttgagtgcaactgatcccaatttacttgatctcactaacatatatgtttagctataggagaactgtctgtttcttccgtttggtggacaaatgtgtttggtcctcttcataattgcgctaatcagtcttccagtagaactgcttaggttgaagtacagaaatatcttaccttgagtcattgtggtcagtaatgttactataactgttttaaggattcaagcaaccactgtaattttggccaggtggagtaatgtttattgttgtcatatcgtcgtaatcattttctttctcttcctcttccccttgctctgtgtgactgtgctaccatatatctttggagatgcaaaaaccaaagtttccttttcaatgaggaatgtttccataaactagactttttagttataatcaaaaccggggagggggggggggcggattcttttcttaaaccaatttctgttctgatatagatgctcagagtagtcaattttctaatatttcacatgccgcaaattgtaggtatattcagttggagataaggaggaattggaaagctttgtagcatctcctgtggttagagtatatgattatggtcctgtcaattttggttcttcttgttccaccattatctattgtagtaaacttgaggagattaagcgccaggtgtgtttcagtgacacatttgcactctcttgattatcttggaagaagttgtatttatttattcatttattttttctgtttctttatggcaagagcagtgcataccttttgtcaggaagaatggtgatattcaatctgccaggaacacaaaaaagctgctcaacagaatgcatgataatataatcttttgcttggaaaatttgggcatttggggagcattgcaagtaagatcttgtgaaaacaattgaatttcttggttctgttaatttgcagttgagagcctttcccttgcaattaaataatctgctattagtgttactttgattcttatttcatattctgcaacttttttctatttatctgaattatattcacaaactctgtactctggcaaaatcatgttggagaataccaaatagagtagaacattagattcacatgctatttaataaggctttatttttataaggtgtcgtattcataggtcattacttgctacttttttttttgtgcactgccaataagcagtgactaattattttttattctttcatttaatttgtatcagttctagcttgttgcagacttgcaggtagttgctgattaaagtatccaaggaaattctgatttatttccaccttctgcattttgtaggcttgccgacttcttttaactggtaataactctgagaggaatgaattgatagaagatgaagggattttaagtgacgactctgtatgtgatcgatatcttgttcatgctgctgatgtttttgcttcagattgtacgagaggtataatctttttaggccttttaaattctagcttcaacttcgttgtagctattgtctggtttcttggtggctctatacccaattatgtgttcatcaaagttcagttatgcaggagagatatgggatcagtgtagggactttttagtagtagcttcaacttaattctgccttctgtctctgttaattgatggccgcattacgatttgctacaccattgtaacttgtatgtattaaacttctagtaatcagtgggattttttttttgggtaaatggagatccttagatttttgaatttatatgctctgcttattgtttcagtcaacttgagtaagaatctgagctattagtctttgttgctgatattgtagatggatctgcaaacgatttatctgatgtagagattttgaaggaaccatttttctcgaaaaagctgctacgtcttgttggaattctttccaccttcaggtttgtattcaagcatgtatagtggtttttggttattttatagatatattgcatggaaactctatcggaccatttcaatggttatagtacttggtaaacaaatattatgacttatgtagttcttgcaacactaggaggcaagagaagggacttaatgcatgaggggtgatgtactgatgttaattcattttaactatgttgacacgtctcatttctttctatctggttactttcaaacaaactctactgctgcattttttcatgcctttaagctttttgcttttctcattatttaactaacaaggtgtatcatacacatatttctctcacaaacttctataattacttttacaggttacagccaaatatgaaatgcataatttttgtgaataggattgttactgcaagatccttgtcatacatactgcaaaaccttaagttcctattattttggaagtgccattttcttgtgggagtccactctggacttaaaagtatgtcaagaaagacaatgaaaaacattcttgagaagttcagaacaggagaggtaacccttctgttagtgttaatattccttggtcactcagctccttccaattcgtgaattttcacatcattgaattgttacttttatctctgcattttagcggactagctcagtttatcctttaggcacaatgtgggcagattttgtgttttttgacatccacatatcatttctataaatgttttcctaaggaagtgcatttcctaatgtctcgaagttattatgagacagaagctcattcattcagtctttgttcttgtaatttgagcctctagttctagttggttgtagcttatgtgatgtttgaaggataatggtaacaattaggaaaaccttgtgtaagtattgttaacggttctgtgtcagttgaattaatttattccaatgtttaaaaaactggactagacgtcaaaccagtgagacctccgtttattggttcaactgggcagactggttgaactggctagttgtgctaaataattattgaatatagtaaatatctaataaaactgatttaatgttgattcaagggaataaatgctctaatctcatcacatacgataaaatttagaaaagtccaacatctgtttttacgttttttactggttaaatgggttttatatactggaccagacaggcaattggttcctggttcaaccagtttgcctggcaggtctgtctggtttttttacactaatttatttttgattccttgaatgctgacttggcagttgaatcttttgattgcaactaaagtcggtgaagaaggacttgacattcagacatgctgccttgtgatacgttttgaccttccagaaactgttgcgagctttatccaatcaagaggacgtgcaagaatgcctctctctgagtatgcatttctggtgaacaggtgctattcataaaagtatatgctatttgaaggtctgtcaatttggttctctttctgtaattgggaaaaaataagatctctttctcttaactttgcagtgggaacgagaaggaactagatttgattaaaaattttaagaaagatgaagatcgtatgaatgtggaaatttctttcagaacatctactgaggtttctattggtcttgaggagagaatctatatggttgattcatctggtgcttccatcagttcaggatatagtatctctctacttcatcattactgctcaaaactgccccatgatgagtatgccttactttttcgttcttacctgcttttgaacttataatgtcactatatatgtttcttgtggaaattcatttactaatttagattatccacgtgaatataattttcaggtactttttccccaagccaagcttttattattttgaagattcaggaggaacaatctgcaatataatattaccttcgaatgctccaataaatcaaattgccagtacacctcaatcttcagttaatgctgccaaaaaagatgcttgtctaaaagcaattgaagaattgcataaattgggagccttgactgaccatctcttgccactgcaaaacagtgttcttgaggaggaaacattgctggtgtcttctgattctgggagctctgaaggttgatgcagagcaactttgtagtcttattcttttcttcttctttttggttgggtgactggtatagaattaatcacttttgctcgtctttaatctcagcaaaatttgattttggttttcagcagatgaggattcacgaggtgaactacatgagatgcttgttcctgctgtgcttaaagaatcatggactaacttagagaactgtgtcctcctttatgcttactatataaaatttaatccgaatcctaaggacaggagctataaagagtttgctctctttgtcaagtctcctctccctaaggaggctgagagaatggagctggatcttcacctatctcggcgtaggtcggtgatgacaaagcttaccccatctggagttgcagaatttaagagagaagaggtaacaatgttttgtttctgtcagactttgttctaattatcttactaccaaaactcactgtgtatctgtgcatatgcagatcatgcaggcacagcattttcaagaaatgttcttcaaggtcatccttgatagatcagaactcctttctgaatttattactttaggaaatgtctttctttcatcaagctcctcaacattctatttattgcttcctgttattctctccaattgtgagaataaagtgacagtggattgggggattgtccaaagatgtttgtcgtctccactttttaagcctcctgttgcagctgcaaagattgaaaatttcccttcagatgtttgcttgcaccttgtaaatggttgtaggagtataagagacattgagaatagtttggtgtatgccacacacaagagggccttttactttattactagcattgttggtgaaaaaaatggttacagcccatatagagattcaggcactttaaatcacgtggagcacttaaacatgttggtagctccactcttgattcacaactgttattaacgttatcagaatagtttatggggaggttatgctcaccaagttgtttagattaggtttttatctagtattcaattgataaagtgttaacttgaatgttgtcaatcaggtctggcattcatcttaagtaccctgaacaacctcttctgcatgcaaaaccactttttaagttgcacaatttgctccacaaccgaaagccggaggattcaggtagcttctcgtttgctttgctttcattcttgtcattgttcccttttcactaagtatgttgcttgttatactggattatttgtgttcaagatatgatattctagaccttgctaccatcttcatgggtatattgctatttgttttgtcagattgcattattttttcatgatgggaacaagatttatggttcattattgatagattagtgctacattgcctgtaattgacatgaaatgcctgatttattgttaattatttgttaatgattgtccttttctgatttttcttcttcttcatcagaaaacactagaaaacaagaaattaccaatttgaagtagtcttatagccatgcagcttatttgatgtgcaagagatatcttgaactgtattcttttggaaatgagaaatgctcaagttgggcgattgagtgagactatgagttctcacatggcggtgaagattgaggattaatctttcttttccaatcctagacttaaggattactagctagtaagtagaatcaggctattgcaacaataaaacgctttacaaccggccttgctggccattctttaatctgcttcagcacttggattaatggggctattggtttttgtctgaatcttccctggaaatatactagtatatcgttaaaatgttatctttaatacaacctttttagtatcaaaagcttgagtcattctggatcccccctgccccccaaaggaaaaaaaggtccttctcattttctctatcagtaaatcaaacaaaagggaaatatgttttgttgattttctctgtcttttcatttcttaaggctgttctttgttgtaaacagaagcaaatgaactggaagaatacttcattgatttgcctcctgagctttgtcagctgaaaataataggcttctccaaagagatagggagttcgctttctttgttaccatcaattatgcatcgcctggagaacttgcttgtggctattgaactgaagcatgttttttctgcttcatttgccgagggagctgaagttactgcccttagggtaagacctaagtccacgtgatattatgactagtgcttttggttaagtgtctgttaagttagttactgtgctagtccaatcatttaatcaagaaatgcaagcatctccatgaatgttatctatgactaacagtttgaaatggtgttaggtcctagaagcacttactacagagaagtgtcaagagcgtttttctcttgaaaggcttgagacacttggtgattccttcctcaagtttgctgtggcccgccatctttttcttttacatgatgcacttgatgaaggggaattgactaggagaaggtctaatgttgtaaataattctaatttattcaagctggcaacaaggcgaaatttacaggtttgattgtgttttagaaagtgatattcttatacagaagttttgacttctgttatgaatagcataattgttatatttttgagaaattttacctgttggtcaacatactatttcaaacatagaacatttttacgattccagtctgccattcttcactgctaacaaatgtggagtagttgcattaaatgctaaggtgcatgttcatgtcactcatccaatatggataaattatcttagacctgtagacatagaagattatagaaaaatgtggtatttactaaaatgattaaactaagaaacaatgtgtgtagttagaaccctctccttgattttggaattgttagcatcagccgttgaaggagtttcgggtgtattcaaatgctttacgttcatgccacttggaatggataatttgaacctaagaagatttaatatgtctatgtctatttggtgttttaagataaataattaatatttacggttctgtgtttccactaaatttcaggtttacatacgtgatcaaccttttgatccttatcagttctttcccttgggccatccctgcccagtaatttgtacaaaagaaactaaaggaactgttcacccacaatctagttgtcaagtagatcatacaaagagtgaagtcaaatgtagtagaaatcaccattggctacataaggacacaatttctgatgtggttgaggctcttgtaggagcatttatagttgataggggcttccaagcggcaacagcatttcttagatggataggcatacgagtggacttccaaggttctcaacttaatagtatttgcgctgcaagcaagagatttatgccactttcctccctattggatattggagatcttgaaaatttgttgggttaccagtttcttcataagggtctcctccttcaggcgattgtgcatccttcttttaataggcatgggggaggctgctaccaggtatgcaatatgtctgcttttctacttaaggaaatcagactctctttatgttttgtatttttcacctgccttgtcatttttataacattctattttctgatgcaacaattaataatactttgatacttttccagagattggagtttcttggagatgctgtcttagattatttaattacatcatatctgttttcactgtatccaaagttgaaacctggtcagttgactgatttgagatcagtgtcagtgaacaacaagtcctttgccaatgttgcagtggacagacgcttacacaaatttcttatgtgtgactcttgtcacctcaacgaggccatagaaaaatatgttgacttcatcacatcatcatcaccagacaggggattgtttgaagggccaaaatgtccgaaggtaagaattactagctgttgtatcttatgccccctgatgcatgctttcctctttccccccaagatataatgaattttagccatctttatataatgcaagttacaaatgcaaagctttattcctaacctatgatcattggattttctttttccttttaatttaagttaacgaggtctaggtggaatacaatattctaattaaagcttgcaactaaattatgttcatgcttattgtcttatttgtttaagagaatacatatgctggattatgataaatttaaaaaataattatgagcatttggtagaatgcagtataataatcgaagcaaatcttttttggagctgattatgctattttcttgtttgaggacgaagatgtgggtggctgattttgattctttgagtttgatttatgagagctaggtggaactgatattatgataaaagcaaatctgtgtaagaacacaatgctgctgcacaatacttcaagaagggtttttaatttaatagctttaatgtattgatacaggctcttggtgacttggtagagtcttgtttcggtgctattctccttgatacagggttcaacttgaaccgtgtttggaagataatgctatccattctggatccaatcaagagcctttcaagtgtgcagctcaatcctatcagggaagtacaggagctttcccagtgttataactgggatttgcagtttctagttgcaaaagttggtagaaatttttcagtggatgcaaaggtaaatgcaggagatgtacctctatgtgtttcttacagcaacattaatagaaaagaagctatcagaactactgcacatcaactatatgtaaagttaaaggtaacaggtgccctgcatactttcctattccctcttcttgatgccattaaaacatgatgctttttgaatatgtactcatatttggttccttttagaagttaatatcatttatagcccagtcttagtgtaggtatattccaaacttgtgaagcttgccttatattgcaggtcgataaatgattgtgaatttgcgacttaatccccgtctcttcttgtctttgaatgtacaggctctaggatatgcacccaaatcaaagtccttggaagaagttttgaagggaagccccaagaatgaagccaagctgattggatacgatgaaacacccattgatgtcagtgttactgacatagttggatttgaaaacatgaaattgcaagaatctcttgtgaatgatttcaaccccaaaactcgttctattaaaaggacaacttctagcggtgtatcttgcatctcacctggtagcagacctccaccttcttttgaagtaaaagcagcaaggggttcagcctctggtattgaagccaaaggcaaaccccccaattgctccattgtggatcctagttgtgggattgactcgccatccaaaggtaaatgattgttacactttttgtgactagtcagtgtggagcaattatcttatttgcctcttaatttctcaggtgaatcacatggtcgtactgctagatcacagttatacgaaatctgtgctatcaattgctggaaaccccctttgtttgaatgttgcaaagaggaaggaccaagtcatttgagatcgtaagtacacgacgcatatatactagaaaagacagctgaaaagtctccattaggacagttcgaaagatgggaacttcaaactacatccctcttgaataattttactcaaatcctatatattcaaaatcttttgcagattcacttacagggtaatagttgaaatcgaagaagctccagatatgatattggagtgcttcagcagtcctcggaccacaaagaaggcagcagccgagcatgcagcggaaggtgcactctggtatttaaaacatggaggatacttacaataggtcaacttaaccgactgaacctcattgctagacataatggagatcaaggtttgaatttagtcattttgctatctcagttcaatggctctagtctctctcttcatcccctatttaatgaacttaaaaaccagcattttctttaaaagtcgaataaaagatgatttaacaacaaaattaaaattttgcttcgaacttgttaacgtggcatttttggtatgtccatgtatccaacaaggagcccaatttaattcaatccatgtatctggtgctgtgtcatgaaagtgtaaagattaaatttattaaactcgagatagaggattaaagctattcaattgagataataagatgatcgaatttagatttcaaactcaaatatgtttgatgatgtctatattgatggctgtta

SEQ ID NO: 540 - DNA, 13863 bp, Gossypium raimondii
tgtaatgtcatgtcagcttgttattttcacatattgtttactaaaaatctagttaatggattaacaattgtcatttgggttgagattgaaattttaaaatttgcgatttagaatgattcaattgaaaaatatgaattaaatctataattgtagaagactaataattaaattgaaacaaataaatataatggttattatttaatttagactaaaatttcaaaattaaagaaaaaaataggggaatttaatatattgtttattaatttgttttagagaataaaagaaaccattctccactgtttaattttgattttatttatgaaatttcggatttccgagtgggagacgagattcggcagttcgactcattaataagcgaacaaatgtaatgataaaaaattgttggaagaggagttaccagatttgactttccattgaccgagcacaattcattacaagaaatcctaggagaccgctctgcttagtaaaccgaatgggatttcgacatctatttgtccatttgatcaaagcaaacaaaaatctttttttctttttgcttagcggttgagacttggaaaataagcaatttttaccagtcttctcaccgctgtggctataattccctcgttgatgccgggcggcgaattgtccaccgacgggaccgagccgttcatggcctctaaagttaaagccttttctactccgtcgccgatcgttgaaatcagccgaaaagatgaacctataatggaaaagaaagagaaggatccacgaaaaattgctagaaagttagtctctctttcacttccctatacatgtaaatatctatgcttatttgctccggttttttctttatgcaatgtggctttgccttggttctctttatttatttttttatttctttgcacgagttcagttaaattaaacgagagctatctgtttggcttgagggaagtgggaagatgggggaagggggttggagggaaaacatgaaaaataaaaaaccttgttagatgtttctgtttcaaaaacatcgaaagccaaaaaaaaaaaaaaatgcactgtttatttggagtgctgtttccgacaacctgtgagaagcttttatatatttaatttagtttttatatatttaaaaatcacgtcgggttttatgctttcatttaaggtatcaactggagttatgcaagaaagccatggaagagaacataattgtttatttggagactggttgtgggaagacccacatcgcagttctgcttatttatgagcttggccatttgatacggaaacctcagaatagggtatgcatttttcttgctcccacagtggctcttgttcagcaggtgagctactttctatgattttctgcattaatactctattgtcgggaattattagtttataatattgttttggctaagtttgggatttaggaaccaacttggatcatcattcgtcaattgtggattctttgcagcagtggaccatgcatggtttttaatggaatttgttattgttttatagcaagcccgggttatagaagattctcttgatttcaaggttgggacttattgtggtaactgcagacacttgaagaaccatcatgactgggaaatagagatcaaagaatatgaggttattatgttctttgattgacacaagtttataatttatccacgtgttgttcaacatcctatgttgtccacgtgtcattcgacatcctatgttgaaagcttaactataaagagatatgtcttatgaagtttaccaattttaatttattacacttgaccaaatatgttatcggtttttcttcctccacccccctcccccttatagaagatttttaattaggattatggaccctcgagctttcatcatcctcgccttatatttctattcatgttgaattttttgtacaggttcttgttatgactccccaaatactacttcgtagcttatatcactgcttcatcaggatggacttaatcgctcttctgatatttgatgagtgtcatcatgctcaaataaaaagcaaccatccttatgcagaaatcatgaaagtaaagtgctacatgaagtcacatttgtattctcaatgataaatttatattagtctttatcagttgatgtattttgattctgtagattacttgacaatcatgtaggttttttatgataaagctactgcatcaatgcttcctcgtatatttggaatgacagcatctcccgttgttggtaaaggtaattaaaaattgcatttcttttgaaacaaaagtctgaattattacatggatcagccatctccttttcaattcctttcggtacaaaaacttttcccattggaagtacgagaaattaaaggtgttttgaaatgtgttgtgtgtaaaggcagaatcaatcaagaaaataaattcgaatgcctacttttttatggaaaatgtgtttggtaaatgaaaaaaaatgttcttttctaaaaatgtccgtgaaatatgtttgatatcactaaacatttaaaaatgagaggaaaggttaaagaaataaataaaatatccaatgatattattcttgatttcaaatttctcaactttttcttttgtaattttataagcttttgttaaagagatttgagtagacaggaacaaatgagattgtaaatagttcaagatgcctctagagacaaaaaaggaaaaagaaagcagttaagggaataattactgctaatggcttctagttataaatattaacatatattattaattaatggcttcaaatagtgtttaattatgagtcaacttaacttgcaaagtgccaagcaaagaagtaatggacatcccgcgttttcaaaattgaaaagatgtcttttttttttggttgtttattctcatatttgaacccattttcattattgttttctaaaaacttgtttccgttttcaattatgctacgcttttcagtttatatgatacaaatatattggatgatattgcatcttgtagtgctcttcaatgatatattttcctctttaatcgataggctgttttagttattagttgttatctcatcttttgatagctacttctttgattaccttatcttacgcattcagatgcttccagtcaagtaaatttacctaaaagcatcaacagcctcgaaaacttgcttgatgctaaggtgagtctttgaaactttcactttgtgaaatctggtttggtgcaatctcttgttttccttctaaaaactaattatggttgaagatagggagctaagttcaatcataattcctacatgatgaataaaactcgtaaacagcatttcatgtatgtcatgggaagatgtttggtgcctaaacgtttccttgttaaattagaataaatgtagcttgtgaagatactattcttagtttatgtagctgggtttttgtaatgctgtttgaaaatgctatgcctacttaacttgtgtttgttagcctgaattgaggactttggttcagtcaaccttttccagactttcataagctggagtagtggcaggtcataattcatcttgatttagtgagtcaatgaggacaagaagatctatttggctttctgccttctcacttgagtgcaactgatcccaatttacttgatctcactaacatatatgtttagctataggagaactgtctgtttcttccgtttggtggacaaatgtgtttggtcctcttcataattgcgctaatcagtcttccagtagaactgcttaggttgaagtacagaaatatcttaccttgagtcattgtggtcagtaatgttactataactgttttaaggattcaagcaaccactgtaattttggccaggtggagtaatgtttattgttgtcatatcgtcgtaatcattttctttctcttcctcttccccttgctctgtgtgactgtgctaccatatatctttggagatgcaaaaaccaaagtttccttttcaatgaggaatgtttccataaactagactttttagttataatcaaaaccggggagggggggggggcggattcttttcttaaaccaatttctgttctgatatagatgctcagagtagtcaattttctaatatttcacatgccgcaaattgtaggtatattcagttggagataaggaggaattggaaagctttgtagcatctcctgtggttagagtatatgattatggtcctgtcaattttggttcttcttgttccaccattatctattgtagtaaacttgaggagattaagcgccaggtgtgtttcagtgacacatttgcactctcttgattatcttggaagaagttgtatttatttattcatttattttttctgtttctttatggcaagagcagtgcataccttttgtcaggaagaatggtgatattcaatctgccaggaacacaaaaaagctgctcaacagaatgcatgataatataatcttttgcttggaaaatttgggcatttggggagcattgcaagtaagatcttgtgaaaacaattgaatttcttggttctgttaatttgcagttgagagcctttcccttgcaattaaataatctgctattagtgttactttgattcttatttcatattctgcaacttttttctatttatctgaattatattcacaaactctgtactctggcaaaatcatgttggagaataccaaatagagtagaacattagattcacatgctatttaataaggctttatttttataaggtgtcgtattcataggtcattacttgctacttttttttttgtgcactgccaataagcagtgactaattattttttattctttcatttaatttgtatcagttctagcttgttgcagacttgcaggtagttgctgattaaagtatccaaggaaattctgatttatttccaccttctgcattttgtaggcttgccgacttcttttaactggtaataactctgagaggaatgaattgatagaagatgaagggattttaagtgacgactctgtatgtgatcgatatcttgttcatgctgctgatgtttttgcttcagattgtacgagaggtataatctttttaggccttttaaattctagcttcaacttcgttgtagctattgtctggtttcttggtggctctatacccaattatgtgttcatcaaagttcagttatgcaggagagatatgggatcagtgtagggactttttagtagtagcttcaacttaattctgccttctgtctctgttaattgatggccgcattacgatttgctacaccattgtaacttgtatgtattaaacttctagtaatcagtgggattttttttttgggtaaatggagatccttagatttttgaatttatatgctctgcttattgtttcagtcaacttgagtaagaatctgagctattagtctttgttgctgatattgtagatggatctgcaaacgatttatctgatgtagagattttgaaggaaccatttttctcgaaaaagctgctacgtcttgttggaattctttccaccttcaggtttgtattcaagcatgtatagtggtttttggttattttatagatatattgcatggaaactctatcggaccatttcaatggttatagtacttggtaaacaaatattatgacttatgtagttcttgcaacactaggaggcaagagaagggacttaatgcatgaggggtgatgtactgatgttaattcattttaactatgttgacacgtctcatttctttctatctggttactttcaaacaaactctactgctgcattttttcatgcctttaagctttttgcttttctcattatttaactaacaaggtgtatcatacacatatttctctcacaaacttctataattacttttacaggttacagccaaatatgaaatgcataatttttgtgaataggattgttactgcaagatccttgtcatacatactgcaaaaccttaagttcctattattttggaagtgccattttcttgtgggagtccactctggacttaaaagtatgtcaagaaagacaatgaaaaacattcttgagaagttcagaacaggagaggtaacccttctgttagtgttaatattccttggtcactcagctccttccaattcgtgaattttcacatcattgaattgttacttttatctctgcattttagcggactagctcagtttatcctttaggcacaatgtgggcagattttgtgttttttgacatccacatatcatttctataaatgttttcctaaggaagtgcatttcctaatgtctcgaagttattatgagacagaagctcattcattcagtctttgttcttgtaatttgagcctctagttctagttggttgtagcttatgtgatgtttgaaggataatggtaacaattaggaaaaccttgtgtaagtattgttaacggttctgtgtcagttgaattaatttattccaatgtttaaaaaactggactagacgtcaaaccagtgagacctccgtttattggttcaactgggcagactggttgaactggctagttgtgctaaataattattgaatatagtaaatatctaataaaactgatttaatgttgattcaagggaataaatgctctaatctcatcacatacgataaaatttagaaaagtccaacatctgtttttacgttttttactggttaaatgggttttatatactggaccagacaggcaattggttcctggttcaaccagtttgcctggcaggtctgtctggtttttttacactaatttatttttgattccttgaatgctgacttggcagttgaatcttttgattgcaactaaagtcggtgaagaaggacttgacattcagacatgctgccttgtgatacgttttgaccttccagaaactgttgcgagctttatccaatcaagaggacgtgcaagaatgcctctctctgagtatgcatttctggtgaacaggtgctattcataaaagtatatgctatttgaaggtctgtcaatttggttctctttctgtaattgggaaaaaataagatctctttctcttaactttgcagtgggaacgagaaggaactagatttgattaaaaattttaagaaagatgaagatcgtatgaatgtggaaatttctttcagaacatctactgaggtttctattggtcttgaggagagaatctatatggttgattcatctggtgcttccatcagttcaggatatagtatctctctacttcatcattactgctcaaaactgccccatgatgagtatgccttactttttcgttcttacctgcttttgaacttataatgtcactatatatgtttcttgtggaaattcatttactaatttagattatccacgtgaatataattttcaggtactttttccccaagccaagcttttattattttgaagattcaggaggaacaatctgcaatataatattaccttcgaatgctccaataaatcaaattgccagtacacctcaatcttcagttaatgctgccaaaaaagatgcttgtctaaaagcaattgaagaattgcataaattgggagccttgactgaccatctcttgccactgcaaaacagtgttcttgaggaggaaacattgctggtgtcttctgattctgggagctctgaaggttgatgcagagcaactttgtagtcttattcttttcttcttctttttggttgggtgactggtatagaattaatcacttttgctcgtctttaatctcagcaaaatttgattttggttttcagcagatgaggattcacgaggtgaactacatgagatgcttgttcctgctgtgcttaaagaatcatggactaacttagagaactgtgtcctcctttatgcttactatataaaatttaatccgaatcctaaggacaggagctataaagagtttgctctctttgtcaagtctcctctccctaaggaggctgagagaatggagctggatcttcacctatctcggcgtaggtcggtgatgacaaagcttaccccatctggagttgcagaatttaagagagaagaggtaacaatgttttgtttctgtcagactttgttctaattatcttactaccaaaactcactgtgtatctgtgcatatgcagatcatgcaggcacagcattttcaagaaatgttcttcaaggtcatccttgatagatcagaactcctttctgaatttattactttaggaaatgtctttctttcatcaagctcctcaacattctatttattgcttcctgttattctctccaattgtgagaataaagtgacagtggattgggggattgtccaaagatgtttgtcgtctccactttttaagcctcctgttgcagctgcaaagattgaaaatttcccttcagatgtttgcttgcaccttgtaaatggttgtaggagtataagagacattgagaatagtttggtgtatgccacacacaagagggccttttactttattactagcattgttggtgaaaaaaatggttacagcccatatagagattcaggcactttaaatcacgtggagcacttaaacatgttggtagctccactcttgattcacaactgttattaacgttatcagaatagtttatggggaggttatgctcaccaagttgtttagattaggtttttatctagtattcaattgataaagtgttaacttgaatgttgtcaatcaggtctggcattcatcttaagtaccctgaacaacctcttctgcatgcaaaaccactttttaagttgcacaatttgctccacaaccgaaagccggaggattcaggtagcttctcgtttgctttgctttcattcttgtcattgttcccttttcactaagtatgttgcttgttatactggattatttgtgttcaagatatgatattctagaccttgctaccatcttcatgggtatattgctatttgttttgtcagattgcattattttttcatgatgggaacaagatttatggttcattattgatagattagtgctacattgcctgtaattgacatgaaatgcctgatttattgttaattatttgttaatgattgtccttttctgatttttcttcttcttcatcagaaaacactagaaaacaagaaattaccaatttgaagtagtcttatagccatgcagcttatttgatgtgcaagagatatcttgaactgtattcttttggaaatgagaaatgctcaagttgggcgattgagtgagactatgagttctcacatggcggtgaagattgaggattaatctttcttttccaatcctagacttaaggattactagctagtaagtagaatcaggctattgcaacaataaaacgctttacaaccggccttgctggccattctttaatctgcttcagcacttggattaatggggctattggtttttgtctgaatcttccctggaaatatactagtatatcgttaaaatgttatctttaatacaacctttttagtatcaaaagcttgagtcattctggatcccccctgccccccaaaggaaaaaaaggtccttctcattttctctatcagtaaatcaaacaaaagggaaatatgttttgttgattttctctgtcttttcatttcttaaggctgttctttgttgtaaacagaagcaaatgaactggaagaatacttcattgatttgcctcctgagctttgtcagctgaaaataataggcttctccaaagagatagggagttcgctttctttgttaccatcaattatgcatcgcctggagaacttgcttgtggctattgaactgaagcatgttttttctgcttcatttgccgagggagctgaagttactgcccttagggtaagacctaagtccacgtgatattatgactagtgcttttggttaagtgtctgttaagttagttactgtgctagtccaatcatttaatcaagaaatgcaagcatctccatgaatgttatctatgactaacagtttgaaatggtgttaggtcctagaagcacttactacagagaagtgtcaagagcgtttttctcttgaaaggcttgagacacttggtgattccttcctcaagtttgctgtggcccgccatctttttcttttacatgatgcacttgatgaaggggaattgactaggagaaggtctaatgttgtaaataattctaatttattcaagctggcaacaaggcgaaatttacaggtttgattgtgttttagaaagtgatattcttatacagaagttttgacttctgttatgaatagcataattgttatatttttgagaaattttacctgttggtcaacatactatttcaaacatagaacatttttacgattccagtctgccattcttcactgctaacaaatgtggagtagttgcattaaatgctaaggtgcatgttcatgtcactcatccaatatggataaattatcttagacctgtagacatagaagattatagaaaaatgtggtatttactaaaatgattaaactaagaaacaatgtgtgtagttagaaccctctccttgattttggaattgttagcatcagccgttgaaggagtttcgggtgtattcaaatgctttacgttcatgccacttggaatggataatttgaacctaagaagatttaatatgtctatgtctatttggtgttttaagataaataattaatatttacggttctgtgtttccactaaatttcaggtttacatacgtgatcaaccttttgatccttatcagttctttcccttgggccatccctgcccagtaatttgtacaaaagaaactaaaggaactgttcacccacaatctagttgtcaagtagatcatacaaagagtgaagtcaaatgtagtagaaatcaccattggctacataaggacacaatttctgatgtggttgaggctcttgtaggagcatttatagttgataggggcttccaagcggcaacagcatttcttagatggataggcatacgagtggacttccaaggttctcaacttaatagtatttgcgctgcaagcaagagatttatgccactttcctccctattggatattggagatcttgaaaatttgttgggttaccagtttcttcataagggtctcctccttcaggcgattgtgcatccttcttttaataggcatgggggaggctgctaccaggtatgcaatatgtctgcttttctacttaaggaaatcagactctctttatgttttgtatttttcacctgccttgtcatttttataacattctattttctgatgcaacaattaataatactttgatacttttccagagattggagtttcttggagatgctgtcttagattatttaattacatcatatctgttttcactgtatccaaagttgaaacctggtcagttgactgatttgagatcagtgtcagtgaacaacaagtcctttgccaatgttgcagtggacagacgcttacacaaatttcttatgtgtgactcttgtcacctcaacgaggccatagaaaaatatgttgacttcatcacatcatcatcaccagacaggggattgtttgaagggccaaaatgtccgaaggtaagaattactagctgttgtatcttatgccccctgatgcatgctttcctctttccccccaagatataatgaattttagccatctttatataatgcaagttacaaatgcaaagctttattcctaacctatgatcattggattttctttttccttttaatttaagttaacgaggtctaggtggaatacaatattctaattaaagcttgcaactaaattatgttcatgcttattgtcttatttgtttaagagaatacatatgctggattatgataaatttaaaaaataattatgagcatttggtagaatgcagtataataatcgaagcaaatcttttttggagctgattatgctattttcttgtttgaggacgaagatgtgggtggctgattttgattctttgagtttgatttatgagagctaggtggaactgatattatgataaaagcaaatctgtgtaagaacacaatgctgctgcacaatacttcaagaagggtttttaatttaatagctttaatgtattgatacaggctcttggtgacttggtagagtcttgtttcggtgctattctccttgatacagggttcaacttgaaccgtgtttggaagataatgctatccattctggatccaatcaagagcctttcaagtgtgcagctcaatcctatcagggaagtacaggagctttcccagtgttataactgggatttgcagtttctagttgcaaaagttggtagaaatttttcagtggatgcaaaggtaaatgcaggagatgtacctctatgtgtttcttacagcaacattaatagaaaagaagctatcagaactactgcacatcaactatatgtaaagttaaaggtaacaggtgccctgcatactttcctattccctcttcttgatgccattaaaacatgatgctttttgaatatgtactcatatttggttccttttagaagttaatatcatttatagcccagtcttagtgtaggtatattccaaacttgtgaagcttgccttatattgcaggtcgataaatgattgtgaatttgcgacttaatccccgtctcttcttgtctttgaatgtacaggctctaggatatgcacccaaatcaaagtccttggaagaagttttgaagggaagccccaagaatgaagccaagctgattggatacgatgaaacacccattgatgtcagtgttactgacatagttggatttgaaaacatgaaattgcaagaatctcttgtgaatgatttcaaccccaaaactcgttctattaaaaggacaacttctagcggtgtatcttgcatctcacctggtagcagacctccaccttcttttgaagtaaaagcagcaaggggttcagcctctggtattgaagccaaaggcaaaccccccaattgctccattgtggatcctagttgtgggattgactcgccatccaaaggtaaatgattgttacactttttgtgactagtcagtgtggagcaattatcttatttgcctcttaatttctcaggtgaatcacatggtcgtactgctagatcacagttatacgaaatctgtgctatcaattgctggaaaccccctttgtttgaatgttgcaaagaggaaggaccaagtcatttgagatcgtaagtacacgacgcatatatactagaaaagacagctgaaaagtctccattaggacagttcgaaagatgggaacttcaaactacatccctcttgaataattttactcaaatcctatatattcaaaatcttttgcagattcacttacagggtaatagttgaaatcgaagaagctccagatatgatattggagtgcttcagcagtcctcggaccacaaagaaggcagcagccgagcatgcagcggaaggtgcactctggtatttaaaacatggaggatacttacaataggtcaacttaaccgactgaacctcattgctagacataatggagatcaaggtttgaatttagtcattttgctatctcagttcaatggctctagtctctctcttcatcccctatttaatgaacttaaaaaccagcattttctttaaaagtcgaataaaagatgatttaacaacaaaattaaaattttgcttcgaacttgttaacgtggcatttttggtatgtccatgtatccaacaaggagcccaatttaattcaatccatgtatctggtgctgtgtcatgaaagtgtaaagattaaatttattaaactcgagatagaggattaaagctattcaattgagataataagatgatcgaatttagatttcaaactcaaatat

SEQ ID NO: 541 - DNA, 14025 bp, Gossypium raimondii
gttctaatactttaatttgatcatttttaatttttatactttttaaaatttaaaattgatgataactgttaaattcattaagttaatttttattatttctaaaatttaatgcgctaaacataatatcacatgtgtaatgtcatgtcagcttgttattttcacatattgtttactaaaaatctagttaatggattaacaattgtcatttgggttgagattgaaattttaaaatttgcgatttagaatgattcaattgaaaaatatgaattaaatctataattgtagaagactaataattaaattgaaacaaataaatataatggttattatttaatttagactaaaatttcaaaattaaagaaaaaaataggggaatttaatatattgtttattaatttgttttagagaataaaagaaaccattctccactgtttaattttgattttatttatgaaatttcggatttccgagtgggagacgagattcggcagttcgactcattaataagcgaacaaatgtaatgataaaaaattgttggaagaggagttaccagatttgactttccattgaccgagcacaattcattacaagaaatcctaggagaccgctctgcttagtaaaccgaatgggatttcgacatctatttgtccatttgatcaaagcaaacaaaaatctttttttctttttgcttagcggttgagacttggaaaataagcaatttttaccagtcttctcaccgctgtggctataattccctcgttgatgccgggcggcgaattgtccaccgacgggaccgagccgttcatggcctctaaagttaaagccttttctactccgtcgccgatcgttgaaatcagccgaaaagatgaacctataatggaaaagaaagagaaggatccacgaaaaattgctagaaagttagtctctctttcacttccctatacatgtaaatatctatgcttatttgctccggttttttctttatgcaatgtggctttgccttggttctctttatttatttttttatttctttgcacgagttcagttaaattaaacgagagctatctgtttggcttgagggaagtgggaagatgggggaagggggttggagggaaaacatgaaaaataaaaaaccttgttagatgtttctgtttcaaaaacatcgaaagccaaaaaaaaaaaaaaatgcactgtttatttggagtgctgtttccgacaacctgtgagaagcttttatatatttaatttagtttttatatatttaaaaatcacgtcgggttttatgctttcatttaaggtatcaactggagttatgcaagaaagccatggaagagaacataattgtttatttggagactggttgtgggaagacccacatcgcagttctgcttatttatgagcttggccatttgatacggaaacctcagaatagggtatgcatttttcttgctcccacagtggctcttgttcagcaggtgagctactttctatgattttctgcattaatactctattgtcgggaattattagtttataatattgttttggctaagtttgggatttaggaaccaacttggatcatcattcgtcaattgtggattctttgcagcagtggaccatgcatggtttttaatggaatttgttattgttttatagcaagcccgggttatagaagattctcttgatttcaaggttgggacttattgtggtaactgcagacacttgaagaaccatcatgactgggaaatagagatcaaagaatatgaggttattatgttctttgattgacacaagtttataatttatccacgtgttgttcaacatcctatgttgtccacgtgtcattcgacatcctatgttgaaagcttaactataaagagatatgtcttatgaagtttaccaattttaatttattacacttgaccaaatatgttatcggtttttcttcctccacccccctcccccttatagaagatttttaattaggattatggaccctcgagctttcatcatcctcgccttatatttctattcatgttgaattttttgtacaggttcttgttatgactccccaaatactacttcgtagcttatatcactgcttcatcaggatggacttaatcgctcttctgatatttgatgagtgtcatcatgctcaaataaaaagcaaccatccttatgcagaaatcatgaaagtaaagtgctacatgaagtcacatttgtattctcaatgataaatttatattagtctttatcagttgatgtattttgattctgtagattacttgacaatcatgtaggttttttatgataaagctactgcatcaatgcttcctcgtatatttggaatgacagcatctcccgttgttggtaaaggtaattaaaaattgcatttcttttgaaacaaaagtctgaattattacatggatcagccatctccttttcaattcctttcggtacaaaaacttttcccattggaagtacgagaaattaaaggtgttttgaaatgtgttgtgtgtaaaggcagaatcaatcaagaaaataaattcgaatgcctacttttttatggaaaatgtgtttggtaaatgaaaaaaaatgttcttttctaaaaatgtccgtgaaatatgtttgatatcactaaacatttaaaaatgagaggaaaggttaaagaaataaataaaatatccaatgatattattcttgatttcaaatttctcaactttttcttttgtaattttataagcttttgttaaagagatttgagtagacaggaacaaatgagattgtaaatagttcaagatgcctctagagacaaaaaaggaaaaagaaagcagttaagggaataattactgctaatggcttctagttataaatattaacatatattattaattaatggcttcaaatagtgtttaattatgagtcaacttaacttgcaaagtgccaagcaaagaagtaatggacatcccgcgttttcaaaattgaaaagatgtcttttttttttggttgtttattctcatatttgaacccattttcattattgttttctaaaaacttgtttccgttttcaattatgctacgcttttcagtttatatgatacaaatatattggatgatattgcatcttgtagtgctcttcaatgatatattttcctctttaatcgataggctgttttagttattagttgttatctcatcttttgatagctacttctttgattaccttatcttacgcattcagatgcttccagtcaagtaaatttacctaaaagcatcaacagcctcgaaaacttgcttgatgctaaggtgagtctttgaaactttcactttgtgaaatctggtttggtgcaatctcttgttttccttctaaaaactaattatggttgaagatagggagctaagttcaatcataattcctacatgatgaataaaactcgtaaacagcatttcatgtatgtcatgggaagatgtttggtgcctaaacgtttccttgttaaattagaataaatgtagcttgtgaagatactattcttagtttatgtagctgggtttttgtaatgctgtttgaaaatgctatgcctacttaacttgtgtttgttagcctgaattgaggactttggttcagtcaaccttttccagactttcataagctggagtagtggcaggtcataattcatcttgatttagtgagtcaatgaggacaagaagatctatttggctttctgccttctcacttgagtgcaactgatcccaatttacttgatctcactaacatatatgtttagctataggagaactgtctgtttcttccgtttggtggacaaatgtgtttggtcctcttcataattgcgctaatcagtcttccagtagaactgcttaggttgaagtacagaaatatcttaccttgagtcattgtggtcagtaatgttactataactgttttaaggattcaagcaaccactgtaattttggccaggtggagtaatgtttattgttgtcatatcgtcgtaatcattttctttctcttcctcttccccttgctctgtgtgactgtgctaccatatatctttggagatgcaaaaaccaaagtttccttttcaatgaggaatgtttccataaactagactttttagttataatcaaaaccggggagggggggggggcggattcttttcttaaaccaatttctgttctgatatagatgctcagagtagtcaattttctaatatttcacatgccgcaaattgtaggtatattcagttggagataaggaggaattggaaagctttgtagcatctcctgtggttagagtatatgattatggtcctgtcaattttggttcttcttgttccaccattatctattgtagtaaacttgaggagattaagcgccaggtgtgtttcagtgacacatttgcactctcttgattatcttggaagaagttgtatttatttattcatttattttttctgtttctttatggcaagagcagtgcataccttttgtcaggaagaatggtgatattcaatctgccaggaacacaaaaaagctgctcaacagaatgcatgataatataatcttttgcttggaaaatttgggcatttggggagcattgcaagtaagatcttgtgaaaacaattgaatttcttggttctgttaatttgcagttgagagcctttcccttgcaattaaataatctgctattagtgttactttgattcttatttcatattctgcaacttttttctatttatctgaattatattcacaaactctgtactctggcaaaatcatgttggagaataccaaatagagtagaacattagattcacatgctatttaataaggctttatttttataaggtgtcgtattcataggtcattacttgctacttttttttttgtgcactgccaataagcagtgactaattattttttattctttcatttaatttgtatcagttctagcttgttgcagacttgcaggtagttgctgattaaagtatccaaggaaattctgatttatttccaccttctgcattttgtaggcttgccgacttcttttaactggtaataactctgagaggaatgaattgatagaagatgaagggattttaagtgacgactctgtatgtgatcgatatcttgttcatgctgctgatgtttttgcttcagattgtacgagaggtataatctttttaggccttttaaattctagcttcaacttcgttgtagctattgtctggtttcttggtggctctatacccaattatgtgttcatcaaagttcagttatgcaggagagatatgggatcagtgtagggactttttagtagtagcttcaacttaattctgccttctgtctctgttaattgatggccgcattacgatttgctacaccattgtaacttgtatgtattaaacttctagtaatcagtgggattttttttttgggtaaatggagatccttagatttttgaatttatatgctctgcttattgtttcagtcaacttgagtaagaatctgagctattagtctttgttgctgatattgtagatggatctgcaaacgatttatctgatgtagagattttgaaggaaccatttttctcgaaaaagctgctacgtcttgttggaattctttccaccttcaggtttgtattcaagcatgtatagtggtttttggttattttatagatatattgcatggaaactctatcggaccatttcaatggttatagtacttggtaaacaaatattatgacttatgtagttcttgcaacactaggaggcaagagaagggacttaatgcatgaggggtgatgtactgatgttaattcattttaactatgttgacacgtctcatttctttctatctggttactttcaaacaaactctactgctgcattttttcatgcctttaagctttttgcttttctcattatttaactaacaaggtgtatcatacacatatttctctcacaaacttctataattacttttacaggttacagccaaatatgaaatgcataatttttgtgaataggattgttactgcaagatccttgtcatacatactgcaaaaccttaagttcctattattttggaagtgccattttcttgtgggagtccactctggacttaaaagtatgtcaagaaagacaatgaaaaacattcttgagaagttcagaacaggagaggtaacccttctgttagtgttaatattccttggtcactcagctccttccaattcgtgaattttcacatcattgaattgttacttttatctctgcattttagcggactagctcagtttatcctttaggcacaatgtgggcagattttgtgttttttgacatccacatatcatttctataaatgttttcctaaggaagtgcatttcctaatgtctcgaagttattatgagacagaagctcattcattcagtctttgttcttgtaatttgagcctctagttctagttggttgtagcttatgtgatgtttgaaggataatggtaacaattaggaaaaccttgtgtaagtattgttaacggttctgtgtcagttgaattaatttattccaatgtttaaaaaactggactagacgtcaaaccagtgagacctccgtttattggttcaactgggcagactggttgaactggctagttgtgctaaataattattgaatatagtaaatatctaataaaactgatttaatgttgattcaagggaataaatgctctaatctcatcacatacgataaaatttagaaaagtccaacatctgtttttacgttttttactggttaaatgggttttatatactggaccagacaggcaattggttcctggttcaaccagtttgcctggcaggtctgtctggtttttttacactaatttatttttgattccttgaatgctgacttggcagttgaatcttttgattgcaactaaagtcggtgaagaaggacttgacattcagacatgctgccttgtgatacgttttgaccttccagaaactgttgcgagctttatccaatcaagaggacgtgcaagaatgcctctctctgagtatgcatttctggtgaacaggtgctattcataaaagtatatgctatttgaaggtctgtcaatttggttctctttctgtaattgggaaaaaataagatctctttctcttaactttgcagtgggaacgagaaggaactagatttgattaaaaattttaagaaagatgaagatcgtatgaatgtggaaatttctttcagaacatctactgaggtttctattggtcttgaggagagaatctatatggttgattcatctggtgcttccatcagttcaggatatagtatctctctacttcatcattactgctcaaaactgccccatgatgagtatgccttactttttcgttcttacctgcttttgaacttataatgtcactatatatgtttcttgtggaaattcatttactaatttagattatccacgtgaatataattttcaggtactttttccccaagccaagcttttattattttgaagattcaggaggaacaatctgcaatataatattaccttcgaatgctccaataaatcaaattgccagtacacctcaatcttcagttaatgctgccaaaaaagatgcttgtctaaaagcaattgaagaattgcataaattgggagccttgactgaccatctcttgccactgcaaaacagtgttcttgaggaggaaacattgctggtgtcttctgattctgggagctctgaaggttgatgcagagcaactttgtagtcttattcttttcttcttctttttggttgggtgactggtatagaattaatcacttttgctcgtctttaatctcagcaaaatttgattttggttttcagcagatgaggattcacgaggtgaactacatgagatgcttgttcctgctgtgcttaaagaatcatggactaacttagagaactgtgtcctcctttatgcttactatataaaatttaatccgaatcctaaggacaggagctataaagagtttgctctctttgtcaagtctcctctccctaaggaggctgagagaatggagctggatcttcacctatctcggcgtaggtcggtgatgacaaagcttaccccatctggagttgcagaatttaagagagaagaggtaacaatgttttgtttctgtcagactttgttctaattatcttactaccaaaactcactgtgtatctgtgcatatgcagatcatgcaggcacagcattttcaagaaatgttcttcaaggtcatccttgatagatcagaactcctttctgaatttattactttaggaaatgtctttctttcatcaagctcctcaacattctatttattgcttcctgttattctctccaattgtgagaataaagtgacagtggattgggggattgtccaaagatgtttgtcgtctccactttttaagcctcctgttgcagctgcaaagattgaaaatttcccttcagatgtttgcttgcaccttgtaaatggttgtaggagtataagagacattgagaatagtttggtgtatgccacacacaagagggccttttactttattactagcattgttggtgaaaaaaatggttacagcccatatagagattcaggcactttaaatcacgtggagcacttaaacatgttggtagctccactcttgattcacaactgttattaacgttatcagaatagtttatggggaggttatgctcaccaagttgtttagattaggtttttatctagtattcaattgataaagtgttaacttgaatgttgtcaatcaggtctggcattcatcttaagtaccctgaacaacctcttctgcatgcaaaaccactttttaagttgcacaatttgctccacaaccgaaagccggaggattcaggtagcttctcgtttgctttgctttcattcttgtcattgttcccttttcactaagtatgttgcttgttatactggattatttgtgttcaagatatgatattctagaccttgctaccatcttcatgggtatattgctatttgttttgtcagattgcattattttttcatgatgggaacaagatttatggttcattattgatagattagtgctacattgcctgtaattgacatgaaatgcctgatttattgttaattatttgttaatgattgtccttttctgatttttcttcttcttcatcagaaaacactagaaaacaagaaattaccaatttgaagtagtcttatagccatgcagcttatttgatgtgcaagagatatcttgaactgtattcttttggaaatgagaaatgctcaagttgggcgattgagtgagactatgagttctcacatggcggtgaagattgaggattaatctttcttttccaatcctagacttaaggattactagctagtaagtagaatcaggctattgcaacaataaaacgctttacaaccggccttgctggccattctttaatctgcttcagcacttggattaatggggctattggtttttgtctgaatcttccctggaaatatactagtatatcgttaaaatgttatctttaatacaacctttttagtatcaaaagcttgagtcattctggatcccccctgccccccaaaggaaaaaaaggtccttctcattttctctatcagtaaatcaaacaaaagggaaatatgttttgttgattttctctgtcttttcatttcttaaggctgttctttgttgtaaacagaagcaaatgaactggaagaatacttcattgatttgcctcctgagctttgtcagctgaaaataataggcttctccaaagagatagggagttcgctttctttgttaccatcaattatgcatcgcctggagaacttgcttgtggctattgaactgaagcatgttttttctgcttcatttgccgagggagctgaagttactgcccttagggtaagacctaagtccacgtgatattatgactagtgcttttggttaagtgtctgttaagttagttactgtgctagtccaatcatttaatcaagaaatgcaagcatctccatgaatgttatctatgactaacagtttgaaatggtgttaggtcctagaagcacttactacagagaagtgtcaagagcgtttttctcttgaaaggcttgagacacttggtgattccttcctcaagtttgctgtggcccgccatctttttcttttacatgatgcacttgatgaaggggaattgactaggagaaggtctaatgttgtaaataattctaatttattcaagctggcaacaaggcgaaatttacaggtttgattgtgttttagaaagtgatattcttatacagaagttttgacttctgttatgaatagcataattgttatatttttgagaaattttacctgttggtcaacatactatttcaaacatagaacatttttacgattccagtctgccattcttcactgctaacaaatgtggagtagttgcattaaatgctaaggtgcatgttcatgtcactcatccaatatggataaattatcttagacctgtagacatagaagattatagaaaaatgtggtatttactaaaatgattaaactaagaaacaatgtgtgtagttagaaccctctccttgattttggaattgttagcatcagccgttgaaggagtttcgggtgtattcaaatgctttacgttcatgccacttggaatggataatttgaacctaagaagatttaatatgtctatgtctatttggtgttttaagataaataattaatatttacggttctgtgtttccactaaatttcaggtttacatacgtgatcaaccttttgatccttatcagttctttcccttgggccatccctgcccagtaatttgtacaaaagaaactaaaggaactgttcacccacaatctagttgtcaagtagatcatacaaagagtgaagtcaaatgtagtagaaatcaccattggctacataaggacacaatttctgatgtggttgaggctcttgtaggagcatttatagttgataggggcttccaagcggcaacagcatttcttagatggataggcatacgagtggacttccaaggttctcaacttaatagtatttgcgctgcaagcaagagatttatgccactttcctccctattggatattggagatcttgaaaatttgttgggttaccagtttcttcataagggtctcctccttcaggcgattgtgcatccttcttttaataggcatgggggaggctgctaccaggtatgcaatatgtctgcttttctacttaaggaaatcagactctctttatgttttgtatttttcacctgccttgtcatttttataacattctattttctgatgcaacaattaataatactttgatacttttccagagattggagtttcttggagatgctgtcttagattatttaattacatcatatctgttttcactgtatccaaagttgaaacctggtcagttgactgatttgagatcagtgtcagtgaacaacaagtcctttgccaatgttgcagtggacagacgcttacacaaatttcttatgtgtgactcttgtcacctcaacgaggccatagaaaaatatgttgacttcatcacatcatcatcaccagacaggggattgtttgaagggccaaaatgtccgaaggtaagaattactagctgttgtatcttatgccccctgatgcatgctttcctctttccccccaagatataatgaattttagccatctttatataatgcaagttacaaatgcaaagctttattcctaacctatgatcattggattttctttttccttttaatttaagttaacgaggtctaggtggaatacaatattctaattaaagcttgcaactaaattatgttcatgcttattgtcttatttgtttaagagaatacatatgctggattatgataaatttaaaaaataattatgagcatttggtagaatgcagtataataatcgaagcaaatcttttttggagctgattatgctattttcttgtttgaggacgaagatgtgggtggctgattttgattctttgagtttgatttatgagagctaggtggaactgatattatgataaaagcaaatctgtgtaagaacacaatgctgctgcacaatacttcaagaagggtttttaatttaatagctttaatgtattgatacaggctcttggtgacttggtagagtcttgtttcggtgctattctccttgatacagggttcaacttgaaccgtgtttggaagataatgctatccattctggatccaatcaagagcctttcaagtgtgcagctcaatcctatcagggaagtacaggagctttcccagtgttataactgggatttgcagtttctagttgcaaaagttggtagaaatttttcagtggatgcaaaggtaaatgcaggagatgtacctctatgtgtttcttacagcaacattaatagaaaagaagctatcagaactactgcacatcaactatatgtaaagttaaaggtaacaggtgccctgcatactttcctattccctcttcttgatgccattaaaacatgatgctttttgaatatgtactcatatttggttccttttagaagttaatatcatttatagcccagtcttagtgtaggtatattccaaacttgtgaagcttgccttatattgcaggtcgataaatgattgtgaatttgcgacttaatccccgtctcttcttgtctttgaatgtacaggctctaggatatgcacccaaatcaaagtccttggaagaagttttgaagggaagccccaagaatgaagccaagctgattggatacgatgaaacacccattgatgtcagtgttactgacatagttggatttgaaaacatgaaattgcaagaatctcttgtgaatgatttcaaccccaaaactcgttctattaaaaggacaacttctagcggtgtatcttgcatctcacctggtagcagacctccaccttcttttgaagtaaaagcagcaaggggttcagcctctggtattgaagccaaaggcaaaccccccaattgctccattgtggatcctagttgtgggattgactcgccatccaaaggtaaatgattgttacactttttgtgactagtcagtgtggagcaattatcttatttgcctcttaatttctcaggtgaatcacatggtcgtactgctagatcacagttatacgaaatctgtgctatcaattgctggaaaccccctttgtttgaatgttgcaaagaggaaggaccaagtcatttgagatcgtaagtacacgacgcatatatactagaaaagacagctgaaaagtctccattaggacagttcgaaagatgggaacttcaaactacatccctcttgaataattttactcaaatcctatatattcaaaatcttttgcagattcacttacagggtaatagttgaaatcgaagaagctccagatatgatattggagtgcttcagcagtcctcggaccacaaagaaggcagcagccgagcatgcagcggaaggtgcactctggtatttaaaacatggaggatacttacaataggtcaacttaaccgactgaacctcattgctagacataatggagatcaaggtttgaatttagtcattttgctatctcagttcaatggctctagtctctctcttcatcccctatttaatgaacttaaaaaccagcattttctttaaaagtcgaataaaagatgatttaacaacaaaattaaaattttgcttcgaacttgttaacgtggcatttttggtatgtccatgtatccaacaaggagcccaatttaattcaatccatgtatctggtgctgtgtcatgaaagtgtaaagattaaatttattaaactcgagatagaggattaaagctattcaattgagataataagatgatcgaatttagatttcaaactcaaatatgtttgatgatgtctatattgatggctgtta

SEQ ID NO: 542 - protein, 912 aa, Gossypium raimondii
MDSFEQEGNGAALESLPPPPPVPPDVVPIKAESDAKKIVRHPMARRGVGTKGQKVTILTNHFKVSVGSTDGHFYHYSVSLSYEDGRPVDGKGVGRKVIDRVHETYKNDLDGKNFAYDGEKSLFTIGPLPNNKLEFTVVLEDVAPTRNNGNASPDGQDSPNGRERKRLRRPYHSKTFKVEISYAAKIPMQAIQNALRGQESENSQEALRVLDIILRQHAAKQGCLLVRQSFFQDNQNNFTDIGGGVLGCRGFHSSFRATQGGLSLNIDVSTTMIIQPGPVVDFLLANQNARDPYSLDWNKAKRVLKNLRIKVSPSNQEYKITGLSEQLCKDQLFSMKQKNTKNENGEAETLEITIYDYFVNHRNIQLRYSADLPCINVGKPKRPTYIPIELCSLVSLQRYTKALSTFQRASLVEKSRQKPQERMNVLSNVLRTSNYGAEPMLKSCGVNINSNFTQVDGRILPAPRLRVGNGEDFFPRNGRWNFNNKKLVEPSRIERWAVVNFSAPRCDPNNIARDLIRCGEMKGIRIDPPFDIFNEMNQNRRLSPVVRVEKMFEQIQSKLPGAPQFLLCLLPDRKNSDLYGPWKRKNLSEYGIVTQCMAPARVNDQYLTNLLLKINAKLGGLNSMLTIEQTPSIPMISKVPTIILGMDVSHGSPGQSDVPSIAAVVSSRQWPLISRYRASVRTQSPKLEMVDSLFKPVSDKVDEGIMREALLDFYTSSGKRKPDQIIIFRDGVSESQFNQVLNKELDQVIEACKFLDENWNPKFVVIVAQKNHHTKFFQQGSPDNVLPGTVIDNKVCHPKNNDFYLCAHAGMIGTTRPTHYHVLLDQVGFSADDLQELVHSLSYVYQRSTTAISVVAPICYAHLAASQLGQFMKFEDASETSSSHGGVTAPGAISVPQLPRLKDNVSSSMFFC

SEQ ID NO: 543 - protein, 912 aa, Gossypium raimondii; identical to SEQ ID NO: 542

SEQ ID NO: 544 - protein, 912 aa, Gossypium raimondii; identical to SEQ ID NO: 542

SEQ ID NO: 545 - protein, 863 aa, Gossypium raimondii
MDSFEQEGNGAALESLPPPPPVPPDVVPIKAESDAKKIVRHPMARRGVGTKGQKVTILTNHFKVSVGSTDGHFYHYSVSLSYEDGRPVDGKGVGRKVIDRVHETYKNDLDGKNFAYDGEKSLFTIGPLPNNKLEFTVVLEDVAPTRNNGNASPDGQDSPNGRERKRLRRPYHSKTFKVEISYAAKIPMQAIQNALRGQESENSQEALRVLDIILRQHAAKQGCLLVRQSFFQDNQNNFTDIGGGVLGCRGFHSSFRATQGGLSLNIDVSTTMIIQPGPVVDFLLANQNARDPYSLDWNKAKRVLKNLRIKVSPSNQEYKITGLSEQLCKDQLFSMKQKNTKNENGEAETLEITIYDYFVNHRNIQLRYSADLPCINVGKPKRPTYIPIELCSLVSLQRYTKALSTFQRASLVEKSRQKPQERMNVLSNVLRTSNYGAEPMLKSCGVNINSNFTQVDGRILPAPRLRVGNGEDFFPRNGRWNFNNKKLVEPSRIERWAVVNFSAPRCDPNNIARDLIRCGEMKGIRIDPPFDIFNEMNQNRRLSPVVRVEKMFEQIQSKLPGAPQFLLCLLPDRKNSDLYGPWKRKNLSEYGIVTQCMAPARVNDQYLTNLLLKINAKLGGLNSMLTIEQTPSIPMISKVPTIILGMDVSHGSPGQSDVPSIAAVVSSRQWPLISRYRASVRTQSPKLEMVDSLFKPVSDKVDEGIMREALLDFYTSSGKRKPDQIIIFRDGVSESQFNQVLNKELDQVIEACKFLDENWNPKFVVIVAQKNHHTKFFQQGSPDNVLPGTVIDNKVCHPKNNDFYLCAHAGMIGTTRPTHYHVLLDQVGFSADDLQELVHSLSYVGPYLLRSFGSFTVGAIYEV

SEQ ID NO: 546 - protein, 844 aa, Gossypium raimondii
MDSFEQEGNGAALESLPPPPPVPPDVVPIKAESDAKKIVRHPMARRGVGTKGQKVTILTNHFKVSVGSTDGHFYHYSVSLSYEDGRPVDGKGVGRKVIDRVHETYKNDLDGKNFAYDGEKSLFTIGPLPNNKLEFTVVLEDVAPTRNNGNASPDGQDSPNGRERKRLRRPYHSKTFKVEISYAAKIPMQAIQNALRGQESENSQEALRVLDIILRQHAAKQGCLLVRQSFFQDNQNNFTDIGGGVLGCRGFHSSFRATQGGLSLNIDVSTTMIIQPGPVVDFLLANQNARDPYSLDWNKAKRVLKNLRIKVSPSNQEYKITGLSEQLCKDQLFSMKQKNTKNENGEAETLEITIYDYFVNHRNIQLRYSADLPCINVGKPKRPTYIPIELCSLVSLQRYTKALSTFQRASLVEKSRQKPQERMNVLSNVLRTSNYGAEPMLKSCGVNINSNFTQVDGRILPAPRLRVGNGEDFFPRNGRWNFNNKKLVEPSRIERWAVVNFSAPRCDPNNIARDLIRCGEMKGIRIDPPFDIFNEMNQNRRLSPVVRVEKMFEQIQSKLPGAPQFLLCLLPDRKNSDLYGPWKRKNLSEYGIVTQCMAPARVNDQYLTNLLLKINAKLGGLNSMLTIEQTPSIPMISKVPTIILGMDVSHGSPGQSDVPSIAAVVSSRQWPLISRYRASVRTQSPKLEMVDSLFKPVSDKVDEGIMREALLDFYTSSGKRKPDQIIIFRDGVSESQFNQVLNKELDQVIEACKFLDENWNPKFVVIVAQKNHHTKFFQQGSPDNVLPGTVIDNKVCHPKNNDFYLCAHAGMIGTTRPTHYHVLLDQVGFSADDLQELVHSLSYV

SEQ ID NO: 547 - protein, 822 aa, Gossypium raimondii
MDSFEQEGNGAALESLPPPPPVPPDVVPIKAESDAKKIVRHPMARRGVGTKGQKVTILTNHFKVSVGSTDGHFYHYSVSLSYEDGRPVDGKGVGRKVIDRVHETYKNDLDGKNFAYDGEKSLFTIGPLPNNKLEFTVVLEDVAPTRNNGNASPDGQDSPNGRERKRLRRPYHSKTFKVEISYAAKIPMQAIQNALRGQESENSQEALRVLDIILRQHAAKQGCLLVRQSFFQDNQNNFTDIGGGVLGCRGFHSSFRATQGGLSLNIDVSTTMIIQPGPVVDFLLANQNARDPYSLDWNKAKRVLKNLRIKVSPSNQEYKITGLSEQLCKDQLFSMKQKNTKNENGEAETLEITIYDYFVNHRNIQLRYSADLPCINVGKPKRPTYIPIELCSLVSLQRYTKALSTFQRASLVEKSRQKPQERMNVLSNVLRTSNYGAEPMLKSCGVNINSNFTQVDGRILPAPRLRVGNGEDFFPRNGRWNFNNKKLVEPSRIERWAVVNFSAPRCDPNNIARDLIRCGEMKGIRIDPPFDIFNEMNQNRRLSPVVRVEKMFEQIQSKLPGAPQFLLCLLPDRKNSDLYGPWKRKNLSEYGIVTQCMAPARVNDQYLTNLLLKINAKLGGLNSMLTIEQTPSIPMISKVPTIILGMDVSHGSPGQSDVPSIAAVVSSRQWPLISRYRASVRTQSPKLEMVDSLFKPVSDKVDEGIMREALLDFYTSSGKRKPDQIIIFRDGVSESQFNQVLNKELDQVIEACKFLDENWNPKFVVIVAQKNHHTKFFQQGSPDNVLPGTVIDNKVCHPKNNDFYLCAHAGMIVSSLIFVSVN

SEQ ID NO: 548 - protein, 699 aa, Gossypium raimondii
MDTSTITAGCLLVRQSFFQDNQNNFTDIGGGVLGCRGFHSSFRATQGGLSLNIDVSTTMIIQPGPVVDFLLANQNARDPYSLDWNKAKRVLKNLRIKVSPSNQEYKITGLSEQLCKDQLFSMKQKNTKNENGEAETLEITIYDYFVNHRNIQLRYSADLPCINVGKPKRPTYIPIELCSLVSLQRYTKALSTFQRASLVEKSRQKPQERMNVLSNVLRTSNYGAEPMLKSCGVNINSNFTQVDGRILPAPRLRVGNGEDFFPRNGRWNFNNKKLVEPSRIERWAVVNFSAPRCDPNNIARDLIRCGEMKGIRIDPPFDIFNEMNQNRRLSPVVRVEKMFEQIQSKLPGAPQFLLCLLPDRKNSDLYGPWKRKNLSEYGIVTQCMAPARVNDQYLTNLLLKINAKLGGLNSMLTIEQTPSIPMISKVPTIILGMDVSHGSPGQSDVPSIAAVVSSRQWPLISRYRASVRTQSPKLEMVDSLFKPVSDKVDEGIMREALLDFYTSSGKRKPDQIIIFRDGVSESQFNQVLNKELDQVIEACKFLDENWNPKFVVIVAQKNHHTKFFQQGSPDNVLPGTVIDNKVCHPKNNDFYLCAHAGMIGTTRPTHYHVLLDQVGFSADDLQELVHSLSYVYQRSTTAISVVAPICYAHLAASQLGQFMKFEDASETSSSHGGVTAPGAISVPQLPRLKDNVSSSMFFC

SEQ ID NO: 549 - protein, 913 aa, Gossypium raimondii
MDSFEQDGNGAAPDSLPPPPPVPPDVVPIKAEPEPAKKKVVRVPMARRGLGSKGQKITLLTNHFKVNVGSSDGHFFHYCVSLYYEDGRPVDGKGVGRKVIERVQETYGNELAGKDFAYDGEKSLFTVGALPNNKHEFTVVLEDVTSNRNNGNASPDVHDDSNGQDRKRIKRPYQSKTFKVEISFAAKIPMQAIQNALRGQESENSQEALRVLDIILRQHAAKQGCLLVRQSFFQNNPDNFTDIGGGVLGCRGFHSSFRASQGGLSLNIDVSTTMIIRPGPVVDFLLANQNARDPYSLDWTKAKRSLKNLRIKVSPSNQEYKITGLSEQLCKDQLFSLKQKSMKNDNGEAENLEITVYDYFVNHRNIQLRYSADLPCINVGKPKRPTYIPLELCSLVSLQRYTKALTTFQRASLVEKSRQKPQERMTVLSSALQRSNYGAEPMLRSCGISISTNFTQVEGRVLPAPRLKVGNGEDFFPRNGRWNFNNKKLVEPTKIERWAVVNFSARCDTNSLVRDLIRCGDMKGIRIDPPFDVFQESNQNRRCSPLVRVEKMFEDIQSKLPGAPQFLLCLLPDRKNSDLYGPWKKKNLSEFGIVTQCMAPTRVNDQYLTNLLLKINAKLGGLNSMLAIEQTPSIPVVSKVPTIILGMDVSHGSPGQSDIPSIAAVVSSRQWPLISRYRASVRTQSPKLEMIDSLFKKVSDKEDEGIMREVLLDFYTSSGKRKPDQIIIFRDGVSESQFNQVLNIELDQVIEACKFLDESWNPKFVVIVAQKNHHTKFFQQGSPDNVPPGTVIDNKICHPKNNDFYLCAHAGMIGTTRPTHYHVLLDQIGFSADDLQELVHSLSYVYQRSTTAISVVAPICYAHLAAAQVGTFMKFEDASETNSSHGGVTAPGAISVPQLPRLKENVCNSMFFC

SEQ ID NO: 550 - protein, 912 aa, Gossypium raimondii; identical to SEQ ID NO: 542

SEQ ID NO: 551 - protein, 912 aa, Gossypium raimondii; identical to SEQ ID NO: 542

SEQ ID NO: 552 - protein, 912 aa, Gossypium raimondii; identical to SEQ ID NO: 542

SEQ ID NO: 553 - protein, 913 aa, Gossypium raimondii; identical to SEQ ID NO: 549

SEQ ID NO: 554 - protein, 898 aa, Gossypium raimondii
MEKASTEEALELPSLPLPLPTIPSNVKLESLKPPKYSIVSRREVGTSGRKISLLANHFKVSVNAPDAVFYQYTVTVLSEDSRVVESKRIGRKLVDKLYQTYSSELAGKRFAYDGEKSLYTVGPLPQNKFEFTIVLEDSFAKWSPDADGGPAETGKRTKRSFQSKTYKVELSYSAKIPLKSISLALKGVQSDDSTQDALRVLDIILRQQAADRGCLLVRQSFFQDDSRNYVDLGGGVLGLRGFHSSFRPTQGGLSLNMDVSTTMILRPGPVFEFLKQNLNLNDERFWLKARRMLKNMRIKTRHRNMEFKITGLSEKPCCELFFPMKVKNGGCGEVRTVEITVYEYFTKHCGIELTYSADMPCLDVGKPKRPNYLPLELCSLVSLQRYTKALTTNQRATLVERSRQKPRERIQILTDALKNNKFNENPVLSACEISIGRQLTEVEGRILETPRLKVGNHEDCIPRNGRWNYNNKRFLDPKKIERWIAVNFSARCDLSQISRDLISCARNKGIEMERPHTLIEEERHQAAKAGPAARVEAMFDQIIAKLPGPPEFILCVLPVRKNSDIYGPWKKKCLCDMGIATQCISPGKINDQYLTNVLLKINSKLGGINSLLEIEKPSILPLLKDTPTLILGMDVSHGSPGRSDVPSIAAVVGSLHWPLISRYRASVRTQSPKMEMIEALYKPSPDGKVDDGIIRELLVDFYKTSGNRKPKQIIIFRDGVSESQFNQVLNIELEQIIKSYQFLGESDVPKFTVVVAQKNHHTKLFQANAPENVPPGTVVDTKIVHPRNYDFYMSAHAGMIGTSRPAHYHVLLDEIGFSPNDLQNLIHCLSYVYQRSTAAVSIVAPICYAHLAAYQMGQFLKLDELSETSSGNVTSTGSILVPDLPRLKKNVASTMFFC

SEQ ID NO: 555 - protein, 850 aa, Gossypium raimondii
MEKASTEEALELPSLPLPLPTIPSNVKLESLKPPKYSIVSRREVGTSGRKISLLANHFKVSVNAPDAVFYQYTVTVLSEDSRVVESKRIGRKLVDKLYQTYSSELAGKRFAYDGEKSLYTVGPLPQNKFEFTIVLEDSFAKWSPDADGGPAETGKRTKRSFQSKTYKVELSYSAKIPLKSISLALKGVQSDDSTQDALRVLDIILRQQAADRGCLLVRQSFFQDDSRNYVDLGGGVLGLRGFHSSFRPTQGGLSLNMDVSTTMILRPGPVFEFLKQNLNLNDERFWLKARRMLKNMRIKTRHRNMEFKITGLSEKPCCELFFPMKVKNGGCGEVRTVEITVYEYFTKHCGIELTYSADMPCLDVGKPKRPNYLPLELCSLVSLQRYTKALTTNQRATLVERSRQKPRERIQILTDALKNNKFNENPVLSACEISIGRQLTEVEGRILETPRLKVGNHEDCIPRNGRWNYNNKRFLDPKKIERWIAVNFSARCDLSQISRDLISCARNKGIEMERPHTLIEEERHQAAKAGPAARVEAMFDQIIAKLPGPPEFILCVLPVRKNSDIYGPWKKKCLCDMGIATQCISPGKINDQYLTNVLLKINSKLGGINSLLEIEKPSILPLLKDTPTLILGMDVSHGSPGRSDVPSIAAVVGSLHWPLISRYRASVRTQSPKMEMIEALYKPSPDGKVDDGIIRELLVDFYKTSGNRKPKQIIIFRDGVSESQFNQVLNIELEQIIKSYQFLGESDVPKFTVVVAQKNHHTKLFQANAPENVPPGTVVDTKIVHPRNYDFYMSAHAGMIGTSRPAHYHVLLDEIGFSPNDLQNLIHCLSYVYQRSTAAVSIDGPIFEAG

SEQ ID NO: 556 - protein, 832 aa, Gossypium raimondii
MEKASTEEALELPSLPLPLPTIPSNVKLESLKPPKYSIVSRREVGTSGRKISLLANHFKVSVNAPDAVFYQYTVTVLSEDSRVVESKRIGRKLVDKLYQTYSSELAGKRFAYDGEKSLYTVGPLPQNKFEFTIVLEDSFAKWSPDADGGPAETGKRTKRSFQSKTYKVELSYSAKIPLKSISLALKGVQSDDSTQDALRVLDIILRQQAADRGCLLVRQSFFQDDSRNYVDLGGGVLGLRGFHSSFRPTQGGLSLNMDVSTTMILRPGPVFEFLKQNLNLNDERFWLKARRMLKNMRIKTRHRNMEFKITGLSEKPCCELFFPMKVKNGGCGEVRTVEITVYEYFTKHCGIELTYSADMPCLDVGKPKRPNYLPLELCSLVSLQRYTKALTTNQRATLVERSRQKPRERIQILTDALKNNKFNENPVLSACEISIGRQLTEVEGRILETPRLKVGNHEDCIPRNGRWNYNNKRFLDPKKIERWIAVNFSARCDLSQISRDLISCARNKGIEMERPHTLIEEERHQAAKAGPAARVEAMFDQIIAKLPGPPEFILCVLPVRKNSDIYGPWKKKCLCDMGIATQCISPGKINDQYLTNVLLKINSKLGGINSLLEIEKPSILPLLKDTPTLILGMDVSHGSPGRSDVPSIAAVVGSLHWPLISRYRASVRTQSPKMEMIEALYKPSPDGKVDDGIIRELLVDFYKTSGNRKPKQIIIFRDGVSESQFNQVLNIELEQIIKSYQFLGESDVPKFTVVVAQKNHHTKLFQANAPENVPPGTVVDTKIVHPRNYDFYMSAHAGMIGTSRPAHYHVLLDEIGFSPNDLQNLIHCLSYV

SEQ ID NO: 557 - protein, 905 aa, Gossypium raimondii
MPSTRRASNPMKDTDSTKNPTRSSQRNRKTVLEPENDEVIVVSEGENSEVSRGGKRKESSASGAGNNAKKSKPSVAKMTPLDTENGEAMVVDGTENGSKTTPKNSKKTKTDVAVNEDKEETKFLGEPVDDEEARRRWPKRYQGKGAKKVISKSSNGDSEEIIQARRHYTQAKVDGCMIFNLYDDAHVKAEDGEDCYICKIVEMFEAVDGDLYFTAQWFYRAQDTVLKTLGHLIDKKRVFFSQIQDDNPLDCLVAKLNIAKVSLNVDLEAKNKEIPSCDYYCDMLYTLEYSSFTNLPPEGKTNASEEASSTISDDSPDTVNGANSGSEDASLLDLYSGCGAMSTGLCLGANMAGLRLVTKWAVDINKYACESLQWNHPETTVRNESAEDFLALLKEWERLCASFSSSKSENLERQSFNSSVNEDNVNDEEEEEDENEDGDGEVFEVEKFLAICYGDPKEKGERGLYLKVRWKNYGPEEDTWEPLDGLGDCRECLKDFVTSGFKAKILPLPGDVDVVCGGPPCQGISGFNRFRNKDNPLQDEKNKQLQVFMEIVEYLKPKFVLMENVVDIVKFAEGYLGRYALSKLIHLNYQVRMGMMAAGAYGLPQFRMRAFFWGARPNQKLPQYPLPTHDLVLRGVIPVEFEMNTVGWEEGKKIELEKKLLLEDAISDLPSVGNYEDKDEMDYDKDPKTEFQRFIRLRREEMPGFSSLNAKPTKHLLYDHRPLQLNTDDYQRVCRVPKRKGANFRDFPGVIVNSGNKVEWDPNVERVYLESGKPLVPDYAMSFVGGSSSKPFARLWWDETVPTVVTRAEPHNQAILHPVQDRVLSIRENARLQGFPDYYKLFGPVKERYIQVGNAVAVPVSRALGYALGLAYQGVVSNDEPLTKLPPRFPNISEKASSDSSQDNS

SEQ ID NO: 558 - protein, 1659 aa, Gossypium raimondii
MHSPKEEQGEPLKRSFSEANSDPPDWMVLDDNETAKEEDPSSSSKPKDFNPRGYQLQVYEVAKGRNIIAVLDTGVGKTMIAVMLIKDFVQAIESTESKKLIIFLAPTVHLVNQQFEYVKDHTSLEVEQYYGAKGVDEWTLDCWEKETKEHDVLVMTPQILLDALRKAFLSLEMVSLMIIDECHRATGNHPYAKIMKEFYHKSNNKPKIFGMTASPVVSKGVLSSNNCDGQMSELECVLDSLIYTIEDRTEMEACVPSAKESCRFFDPAQFSSLDLKAKVEASWLKTDASLSNLQSSLQTSYKGMDDKLKNLRKRLSNDHAKVLHCLDNLGLICAYEAVNICLENILDTTEESKAYRESVLQYKNFLEEVQCRIGESLPLGDKNFLNTGFDYLKAVDLGYISPKLHELLQLFQSFGETRQVLCLIFVERIITAKVIERFAKKVSCLSHFMVSYMTGSNTSVDSLAPKMQKETLESFRSGKVNLLFTTDVVEEGIHVPNCCYVIRFDLPKTVRSYVQSRGRARQNNSEFIMMLERGNVKQRNQLYDIIRSEYSMTNSAIKRDPDSDPCLLKDHTFEETNVFIVDATGASVTADSAVSLIHKYCGKLPGDKYYTPKPNFQFTSSEGLYKCKLTLPVNAAVQTIVGPLSRNSHLAKQLVCLEACKQLHQMGALDDHLTPSIEEPSENACISKGKDSGAGAGAGTTKRKELHGTTCIQALCGSWGEKSDDAVFFAYKFDFKCNIITVVYSGFVLLIESKLADDVGNTEMDLFLIGKMVKASVSSCGQVYLNAEQMVKAKRFQEFFFNGLFGKLFVGSKSSGAPREFLLRDKTSSLWSPSHMYLLLPLEDNSTDELRIHWPGITACTLAAEFLNKNSLLGTEQSDDDGSNPSLNSTGSPVTYCKETNIIRFANSSVDANSLRNTVVLAIHTGRIYCIIEAVSDKTAESSFAETVDTVSSEFATFYEYFYKKYNIVLKHPGQPLMLLKQSHNPHNLLVNFNDEGVSAKASQAGVVNEKPRFHVHMPPELLLVLDVPVSVLKSLYLLPSLMHRLESLMLANQLREEINFCSSNIDIPSSMILEALTTLRCCESFSMERLELLGDSVLKYAVSCHLFLRYPNKHEGQLSARRSLAVCNSTLHKLGTDHKIQGYIRDSAFDPRRWVAPGQRVLRPVPCKCGVDSLEVPLDKKFQTEDPKVKVGKSCDRGHRWLCSKTISDCVEALIGAYYLSGGLVAALHVMKWLGIDAELDPLVVAEVINQASLRTYVPNYEIHMIESKVGYNFSVKFFLQEALTHESLHESYCYQRLEFLGDSVLDLLITQYLYNHHTDIDPGELTDLRSASVNNENFAQVAVRHDLHKHLQHCSTLLSNQISEYVRSFTESDNTTRLDPSIKGPKALGDLVESIVGAILIDTNLNLDKVWRIVEPLLSPIVTPDKLELPPFRELNELCDSLGYFIKEKCKNKGEVVHAELLLQLDHDLLVGEGFDRSRKVAKGKAASCLLKDLENRGISRKKRKHDCVDSSQTMEDDSLEPTIPKRQRSAEIQLLDESKKACSATPATPVIVTVKTKKGGPRTTLFELCKKLLWPMPSIKATEHKSSAPMEIGEGPERKKGFISFVSKIILNVPGYDIIECTGDAKADKKSSSDSAALFMLYELEQRGKLIIEETL

SEQ ID NO: 559 - protein, 1657 aa, Gossypium raimondii
MHSPKEEQGEPLKRSFSEANSDPPDWMVLDDNETAKEEDPSSSSKPKDFNPRGYQLQVYEVAKGRNIIAVLDTGVGKTMIAVMLIKDFVQAIESTESKKLIIFLAPTVHLVNQQFEYVKDHTSLEVEQYYGAKGVDEWTLDCWEKETKEHDVLVMTPQILLDALRKAFLSLEMVSLMIIDECHRATGNHPYAKIMKEFYHKSNNKPKIFGMTASPVVSKGVLSSNNCDGQMSELECVLDSLIYTIEDRTEMEACVPSAKESCRFFDPAQFSSLDLKAKVEASWLKTDASLSNLQSSLQTSYKGMDDKLKNLRKRLSNDHAKVLHCLDNLGLICAYEAVNICLENILDTTEESKAYRESVLQYKNFLEEVQCRIGESLPLGDKNFLNTGFDYLKAVDLGYISPKLHELLQLFQSFGETRQVLCLIFVERIITAKVIERFAKKVSCLSHFMVSYMTGSNTSVDSLAPKMQKETLESFRSGKVNLLFTTDVVEEGIHVPNCCYVIRFDLPKTVRSYVQSRGRARQNNSEFIMMLERGNVKQRNQLYDIIRSEYSMTNSAIKRDPDSDPCLLKDHTFEETNVFIVDATGASVTADSAVSLIHKYCGKLPGDKYYTPKPNFQFTSSEGLYKCKLTLPVNAAVQTIVGPLSRNSHLAKQLVCLEACKQLHQMGALDDHLTPSIEEPSENACISKGKDSGAGAGTTKRKELHGTTCIQALCGSWGEKSDDAVFFAYKFDFKCNIITVVYSGFVLLIESKLADDVGNTEMDLFLIGKMVKASVSSCGQVYLNAEQMVKAKRFQEFFFNGLFGKLFVGSKSSGAPREFLLRDKTSSLWSPSHMYLLLPLEDNSTDELRIHWPGITACTLAAEFLNKNSLLGTEQSDDDGSNPSLNSTGSPVTYCKETNIIRFANSSVDANSLRNTVVLAIHTGRIYCIIEAVSDKTAESSFAETVDTVSSEFATFYEYFYKKYNIVLKHPGQPLMLLKQSHNPHNLLVNFNDEGVSAKASQAGVVNEKPRFHVHMPPELLLVLDVPVSVLKSLYLLPSLMHRLESLMLANQLREEINFCSSNIDIPSSMILEALTTLRCCESFSMERLELLGDSVLKYAVSCHLFLRYPNKHEGQLSARRSLAVCNSTLHKLGTDHKIQGYIRDSAFDPRRWVAPGQRVLRPVPCKCGVDSLEVPLDKKFQTEDPKVKVGKSCDRGHRWLCSKTISDCVEALIGAYYLSGGLVAALHVMKWLGIDAELDPLVVAEVINQASLRTYVPNYEIHMIESKVGYNFSVKFFLQEALTHESLHESYCYQRLEFLGDSVLDLLITQYLYNHHTDIDPGELTDLRSASVNNENFAQVAVRHDLHKHLQHCSTLLSNQISEYVRSFTESDNTTRLDPSIKGPKALGDLVESIVGAILIDTNLNLDKVWRIVEPLLSPIVTPDKLELPPFRELNELCDSLGYFIKEKCKNKGEVVHAELLLQLDHDLLVGEGFDRSRKVAKGKAASCLLKDLENRGISRKKRKHDCVDSSQTMEDDSLEPTIPKRQRSAEIQLLDESKKACSATPATPVIVTVKTKKGGPRTTLFELCKKLLWPMPSIKATEHKSSAPMEIGEGPERKKGFISFVSKIILNVPGYDIIECTGDAKADKKSSSDSAALFMLYELEQRGKLIIEETL

SEQ ID NO: 560 - protein, 1516 aa, Gossypium raimondii
MHSPKEEQGEPLKRSFSEANSDPPDWMVLDDNETAKEEDPSSSSKPKDFNPRGYQLQVYEVAKGRNIIAVLDTGVGKTMIAVMLIKDFVQAIESTESKKLIIFLAPTVHLVNQQFEYVKDHTSLEVEQYYGAKGVDEWTLDCWEKETKEHDVLVMTPQILLDALRKAFLSLEMVSLMIIDECHRATGNHPYAKIMKEFYHKSNNKPKIFGMTASPVVSKGVLSSNNCDGQMSELECVLDSLIYTIEDRTEMEACVPSAKESCRFFDPAQFSSLDLKAKVEASWLKTDASLSNLQSSLQTSYKGMDDKLKNLRKRLSNDHAKVLHCLDNLGLICAYEAVNICLENILDTTEESKAYRESVLQYKNFLEEVQCRIGESLPLGDKNFLNTGFDYLKAVDLGYISPKLHELLQLFQSFGETRQVLCLIFVERIITAKVIERFAKKVSCLSHFMVSYMTGSNTSVDSLAPKMQKETLESFRSGKVNLLFTTDVVEEGIHVPNCCYVIRFDLPKTVRSYVQSRGRARQNNSEFIMMLERGNVKQRNQLYDIIRSEYSMTNSAIKRDPDSDPCLLKDHTFEETNVFIVDATGASVTADSAVSLIHKYCGKLPGDKYYTPKPNFQFTSSEGLYKCKLTLPVNAAVQTIVGPLSRNSHLAKQLVCLEACKQLHQMGALDDHLTPSIEEPSENACISKGKDSGAGAGTTKRKELHGTTCIQALCGSWGEKSDDAVFFAYKFDFKCNIITVVYSGFVLLIESKLADDVGNTEMDLFLIGKMVKASVSSCGQVYLNAEQMVKAKRFQEFFFNGLFGKLFVGSKSSGAPREFLLRDKTSSLWSPSHMYLLLPLEDNSTDELRIHWPGITACTLAAEFLNKNSLLGTEQSDDDGSNPSLNSTGSPVTYCKETNIIRFANSSVDANSLRNTVVLAIHTGRIYCIIEAVSDKTAESSFAETVDTVSSEFATFYEYFYKKYNIVLKHPGQPLMLLKQSHNPHNLLVNFNDEGVSAKASQAGVVNEKPRFHVHMPPELLLVLDVPVSVLKSLYLLPSLMHRLESLMLANQLREEINFCSSNIDIPSSMILEALTTLRCCESFSMERLELLGDSVLKYAVSCHLFLRYPNKHEGQLSARRSLAVCNSTLHKLGTDHKIQGYIRDSAFDPRRWVAPGQRVLRPVPCKCGVDSLEVPLDKKFQTEDPKVKVGKSCDRGHRWLCSKTISDCVEALIGAYYLSGGLVAALHVMKWLGIDAELDPLVVAEVINQASLRTYVPNYEIHMIESKVGYNFSVKFFLQEALTHESLHESYCYQRLEFLGDSVLDLLITQYLYNHHTDIDPGELTDLRSASVNNENFAQVAVRHDLHKHLQHCSTLLSNQISEYVRSFTESDNTTRLDPSIKGPKALGDLVESIVGAILIDTNLNLDKVWRIVEPLLSPIVTPDKLELPPFRELNELCDSLGYFIKEKCKNKGEVVHAELLLQLDHDLLVGEGFDRSRKVAKGKAASCLLKDLEVRIHKSLSGHEKGVSLVTSAI

SEQ ID NO: 561 - protein, 1462 aa, Gossypium raimondii
MHSPMEEEQCYPLKTTFSETHLHPSQIMVSINDDHAKNHHPSSSSNPDHSSPRGHQLQVVRYKMIAVMLIKDFVQPINSIDKKKLIIFLAPTVHLVNQQFEYIKFHTSLDVEQYYGDKGVNEWNSGYWEKDIKEHDVLVMTPQILLDALWKAFLSLEMVSLMIIDECHHATGNHPYAKIMKEFYHKSNNKPKIFGMTASPLVSKGALSNNDCEDQLSELENVMDCMIYAIEDMTEMETYVPTAKESCRFFDPTRFCSSGLKAMIEASWLKIDASLSTLQGSIQTSYTDMDDKFKALHKRSSNDHAKILHCLDDLGLICAYEAVKVCLENIPDTKEECEAYKEGVLQCKRFLNEVLQIIRESLPLGDENFLNSGFDYLKAVDSGYISPKLHELIEFFLSLGEPSQVLCLVFVERIVTAKVIERFVKKVSCLSCFVVSCLTGSNTSVDSMAPKIQKETLEYFMVNDCGEGIHIPNCSYVIRFDLPKTVLSYVQSRGRARQSGSQFIMILERGNEKQRDQLYDLIRSEHSMTNTAMNRDPDLSLPENRTLEETNVSIVAATGASIEETSKNRCASKGKDPIFDSGTTRWKELHGTTQIRAFSGSWGEKADASVFFAYKIDFSCNVVSVVYSGFLTDDVGNIEVDLYLIGKIAKARVSFYGKVHLDAVQITAAKRFQEIFFNGLFGRLFVGSSRTSRELLFHSKTSLLWHPFNMYLLLPLEDSLSNELRINWPGITACTLAVEFLTADGNRGNPSLNQTDSSVTEHKETNVIHFANRSIDVNNISNIVVLAIHTGRIYSTIELVHDTSAKSSFNDIVDMNSLKFATFSEYYNRKYCIVLKHPGQPLLLLKQSHNPHNLLVDFNDEGCRFSAQALQASSVNEKSWNTIHMPPKLLLILDVPVYVLKAFYLLPSLMHRLESLMLASQLREEIDFRSSNFDIPSSMILEALTTLRCCESFSMERLEFLGDSVLKYAGYIRDSAFDPRRWVAPGQLRLRSFPCNCRVDSREVPLDKKFQTEDLEIKVSISCDRGHRWMCSKTISDCVEALIGAYYVSGGLIAALHMMKWLGIDAELDPSLVAEAINRASLQSYKFSMKFFLQEALTHASANEFYCYQRLEFLGDSVLDLLITRYLYCNHTDIDSGELTDLRSASVSNETFAQVAVRNDLHKHLRHCSTLLLDQISEYAQSLPESWDTTRSVPGIKGPKICSNLIESIVAAILIDTNLNLDEVWRIVEPLLSLIVTPDKLEEKCVNTGEMVHAKLWLQLDDILLVGEAFNRSKKVAKGKAALYLLKELEDRGISRKRTKQDHAGSSGTTDDDLLEPKMCKKQRIAEIPSPTNDSSRTAYGAEIPSPANASSRTAYVIARINTNKGRPRATLYEICRKQLWPRPTFETTEGRSRSPMEIGKGADRKIGFNSFVTKITLNGPSSGIIECSGDVRADKKSSCDSAAILMLYRLKELGKLIIRES

SEQ ID NO: 562 - protein, 654 aa, Gossypium raimondii
MLRSFSWPILQVKRMVDNNSGGEADNFDWDTEDDLEIDNYAISAPSGLSTPCGEAVLGSAEAGSSGNSPNSKIIDHFVGMGFSREMVAKVIEEKGEENSDLILETLLEYSASTLPSSSNSKLIDHFVGMGFSEEMVVKVVQENGEGNTDSILETLLTYSALETTAPVQQNPDSGNCSSDYEGSLLNDFSDFDSFSETEEIISPSSEEGRKLLHLTKMGYSEAEASVAMERCGPDSTIEELTDFICAAQIAKAADALFPLEDKKPFSNGSSHKKRRNWGYDLLLRKKKLKLEKRFDEDDDVVHLPNPMIGFGVPNEPDQITHRVLPEAALGPPYFYYENVALAPKGVWTTISRFLYDVEPEFVDSKFFCAAARKRGYVHNLPIDNRFPLLPFPPRTIHEAFPLTRKWWPSWDTRTKLNCLQTCIASARLTDKIRKALEDSDGEPLLGIQKFVLEQCRKWNLVWVGRNKVAPLEPDEVEMLLGFPRNHTRGGGISRTDRYKSLGNSFQIDTVAYHFSVLKDKFPGGINLLSLFSGIGGAEVALHRLGIPLKNVVAVEIAEVNRNILRSWWEQTNQRGTLTDIQDVQELNGDRLEQLIKNFGGFDLVVGGSPCNNLTGSNRYHRDGLEGKDSALFFDFCRILDLVKCIMNGTKSMIV

SEQ ID NO: 563 - protein, 653 aa, Gossypium raimondii
MLRSFSWPILQVKRMVDNNSGGEADNFDWDTEDDLEIDNYAISAPSGLSTPCGEAVLGSAEAGSSGNSPNSKIIDHFVGMGFSREMVAKVIEEKGEENSDLILETLLEYSASTLPSSSNSKLIDHFVGMGFSEEMVVKVVQENGEGNTDSILETLLTYSALETTAPVQQNPDSGNCSSDYEGSLLNDFSDFDSFSETEEIISPSSEEGRKLLHLTKMGYSEAEASVAMERCGPDSTIEELTDFICAAQIAKAADALFPLEDKPFSNGSSHKKRRNWGYDLLLRKKKLKLEKRFDEDDDVVHLPNPMIGFGVPNEPDQITHRVLPEAALGPPYFYYENVALAPKGVWTTISRFLYDVEPEFVDSKFFCAAARKRGYVHNLPIDNRFPLLPFPPRTIHEAFPLTRKWWPSWDTRTKLNCLQTCIASARLTDKIRKALEDSDGEPLLGIQKFVLEQCRKWNLVWVGRNKVAPLEPDEVEMLLGFPRNHTRGGGISRTDRYKSLGNSFQIDTVAYHFSVLKDKFPGGINLLSLFSGIGGAEVALHRLGIPLKNVVAVEIAEVNRNILRSWWEQTNQRGTLTDIQDVQELNGDRLEQLIKNFGGFDLVVGGSPCNNLTGSNRYHRDGLEGKDSALFFDFCRILDLVKCIMNGTKSMIV

SEQ ID NO: 564 - protein, 635 aa, Gossypium raimondii
MVDNNSGGEADNFDWDTEDDLEIDNYAISAPSGLSTPCGEAVLGSAEAGSSGNSPNSKIIDHFVGMGFSREMVAKVIEEKGEENSDLILETLLEYSASTLPSSSNSKLIDHFVGMGFSEEMVVKVVQENDSILETLLTYSALETTAPVQQNPDSGNCSSDYEGSLLNDFSDFDSFSETEEIISPSSEEGRKLLHLTKMGYSEAEASVAMERCGPDSTIEELTDFICAAQIAKAADALFPLEDKKPFSNGSSHKKRRNWGYDLLLRKKKLKLEKRFDEDDDVVHLPNPMIGFGVPNEPDQITHRVLPEAALGPPYFYYENVALAPKGVWTTISRFLYDVEPEFVDSKFFCAAARKRGYVHNLPIDNRFPLLPFPPRTIHEAFPLTRKWWPSWDTRTKLNCLQTCIASARLTDKIRKALEDSDGEPLLGIQKFVLEQCRKWNLVWVGRNKVAPLEPDEVEMLLGFPRNHTRGGGISRTDRYKSLGNSFQIDTVAYHFSVLKDKFPGGINLLSLFSGIGGAEVALHRLGIPLKNVVAVEIAEVNRNILRSWWEQTNQRGTLTDIQDVQELNGDRLEQLIKNFGGFDLVVGGSPCNNLTGSNRYHRDGLEGKDSALFFDFCRILDLVKCIMNGTKSMIV

SEQ ID NO: 565 - protein, 636 aa, Gossypium raimondii
MDQNGSGGDADNFDWDTEDELEIDNYAIASRSGVSLTNGEAVLGTAEVSSSADSPNSKLIDHFVGMGFSQELVTKAIEENGEENSNLILEALLRYSASSLASSSNSKLIDHFVGMGFSEEMVLKAVQENGEGNTDTILETLLTYSALEKSAPVQQHADSDDFSSDCEGNFLDDFTDIDSSSDTEEIINTGSDEESKLLYLTKMGYSEAEASVAMERCGPDSSIAELTDFICAAQMAKAADALFPVEDRKPFCNGSNYNKRRNLGYDLWKRKKQMKLEKKLLNEDDDALHLPNPMIGFGVPTEPDLITQRTLPEAAVGPPYFYYENVALAPKGVWSTISRFLYDVEPEFVDSKFFCAAARKRGYIHNLPIENRFPLLPFPPRTIHEAFPLTRKWWPSWDPRTKLNCIQTCTASARLTERIRKALEAYDGEPPLNVQKYVLDECRKWNLVWVGRNKVAPLEADEVEMLLGFPKNHTRGGGMSRTDRYKSLGNSFQVDTVAYHLSVLKDMFPGGINLLSLFSGIGGAEVALHRLGIPLKNVVSVEISEVNRNIVRGWWEQTNQRGTLIDIADVQELNGDRLEQLMSRFGGFDLVVGGSPCNNLAGSNRHHRDGLEGKESSLFFDYCRILDLVRCMQRNQ

SEQ ID NO: 566 - protein, 636 aa, Gossypium raimondii; identical to SEQ ID NO: 565

SEQ ID NO: 567 - protein, 532 aa, Gossypium raimondii
MIYMCLLCLALTKVKENVNMFVHPWKGIIANIPTTLQDGKHVGESGRKLREDLAKKGFNPLKVQPLWNRHGHSGYAIVEFNKEWDGFNNAIMFEKSFELDHYGKKDYYSSRRKKDKLYAWVAREDDYYSGGLIGEYLRRNGDLKTVSSKEAEDRRKTSKLLTTLNNTLETKNQRLQEMQNKFNEVSSSMSTLMWQKDDMIRAYNEECKKMQENAHNHFKQISLEHERNAKCILDQKRELEQREKELLQREAQNENETKKLQHEKMINERAALEQKKADETMFKLAEEHKRDKEKLHREIIKLEKQLDTRQGLELEIQRLRGALQVMEHMNGDGDADTKKRMEVIQDELKEKEEELEDLEDLNQALIIKERKSNDELQDARKELITAFKDVSTRAHIGVKKMGEVDIKPFLVAAKRKYSAKEADVKSAELCTLWQDYLRDPSWHPFKILKDKEGNCKEILDEEDEKLVELKTELGDEAYNAVTMALKQMNEYNPSGRYVVPELWNFNEGRKATLTDGVQHLLNKWKLHKRRRY

SEQ ID NO: 568 - protein, 983 aa, Gossypium raimondii
SQSFKSNGNKDAKIMNIDRINGMGLRRSPRLSSAPPETKDCSSKTIFKSSENGSYSETRPSGTDKEAVLSKRNDPNFSDEKQRRKSPRFVAGTEHCGGNGSLRKFQDLNSGFPLKQLRRSLKISQATKNVCPDVSITRLDMDERGSSGEKRLGISPSSVHATENGDSNASFREHRREMSVEKQLKTPSSLSTLLAEGDSAEVNSSSNRLSNSCDEQPSKKFKISSAESDIDDDDDEDKIVWNVECHYAQAEIDGCTINLGDCVYIKGEEAKHHIGRILEFFRTTDGENYFRVQWFYRAEDTVMKQEATLHGESRLFYSTIVNDNLIDCIISKVSVTQISPKFGSKSNSLPQSDFYFDMEYCVDYSTFCTLPTDIFSDNSFKSHSSSKCYEEVFPTTPAFSANIPSFGTYKAQLTKLDLYSGCGGMSTGLCLGAKASCNDLVAKWAVDSDKSPCESLKLNHPETHVRNEAADDFLQLLKEWEKLCKQYRVKNLERTYPSRSRISETVWNNASSAKDSGTPDEHEVSSLVDICYGDPCDTGNRGLKFKVCWKGYSASDDTWEPIESLRNCQECIQEFVTNGFRSKILPLRGDVDVICGGPPCQGISGYNRHRNVDSPLDDEKNRQIVVFVDIVEYLKPKFVLMENVVDIMRLVKASLGRYALSRLVLMKYQARLGIVAAGCYGLPQFRLRVFLFGAHSSEKLPQFPLPTHDVIIRYGYPAEFERNTVAYDEGQPRQLEDALVLRDSFSDLPPVANNEAREKMTYEKPPETDFQRYIRSSEYKMTGSELNGAKRITNLLYDHRPSPLSEDDYIRVCLNPKRKGANFRDLPGVIVGTDNVAWRGRTQEQQFLPSGKPLVPDYVFTLKQGKSKRPFARLWWDETMPTVLTAPFCHSQAILHPEQDWLLTAREWARLQGFPDYYRFRGTIKERYCQIGNAVAVPVGRALGYTMGMAFQKGSGNEPLMILPPKVFSFHQYPVSKIIVPKH

SEQ ID NO: 569 - protein, 1577 aa, Gossypium raimondii
MGSVALLDSNSPSGMKKNKKGKNKSAKSSTKKEMETDKKVQKRNSAQENGEPVPSKRPKRAAACTDFKEKAVCISEKDSVVETKKDMVVEDEILAVALTCEKDDGRPNRRLTDFVLHNSEGLPQPFEMLEVIDMFITGLILPLEENTDKEKVKEKSVRCEGFGHVESWDISGYEDGCPVIWLSTDVADYTCCKPSGSYKKYYEHFFEKARACVEVYKKLSKPSGGNPDLSLDELLAGVVRSMSGSKSFSRGASIRDFVISQGEFIYNQLIGLDATSRVNDQVFAGLPVLTALKDESRKRENIGLDIALFSGGALTIGKKGEGESKLDETYSSTFTAEEDEDAKLAKLLQEEEYWKSMKQKRNQGSASMSNKFYIKINEDEIANDYPLPAYYKNSNEETDELVVFESDFDVCDPEELPRSVLHNWSFYNSDSRLISLELLPMKPCADIDVTIFGSGVMTADDGIGFCLDNDLSQSTSGSSSVLNADGIPIFLSAIKEWMIEFGSSMIFISIRTDMAWYRLGKPSKQYLPWYEPVLKTARVAISIITLLKEQTRVSRLSFNDVIKRVSEFKKDNRAFISSDPAAVERYIVVHGQIILQLFAEFPDEKIKKCAFVVGLANKMEERHHTKWLVKKKKVVHKNEPNLNPRAAMMPIASIRKAMQATTTRLINRIWGEYYSNYSPEDSKEETNCEVKDEDENEEQEENEDDDGDANAEAEAEAEAEAEAEADANANAEDKPIPMETQKSPSVSKQPRQCSTEEVSWDGEPVSQTSSDKPLYKRAIVHGEVVVVGSAVSVEVDLYELPAIYFVEYMFETSKGRKMFHGRMMQRGSETVLGNAANEREVFLTNNCGDFELEDVKQTVVVDIRLRPWGYQHRKDNANMDKLDRAEAEERKRKGLPMEYYCKSLYWPERGAFYTLPIDSLGLGSGCCHSCQVKDAGRAKEVFKVNSSNTGFVYKGTEYSLHDYVYVSPHQFTVERAETENFKAGRNIGLKPYVVCQVLEIIIPKGQKKVCEESTQVKVRRFFRPEDISAEKAYSSDIREVYYSEETDILFVEAIEGKCEVRKKNDLPACNSPVIFHHVFFCDRIYDPSNGSLKQLPAQVKLRYSTGIVDNEIAYQKKKGKGKQEESELEVEKQQEAYQENRLATLDIFAGCGGLSEGLHQSGVSLTKWAIEYEEPAGDAFKLNHPESLVFIKNCNVILRAIMEKCGDVDDCISTSEAAELAASLDEKEINDLPLPGQVDFINGGPPCQGFSGMNRFNHSTWSKVQCEMILAFLSFADYFRPRYFLLENVRNFVSFNKGQTFKLTLASLLEMGYQVRFGILEAGAYGVSQSRKRAFIWAASPEETLPEWPEPMHVFAVPELKVTLSHNLQYAAVRSTASGAPFRAITVRDTIGDLPAVGNGASKTNLEYQSEAVSWFQKKIRGNMAVLTDHISKEMNELNLIRCQKIPKRPGADWHDLPDEKVKLSTGQLVDLIPWCLPNTAKRHNQWKGLFGRLDWEGNFPTSITDPQPMGKVGMCFHPEQDRILTVRECARSQGFPDIYKFAGNIQHKHRQIGNAVPPPLAFALGRKLKEALDSKK

SEQ ID NO: 570 - protein, 1569 aa, Gossypium raimondii
MGSVALLDSNSPSGMKKNKKGKNKSAKSSTKKEMETDKKVQKRNSAQENGEPVPSKRPKRAAACTDFKEKAVCISEKDSVVETKKDMVVEDEILAVALTCEKDDGRPNRRLTDFVLHNSEGLPQPFEMLEVIDMFITGLILPLEENTDKEKVKEKSVRCEGFGHVESWDISGYEDGCPVIWLSTDVADYTCCKPSGSYKKYYEHFFEKARACVEVYKKLSKPSGGNPDLSLDELLAGVVRSMSGSKSFSRGASIRDFVISQGEFIYNQLIGLDATSRVNDQVFAGLPVLTALKDESRKPLFSGGALTIGKKGEGESKLDETYSSTFTAEEDEDAKLAKLLQEEEYWKSMKQKRNQGSASMSNKFYIKINEDEIANDYPLPAYYKNSNEETDELVVFESDFDVCDPEELPRSVLHNWSFYNSDSRLISLELLPMKPCADIDVTIFGSGVMTADDGIGFCLDNDLSQSTSGSSSVLNADGIPIFLSAIKEWMIEFGSSMIFISIRTDMAWYRLGKPSKQYLPWYEPVLKTARVAISIITLLKEQTRVSRLSFNDVIKRVSEFKKDNRAFISSDPAAVERYIVVHGQIILQLFAEFPDEKIKKCAFVVGLANKMEERHHTKWLVKKKKVVHKNEPNLNPRAAMMPIASIRKAMQATTTRLINRIWGEYYSNYSPEDSKEETNCEVKDEDENEEQEENEDDDGDANAEAEAEAEAEAEAEADANANAEDKPIPMETQKSPSVSKQPRQCSTEEVSWDGEPVSQTSSDKPLYKRAIVHGEVVVVGSAVSVEVDLYELPAIYFVEYMFETSKGRKMFHGRMMQRGSETVLGNAANEREVFLTNNCGDFELEDVKQTVVVDIRLRPWGYQHRKDNANMDKLDRAEAEERKRKGLPMEYYCKSLYWPERGAFYTLPIDSLGLGSGCCHSCQVKDAGRAKEVFKVNSSNTGFVYKGTEYSLHDYVYVSPHQFTVERAETENFKAGRNIGLKPYVVCQVLEIIIPKGQKKVCEESTQVKVRRFFRPEDISAEKAYSSDIREVYYSEETDILFVEAIEGKCEVRKKNDLPACNSPVIFHHVFFCDRIYDPSNGSLKQLPAQVKLRYSTGIVDNEIAYQKKKGKGKQEESELEVEKQQEAYQENRLATLDIFAGCGGLSEGLHQSGVSLTKWAIEYEEPAGDAFKLNHPESLVFIKNCNVILRAIMEKCGDVDDCISTSEAAELAASLDEKEINDLPLPGQVDFINGGPPCQGFSGMNRFNHSTWSKVQCEMILAFLSFADYFRPRYFLLENVRNFVSFNKGQTFKLTLASLLEMGYQVRFGILEAGAYGVSQSRKRAFIWAASPEETLPEWPEPMHVFAVPELKVTLSHNLQYAAVRSTASGAPFRAITVRDTIGDLPAVGNGASKTNLEYQSEAVSWFQKKIRGNMAVLTDHISKEMNELNLIRCQKIPKRPGADWHDLPDEKVKLSTGQLVDLIPWCLPNTAKRHNQWKGLFGRLDWEGNFPTSITDPQPMGKVGMCFHPEQDRILTVRECARSQGFPDIYKFAGNIQHKHRQIGNAVPPPLAFALGRKLKEALDSKK

SEQ ID NO: 571 - protein, 1563 aa, Gossypium raimondii
MKKNKKGKNKSAKSSTKKEMETDKKVQKRNSAQENGEPVPSKRPKRAAACTDFKEKAVCISEKDSVVETKKDMVVEDEILAVALTCEKDDGRPNRRLTDFVLHNSEGLPQPFEMLEVIDMFITGLILPLEENTDKEKVKEKSVRCEGFGHVESWDISGYEDGCPVIWLSTDVADYTCCKPSGSYKKYYEHFFEKARACVEVYKKLSKPSGGNPDLSLDELLAGVVRSMSGSKSFSRGASIRDFVISQGEFIYNQLIGLDATSRVNDQVFAGLPVLTALKDESRKRENIGLDIALFSGGALTIGKKGEGESKLDETYSSTFTAEEDEDAKLAKLLQEEEYWKSMKQKRNQGSASMSNKFYIKINEDEIANDYPLPAYYKNSNEETDELVVFESDFDVCDPEELPRSVLHNWSFYNSDSRLISLELLPMKPCADIDVTIFGSGVMTADDGIGFCLDNDLSQSTSGSSSVLNADGIPIFLSAIKEWMIEFGSSMIFISIRTDMAWYRLGKPSKQYLPWYEPVLKTARVAISIITLLKEQTRVSRLSFNDVIKRVSEFKKDNRAFISSDPAAVERYIVVHGQIILQLFAEFPDEKIKKCAFVVGLANKMEERHHTKWLVKKKKVVHKNEPNLNPRAAMMPIASIRKAMQATTTRLINRIWGEYYSNYSPEDSKEETNCEVKDEDENEEQEENEDDDGDANAEAEAEAEAEAEAEADANANAEDKPIPMETQKSPSVSKQPRQCSTEEVSWDGEPVSQTSSDKPLYKRAIVHGEVVVVGSAVSVEVDLYELPAIYFVEYMFETSKGRKMFHGRMMQRGSETVLGNAANEREVFLTNNCGDFELEDVKQTVVVDIRLRPWGYQHRKDNANMDKLDRAEAEERKRKGLPMEYYCKSLYWPERGAFYTLPIDSLGLGSGCCHSCQVKDAGRAKEVFKVNSSNTGFVYKGTEYSLHDYVYVSPHQFTVERAETENFKAGRNIGLKPYVVCQVLEIIIPKGQKKVCEESTQVKVRRFFRPEDISAEKAYSSDIREVYYSEETDILFVEAIEGKCEVRKKNDLPACNSPVIFHHVFFCDRIYDPSNGSLKQLPAQVKLRYSTGIVDNEIAYQKKKGKGKQEESELEVEKQQEAYQENRLATLDIFAGCGGLSEGLHQSGVSLTKWAIEYEEPAGDAFKLNHPESLVFIKNCNVILRAIMEKCGDVDDCISTSEAAELAASLDEKEINDLPLPGQVDFINGGPPCQGFSGMNRFNHSTWSKVQCEMILAFLSFADYFRPRYFLLENVRNFVSFNKGQTFKLTLASLLEMGYQVRFGILEAGAYGVSQSRKRAFIWAASPEETLPEWPEPMHVFAVPELKVTLSHNLQYAAVRSTASGAPFRAITVRDTIGDLPAVGNGASKTNLEYQSEAVSWFQKKIRGNMAVLTDHISKEMNELNLIRCQKIPKRPGADWHDLPDEKVKLSTGQLVDLIPWCLPNTAKRHNQWKGLFGRLDWEGNFPTSITDPQPMGKVGMCFHPEQDRILTVRECARSQGFPDIYKFAGNIQHKHRQIGNAVPPPLAFALGRKLKEALDSKK

SEQ ID NO: 572 - protein, 1563 aa, Gossypium raimondii; identical to SEQ ID NO: 571

SEQ ID NO: 573 - protein, 1481 aa, Gossypium raimondii
MASMESDSSEEQENSTAFLTGIKFHVSNDADNENMSILEITAPSEVSDPRLGFPNFSNHCTTCDARDMKQCEGHFGVIKFPYTILHPFFLSEVVHILNKICPGCKSIRKDLWMKGANSIARLLETKGCKYCVGNSIEWYPPMRFKITSKELFRKSAIMVEVSENSLMKVRKRGRQALPADYWDFIPKDQQQEEGFVKPGRRVLSHAQVRHLLKDVNPEFIKKFISEADSIFLNFFPVTPNSHRVTEIMHTSSNAQRLIFDERTRVYKKLVDFRGLANELSSHVLECLKISKLHVEKPSTEDSALIAALKKNKDSASNMSGLRYMKDVILGKRNDHCFRMVLTGNPNLKLSEIGIPCHVAEKLQIAEQLNRWNEERLKTCCNLRILEKGEIRIRREGKLVRIRHNEKVQVGDTIYRPLNDGDTVLINRPPSIHQHSLIALSVKVLPVNSVVSINPLICSPFRGDFDGDCLHGYVPQSINTRVELSELVSLDRQLINGQSGRNLLSLSHDSLTAAYLVKEDGVLLNLFQMQQLEMFCPNHSPLPAIVKAPLLSNPVWTGKQLFSMLFPPEFDYVFAPSGVVIHNGDLICSSEGSSWLRDADGNLFQSLIKHYQGKVLDFLHAAQEVLCEWLSMRGLSVSLLDLYLSPDTDSQKNMMDEIFYGLQEAEQTCNFKQLMVDSCQDFLAGNDEETNRFMVLDVEQMCYEKQRSAALSQASVDSFKQVFRDIQNLLYKYANKDNSLFTMFKAGSKGNLLKLVQHSMCLGLQHSLVPLSFRFPHQLSCAAWNNQKSHILTQKVDDTDESAKKYIPYAVVESSFVKGLNPLECFVHSVTTRDTSFSDNADLPGTLSRRLMFFMRDLCAAYDGTVRNAYGDQVVQFCYNIDKGTFSPTSCPDKLVSQGSSLPDGIGGQPVGSLSACAISEAAYSALDQPISLLESSPLLNLKRVLECGSKRSNADQTMSLFLSGKLVRRRHGQEYGALEVKNHLERLIFKDIVSTVSIIFSPQMSSENRFSPWVCHFHVFKDIVTRRRLTVHSIIDALHMHCTNAKRLWKINLPDMQVTSKACSVIDMENEDDTFCITVTIVECKTSRIELDVIQDMVIPSLLEAVVKGFPEIKKVEILWNEDFRVPNSHKPAPGELYLRVSVSGDFGITKLWSVLMNDCLQLMDIIDWTRSHPDNINQFCLAFGIDAGWRFFLNNMKSAISDTGKSILNEHLHLAANCLSATGEFVGLNSKGLKQQREHAFVSSPFMQACFSNPSACFVKAAKTGVADNLQGTIDLLAWGRVPRIGTGGQFDIVYSMKDEELAEPVDVYKLLGDSINSKKQDIEFEVPKVFNPTSEKHSSPFKGALRDSVFDEWKKIETKTRSLLRGRLTLNDVQRLERNLKNILRKYPIDHRVSEADWDTLMMALYFHPHRVEKIGSGAKEIKVGHHPDHADSRCFFLVRTDETTVDFSYRKCVVGALEIIAPCRAQSYKSKWLQHGSL

SEQ ID NO: 574 - protein, 1481 aa, Gossypium raimondii; identical to SEQ ID NO: 573

SEQ ID NO: 575 - protein, 1478 aa, Gossypium raimondii
MESDSSEEQENSTAFLTGIKFHVSNDADNENMSILEITAPSEVSDPRLGFPNFSNHCTTCDARDMKQCEGHFGVIKFPYTILHPFFLSEVVHILNKICPGCKSIRKDLWMKGANSIARLLETKGCKYCVGNSIEWYPPMRFKITSKELFRKSAIMVEVSENSLMKVRKRGRQALPADYWDFIPKDQQQEEGFVKPGRRVLSHAQVRHLLKDVNPEFIKKFISEADSIFLNFFPVTPNSHRVTEIMHTSSNAQRLIFDERTRVYKKLVDFRGLANELSSHVLECLKISKLHVEKPSTEDSALIAALKKNKDSASNMSGLRYMKDVILGKRNDHCFRMVLTGNPNLKLSEIGIPCHVAEKLQIAEQLNRWNEERLKTCCNLRILEKGEIRIRREGKLVRIRHNEKVQVGDTIYRPLNDGDTVLINRPPSIHQHSLIALSVKVLPVNSVVSINPLICSPFRGDFDGDCLHGYVPQSINTRVELSELVSLDRQLINGQSGRNLLSLSHDSLTAAYLVKEDGVLLNLFQMQQLEMFCPNHSPLPAIVKAPLLSNPVWTGKQLFSMLFPPEFDYVFAPSGVVIHNGDLICSSEGSSWLRDADGNLFQSLIKHYQGKVLDFLHAAQEVLCEWLSMRGLSVSLLDLYLSPDTDSQKNMMDEIFYGLQEAEQTCNFKQLMVDSCQDFLAGNDEETNRFMVLDVEQMCYEKQRSAALSQASVDSFKQVFRDIQNLLYKYANKDNSLFTMFKAGSKGNLLKLVQHSMCLGLQHSLVPLSFRFPHQLSCAAWNNQKSHILTQKVDDTDESAKKYIPYAVVESSFVKGLNPLECFVHSVTTRDTSFSDNADLPGTLSRRLMFFMRDLCAAYDGTVRNAYGDQVVQFCYNIDKGTFSPTSCPDKLVSQGSSLPDGIGGQPVGSLSACAISEAAYSALDQPISLLESSPLLNLKRVLECGSKRSNADQTMSLFLSGKLVRRRHGQEYGALEVKNHLERLIFKDIVSTVSIIFSPQMSSENRFSPWVCHFHVFKDIVTRRRLTVHSIIDALHMHCTNAKRLWKINLPDMQVTSKACSVIDMENEDDTFCITVTIVECKTSRIELDVIQDMVIPSLLEAVVKGFPEIKKVEILWNEDFRVPNSHKPAPGELYLRVSVSGDFGITKLWSVLMNDCLQLMDIIDWTRSHPDNINQFCLAFGIDAGWRFFLNNMKSAISDTGKSILNEHLHLAANCLSATGEFVGLNSKGLKQQREHAFVSSPFMQACFSNPSACFVKAAKTGVADNLQGTIDLLAWGRVPRIGTGGQFDIVYSMKDEELAEPVDVYKLLGDSINSKKQDIEFEVPKVFNPTSEKHSSPFKGALRDSVFDEWKKIETKTRSLLRGRLTLNDVQRLERNLKNILRKYPIDHRVSEADWDTLMMALYFHPHRVEKIGSGAKEIKVRHHPDHADSRCFFLVRTDETTVDFSYRKCVVGALEIIAPCRAQSYKSKWLQHGSL

SEQ ID NO: 576 - protein, 1397 aa, Gossypium raimondii
MKSKPMTSIETDLSEEQEVLAATMTGIKFNVSGDEDNGNSIDWYPPMTFKISSKELSKKSTIVVEVSEDSLMMVRKRGRQALPADYWDFIPKDQQEEEDGLMKPRRRVLSHAQVHYLLKDVDPEFIKKFIQNVDSIFLNCFPVTPNSHRVTEITHRSSNSQRLIFDERTRLYKRLVDFRGVANELSSHVLECLKISKASYSALFSFLYLLFQEKPSNEDNELILALTRNKDPVSNMSGLRYMKNVLLGKRNDHCFRMVLTGNPSLKLSEIGIPCPVAERLQIAEQLNKWNEERLKACCNLRILEKGEICIRREGTLVRIHHNEKIRLGDIIYRPLNNGDIVLINRPPSIHQHSFIALSVKVLPVSSSVSINPLICSPFRGDFDGDCLHGYVPQSINTRVELSELVSLNRQLINGQSGRNLLSLSHDSLSAAYLVNGDGVLLNLYEMQQLEMFCPNRSPSPAIIKAPLLSNPVWTGKQLFSMLFPPELDYGFSPSDLVIRNGELITSSEGSSWFRDADGNLFESLIKNCRGKVLDFLHGAQEVLCEWLSMRGMSVSLLDLYLTPDSNSRKNMMDEIFYGLQETELTCNFKQLMVDSFCDFLAGNNEEIDGFVGFDFERMCYEKQRSAAVNQASVDSFKQVFRDIQNLSYKYANKDNSLLTMFKAGSKGNLLKLVQHSMCLGLQRSVVPLSFRFPPKLSCSEWNDLKSQGLTQSGDDSVESAKNFIPYAVIESSFMTGLNPLECFVHSVTSRDSSFSDHADLPGTLSRRLMFFLRDLCASYDGTVRNAYGGQVVQFSYGSDKGTSTATSFANEIQSQGSILPDGTGGQPVGSLSACAISEAAYSALDQPISLLETSPLLNLKRVLECGSRRRNSDQTMTLFLSDKLGKGRHCFEYAALEIKNYLEKLIFSDIVSTVLITYSPQKSTENCFNPWVCHFHVCKEIMKRRRLSVHSIIGSLQMHYANAKKLWKINLPDIQVTSKSCSHTDMPNKDDMFCITVTIVEPSKRSHIELDVILAIVLPSLLEAVVKGFPEIKKVQILWNDRFKVSKSHKTSPGELYLRVAVTGGFGKTKLWGMLMNDCLPIMDLIDWTRSHPDDINQFCSAYGIDSGWKFFLNNLKSAISDTGKTILNEHLHLVADCLSVTGEFVGLNSKGLRLRQEHAFVSSPFMQACFSNPSASFVKAAKKGVSDNLQGTIDALSWGRVPCIGTGAQFDILYSMKDEMITEPVDVYNLLGNIVGSQNQDVEFEVPQACNIKSEKYVSELMDALGDSAFERLKNIETKILREFLTLNDIQRLSRTLKDILHKSPIGHRLSGADWNSAMMALYFHPRRDEKVGSGAQEIKVGYHPEHKNSRCFLLARTDGAIVDFSYHKCVIGALEVIAPDKVQFYKSKWSQSGNL

SEQ ID NO: 577 - protein, 1966 aa, Gossypium raimondii
MEENSSSVILDGEIVGIKFCLATPKEILTASVSGFPINHVSQLSNSYLGLPLEFGKCSACGTSEPGQCEGHFGYIELPIPIYHPSHISELKRLLSLLCLKCLKLKNKFQMKSGSVAERLLSSCCENTPQVSIKEVKTTDGACYLELKQPSRQSKTNWNFLERYGFRYGDHHTRTLLPCEVVEILKRIPSQTRRKLSGKGFFPQEGYILQYLPVPPNCLSVPDVSDGVSVMSSDLSTSMLRKVLKQVEIIKSSRSGTPNFESHEVEANDLQSAVEQYLQVRGTVKASRSIDARYGVNKDASDSSTKAWLEKMRTLFIRKGSGFSSRSVITGDPYKKVNEIGIPSEIAQRITFEERVNMHNMRYLQNLVDNKLCLTYRDGGSTYSLREGSKGHTFLRPGQVVHRRIMDGDIVFINRPPTTHKHSLQALSVYVHDDHTVKINPLICGPLSADFDGDCIHLFYPQSLSAKAEVYELFSVEKQLLSSHSGNLNLQLATDSLLSLRVMLKTFLFKKADAQQLSMFLSSALPEPAFLKCNHVAPCWTAFQILQTAFPACLDCSSDRYLIGKSDILKVDFNKDLMQSVINEVVASIFYEKGPKEVLNFFDSLQPLLMENIFAEGFTVCLEDFSVSREVIENIQKDIQVISPLLYQLRSTYNELVELQMENHIRVAKEPIADFILKTSSLGNLIDSRSDSAVNKVVQQIGFLGMQLSDKGKFYSKTLVEDVAHQFQSIYPSDAIDYPSAEFGLIKSCFFRGLDPYEGIVHSISTREVMVRSTRGLSEPGTLFKNLMAILRDVVICYDGTVRNVSSNSIIQFQYGLSARTRPQFPAGEPVGVLAATAMSNPAYKAVLDSSPSSNSSWELMKEILLCKVSFKNDPIDRRVILYLKDCDCGRKYCQENAAYLVKNHLRRVKLKDIAVDFIIEYQQQQIVSEIEAGLVGHILLNKDLLKELSVSVQEIHMKCQETINSFRKKKKTAETFKRTDLFVSESCSIQQSCVDKWLDMPCLMFFFRNTNDDNLDSAIQILADIIYPVLLQTVIKGDPRICSAKIIWVNPDATTWIRNPSKTQKGELALEVVLEKSAVKQNGDAWRTVIDCCLPVLNIIDTHRSIPYAIKQVEQLLGISCAFEQAVQRLSTSVSMVTRGVLKEHLMLLANSMTCCGNLIGFNSGGYKTLSRSLNIQVPFTEATLFTPRKCFERAAEKCYDDSLSSIVASCSWGKRVAVGTGSRFDLLWNQESGSDQMSGMDVYNFLHMVSGAGGSNSNTACLGEEVDDLMDEWCLSPDHSTGLDKPVFEDAAEFENNLDGQSASANWEKDVSLDKVSDVGWDASGWNKNAEDVDKFAAAATSSEKQNEWSGWGASKSNSQDVGWDALSGWNKNAEDGDKFAAAATSSKKQNECSDWGASKSKSQDVVSPKVDVGWDALSAWHKNAEDGDNFAAAASSSKKQSEWSDWGMSKSKSQDVSPKTDGTCMKEQTELSGWEMKKFDTRDVLPVEERASKPNGWDSGASWGIMSKESEELDASAAAPWSGWGTKDSSPKKSLDKTSKSSSWDTVSSWGRKTAAVHESGFIGNDNQPGQGRIENEWDNKASQVKPVQSASGWNNKVTEEMVVQSTSSWDEKASWEKPVQSMSGWVSSSAAGSDESPTKGCSKNSNWDQQKAQTMNNAWDQQKSPATNSSWDRQKSSTANNSWDQQKPPANSSWDQEKSPTINNSWDQQKSPECSQGWGTLNDLNQPASSSGWDMPQGEDNTQSEKQHQWGQSKGSRRWASDANKKSRPLKPARMMNDDSSMAAMYTVTRQRLDMFTSEEKDILLDVEPLMQSIRKIMHQTGYNDGDPLSADDQTFVLDNVLAHHPDKAVKMGAGIDYVMVNKHSLFLDTRCLYVVTTDGHKQDFSYLKCLENMIKGKYPDLAEAFVAKYFRKSRGNRERGVAPENSQGNRDQSVTQDDNSQGNRDRSDRSVAQDDNEGEVKQ

SEQ ID NO: 578 - protein, 1883 aa, Gossypium raimondii
MEENSSSVILDGEIVGIKFCLATPKEILTASVSGFPINHVSQLSNSYLGLPLEFGKCSACGTSEPGQCEGHFGYIELPIPIYHPSHISELKRLLSLLCLKCLKLKNKFQMKSGSVAERLLSSCCENTPQVSIKEVKTTDGACYLELKQPSRQSKTNWNFLERYGFRYGDHHTRTLLPCEVVEILKRIPSQTRRKLSGKGFFPQEGYILQYLPVPPNCLSVPDVSDGVSVMSSDLSTSMLRKVLKQVEIIKSSRSGTPNFESHEVEANDLQSAVEQYLQVRGTVKASRSIDARYGVNKDASDSSTKAWLEKMRTLFIRKGSGFSSRSVITGDPYKKVNEIGIPSEIAQRITFEERVNMHNMRYLQNLVDNKLCLTYRDGGSTYSLREGSKGHTFLRPGQVVHRRIMDGDIVFINRPPTTHKHSLQALSVYVHDDHTVKINPLICGPLSADFDGDCIHLFYPQSLSAKAEVYELFSVEKQLLSSHSGNLNLQLATDSLLSLRVMLKTFLFKKADAQQLSMFLSSALPEPAFLKCNHVAPCWTAFQILQTAFPACLDCSSDRYLIGKSDILKVDFNKDLMQSVINEVVASIFYEKGPKEVLNFFDSLQPLLMENIFAEGFTVCLEDFSVSREVIENIQKDIQVISPLLYQLRSTYNELVELQMENHIRVAKEPIADFILKTSSLGNLIDSRSDSAVNKVVQQIGFLGMQLSDKGKFYSKTLVEDVAHQFQSIYPSDAIDYPSAEFGLIKSCFFRGLDPYEGIVHSISTREVMVRSTRGLSEPGTLFKNLMAILRDVVICYDGTVRNVSSNSIIQFQYGLSARTRPQFPAGEPVGVLAATAMSNPAYKAVLDSSPSSNSSWELMKEILLCKVSFKNDPIDRRVILYLKDCDCGRKYCQENAAYLVKNHLRRVKLKDIAVDFIIEYQQQQIVSEIEAGLVGHILLNKDLLKELSVSVQEIHMKCQETINSFRKKKKTAETFKRTDLFVSESCSIQQSCVDKWLDMPCLMFFFRNTNDDNLDSAIQILADIIYPVLLQTVIKGDPRICSAKIIWVNPDATTWIRNPSKTQKGELALEVVLEKSAVKQNGDAWRTVIDCCLPVLNIIDTHRSIPYAIKQVEQLLGISCAFEQAVQRLSTSVSMVTRGVLKEHLMLLANSMTCCGNLIGFNSGGYKTLSRSLNIQVPFTEATLFTPRKCFERAAEKCYDDSLSSIVASCSWGKRVAVGTGSRFDLLWNQESGSDQMSGMDVYNFLHMVSGAGGSNSNTACLGEEVDDLMDEWCLSPDHSTGLDKPVFEDAAEFENNLDGQSASANWEKDVSLDKVSDVGWDASGWNKNAEDVDKFAAAATSSEKQNEWSGWGASKSNSQDVGWDALSGWNKNAEDGDKFAAAATSSKKQNECSDWGASKSKSQDVVSPKVDVGWDALSAWHKNAEDGDNFAAAASSSKKQSEWSDWGMSKSKSQDVSPKTDGTCMKEQTELSGWEMKKFDTRDVLPVEERASKPNGWDSGASWGIMSKESEELDASAAAPWSGWGTKDSSPKKSLDKTSKSSSWDTVSSWGRKTAAVHESGFIGNDNQPGQGRIENEWDNKASQVKPVQSASGWNNKVTEEMVVQSTSSWDEKASWEKPVQSMSGWVSSSAAGSDESPTKGCSKNSNWDQQKAQTMNNAWDQQKSPATNSSWDRQKSSTANNSWDQQKPPANSSWDQEKSPTINNSWDQQKSPECSQGWGTLNDLNQPASSSGWDMPQGEDNTQSEKQHQWGQSKGSRRWASDANKKSRPLKPARMMNDDSSMAAMYTVTRQRLDMFTSEEKDILLDVEPLMQSIRKIMHQTGYNDGDPLSADDQTFVLDNVLAHHPDKAVKMGAGIDYVMRRKERINQLFVVHHHLMQNR

SEQ ID NO: 579 - protein, 1841 aa, Gossypium raimondii
MEENSSSVILDGEIVGIKFCLATPKEILTASVSGFPINHVSQLSNSYLGLPLEFGKCSACGTSEPGQCEGHFGYIELPIPIYHPSHISELKRLLSLLCLKCLKLKNKFQMKSGSVAERLLSSCCENTPQVSIKEVKTTDGACYLELKQPSRQSKTNWNFLERYGFRYGDHHTRTLLPCEVVEILKRIPSQTRRKLSGKGFFPQEGYILQYLPVPPNCLSVPDVSDGVSVMSSVLKQVEIIKSSRSGTPNFESHEVEANDLQSAVEQYLQVRGTVKASRSIDARYGVNKDASDSSTKAWLEKMRTLFIRKGSGFSSRSVITGDPYKKVNEIGIPSEIAQRITFEERVNMHNMRYLQNLVDNKLCLTYRDGGSTYSLREGSKGHTFLRPGQVVHRRIMDGDIVFINRPPTTHKHSLQALSVYVHDDHTVKINPLICGPLSADFDGDCIHLFYPQSLSAKAEVYELFSVEKQLLSSHSGNLNLQLATDSLLSLRVMLKTFLFKKADAQQLSMFLSSALPEPAFLKCNHVAPCWTAFQILQTAFPACLDCSSDRYLIGKSDILKVDFNKDLMQSVINEVVASIFYEKGPKEVLNFFDSLQPLLMENIFAEGFTVCLEDFSVSREVIENIQKDIQVISPLLYQLRSTYNELVELQMENHIRVAKEPIADFILKTSSLGNLIDSRSDSAVNKVVQQIGFLGMQLSDKGKFYSKTLVEDVAHQFQSIYPSDAIDYPSAEFGLIKSCFFRGLDPYEGIVHSISTREVMVRSTRGLSEPGTLFKNLMAILRDVVICYDGTVRNVSSNSIIQFQYGLSARTRPQFPAGEPVGVLAATAMSNPAYKAVLDSSPSSNSSWELMKEILLCKVSFKNDPIDRRVILYLKDCDCGRKYCQENAAYLVKNHLRRVKLKDIAVDFIIEYQQQQIVSEIEAGLVGHILLNKDLLKELSVSVQEIHMKCQETINSFRKKKKTAETFKRTDLFVSESCSIQQSCVDKWLDMPCLMFFFRNTNDDNLDSAIQILADIIYPVLLQTVIKGDPRICSAKIIWVNPDATTWIRNPSKTQKGELALEVVLEKSAVKQNGDAWRTVIDCCLPVLNIIDTHRSIPYAIKQVEQLLGISCAFEQAVQRLSTSVSMVTRGVLKEHLMLLANSMTCCGNLIGFNSGGYKTLSRSLNIQVPFTEATLFTPRKCFERAAEKCYDDSLSSIVASCSWGKRVAVGTGSRFDLLWNQESGSDQMSGMDVYNFLHMVSGAGGSNSNTACLGEEVDDLMDEWCLSPDHSTGLDKPVFEDAAEFENNLDGQSASANWEKDVSLDKVSDVGWDASGWNKNAEDVDKFAAAATSSEKQNEWSGWGASKSNSQDVGWDALSGWNKNAEDGDKFAAAATSSKKQNECSDWGASKSKSQDVVSPKVDVGWDALSAWHKNAEDGDNFAAAASSSKKQSEWSDWGMSKSKSQDVSPKTDGTCMKEQTELSGWEMKKFDTRDVLPVEERASKPNGWDSGASWGIMSKESEELDASAAAPWSGWGTKDSSPKKSLDKTSKSSSWDTVSSWGRKTAAVHESGFIGNDNQPGQGRIENEWDNKASQVKPVQSASGWNNKVTEEMVVQSTSSWDEKASWEKPVQSMSGWVSSSAAGSDESPTKGCSKNSNWDQQKAQTMNNAWDQQKSPATNSSWDRQKSSTANNSWDQQKPPANSSWDQEKSPTINNSWDQQKSPECSQGWGTLNDLNQPASSSGWDMPQGEDNTQSEKQHQWGQSKGSRRWASDANKKSRPLKPARMMNDDSSMAAMYTVTRQRLDMFTSEEKDILLDVEPLMQSIRKIMHQTGKFIFEGTTMGIHCLPMIRRLYLIMF

SEQ ID NO: 580 - protein, 1406 aa, Gossypium raimondii
MEENSSSVILDGEIVGIKFCLATPKEILTASVSGFPINHVSQLSNSYLGLPLEFGKCSACGTSEPGQCEGHFGYIELPIPIYHPSHISELKRLLSLLCLKCLKLKNKFQMKSGSVAERLLSSCCENTPQVSIKEVKTTDGACYLELKQPSRQSKTNWNFLERYGFRYGDHHTRTLLPCEVVEILKRIPSQTRRKLSGKGFFPQEGYILQYLPVPPNCLSVPDVSDGVSVMSSDLSTSMLRKVLKQVEIIKSSRSGTPNFESHEVEANDLQSAVEQYLQVRGTVKASRSIDARYGVNKDASDSSTKAWLEKMRTLFIRKGSGFSSRSVITGDPYKKVNEIGIPSEIAQRITFEERVNMHNMRYLQNLVDNKLCLTYRDGGSTYSLREGSKGHTFLRPGQVVHRRIMDGDIVFINRPPTTHKHSLQALSVYVHDDHTVKINPLICGPLSADFDGDCIHLFYPQSLSAKAEVYELFSVEKQLLSSHSGNLNLQLATDSLLSLRVMLKTFLFKKADAQQLSMFLSSALPEPAFLKCNHVAPCWTAFQILQTAFPACLDCSSDRYLIGKSDILKVDFNKDLMQSVINEVVASIFYEKGPKEVLNFFDSLQPLLMENIFAEGFTVCLEDFSVSREVIENIQKDIQVISPLLYQLRSTYNELVELQMENHIRVAKEPIADFILKTSSLGNLIDSRSDSAVNKVVQQIGFLGMQLSDKGKFYSKTLVEDVAHQFQSIYPSDAIDYPSAEFGLIKSCFFRGLDPYEGIVHSISTREVMVRSTRGLSEPGTLFKNLMAILRDVVICYDGTVRNVSSNSIIQFQYGLSARTRPQFPAGEPVGVLAATAMSNPAYKAVLDSSPSSNSSWELMKEILLCKVSFKNDPIDRRVILYLKDCDCGRKYCQENAAYLVKNHLRRVKLKDIAVDFIIEYQQQQIVSEIEAGLVGHILLNKDLLKELSVSVQEIHMKCQETINSFRKKKKTAETFKRTDLFVSESCSIQQSCVDKWLDMPCLMFFFRNTNDDNLDSAIQILADIIYPVLLQTVIKGDPRICSAKIIWVNPDATTWIRNPSKTQKGELALEVVLEKSAVKQNGDAWRTVIDCCLPVLNIIDTHRSIPYAIKQVEQLLGISCAFEQAVQRLSTSVSMVTRGVLKEHLMLLANSMTCCGNLIGFNSGGYKTLSRSLNIQVPFTEATLFTPRKCFERAAEKCYDDSLSSIVASCSWGKRVAVGTGSRFDLLWNQESGSDQMSGMDVYNFLHMVSGAGGSNSNTACLGEEVDDLMDEWCLSPDHSTGLDKPVFEDAAEFENNLDGQSASANWEKDVSLDKVSDVGWDASGWNKNAEDVDKFAAAATSSEKQNEWSGWGASKSNSQDMLSLQKWMLVGMPCLHGIKMQRMVTILQQLHPVQRSKASGLIGG

SEQ ID NO: 581 - protein, 1204 aa, Gossypium raimondii
MGASPDGKGNGGMGSTSGEKFANGTDLNMDIDEDDDVFDELVSVQELGEEFLRNFCRKAAVSFFNQYGLVSHQINSYNDFIKYGLQNTFDSFGEFVIHSGYDPSKKGEGDWRHARVKFGKVTVERPTFWAVTGGNELNMLPRHARLQNMTYSSRMKVTVELQVYTAKSVKSDKFKTGREEIVEEEIVHQDNREIIIGRIPVMVKSELCWMNEVEKSDCDFDHGGYFLIKGAEKIFIAQEQISLKRLWISNIQGWTVAYRSEVKRNRLIIRLVENSKVEYIKGGEKILTVFFLSIEIPVWILFFALGVRSDKEVVSLIDYGSSDSSISNILFASIRDADWKCRNFREESAALNHLDRLRKETRFPPEESVEECLGKYLFPSLKGFKQKARFLGYMVKSLLQAFTGHRKCDNRDDFRNKRLELAGELLEREMKVHIAHARRRMAKTLQRDLYADRTVRPIEHYLDASIVTNGLSRAFSTGAWSHPYKKMERISGVVANLGRANPLQTMVDLRKTRQQVQYTGKVGDARYPHPSHWGKVCFLSTPDGENCGLVKNLATTALVSTNIVKSVVESIVDTLFDSGMEKVVNDTSSSLDGKDKVFLNGEWVGVCEDSLFFAAELRRKRRRKELPYQVEIKRDEHKGEVRIFTDAGRILRPLLVVENLFKLKAFKGKENYAFQPLLDKGIVELIGAEEEEDCRTAWGIRYLLTEVEGKQPVKYTHCELDMSFLLGLSCGIIPFANHDHARRVLYQAQKHSQQAIGFSTTNPNIRVDTLSHQMYYPQRPLFHTMTADCLGKSGFPLGQNRLEPKPELYNGQNAIVAVNVHLGYNQEDSLVMNRASIERGMFRTEHVRSYKAEVDNKEIQEKRRKAEDIVNFGKTESKIGRVDSLDDDGFPYIGASLQSGDIVIGRFAESGADHGVKLKHTERGMVQKVVLSSNDDGKNFAVVSLRQVRSPCLGDKFSSMHGQKGVLGFLESHENFPFTTQGIVPDIVINPHAFPSRQTPGQLLEAALGKGIACGGSKKHATPFSTLSIDAITEQLHRAGFSRWGNERVYNGRTGEMVRSLIFMGPTFYQRLVHMAEDKVKFRNTGPVHPLTRQPVADRKRYGGIKFGEMERDCLIAHGASANLHERLFTLSDCSQMHVCQNCKNAANVIERTVAAGRKIRGPYCRVCQSGDEIVKVSVPYGAKLLCQELFSMGISLKFETQLC

SEQ ID NO: 582 - protein, 1038 aa, Gossypium raimondii
MGASPDGKGNGGMGSTSGEKFANGTDLNMDIDEDDDVFDELVSVQELGEEFLRNFCRKAAVSFFNQYGLVSHQINSYNDFIKYGLQNTFDSFGEFVIHSGYDPSKKGEGDWRHARVKFGKVTVERPTFWAVTGGNELNMLPRHARLQNMTYSSRMKVTVELQVYTAKSVKSDKFKTGREEIVEEEIVHQDNREIIIGRIPVMVKSELCWMNEVEKSDCDFDHGGYFLIKGAEKIFIAQEQISLKRLWISNIQGWTVAYRSEVKRNRLIIRLVENSKVEYIKGGEKILTVFFLSIEIPVWILFFALGVRSDKEVVSLIDYGSSDSSISNILFASIRDADWKCRNFREESAALNHLDRLRKETRFPPEESVEECLGKYLFPSLKGFKQKARFLGYMVKSLLQAFTGHRKCDNRDDFRNKRLELAGELLEREMKVHIAHARRRMAKTLQRDLYADRTVRPIEHYLDASIVTNGLSRAFSTGAWSHPYKKMERISGVVANLGRANPLQTMVDLRKTRQQVQYTGKVGDARYPHPSHWGKVCFLSTPDGENCGLVKNLATTALVSTNIVKSVVESIVDTLFDSGMEKVVNDTSSSLDGKDKVFLNGEWVGVCEDSLFFAAELRRKRRRKELPYQVEIKRDEHKGEVRIFTDAGRILRPLLVVENLFKLKAFKGKENYAFQPLLDKGIVELIGAEEEEDCRTAWGIRYLLTEVEGKQPVKYTHCELDMSFLLGLSCGIIPFANHDHARRVLYQAQKHSQQAIGFSTTNPNIRVDTLSHQMYYPQRPLFHTMTADCLGKSGFPLGQNRLEPKPELYNGQNAIVAVNVHLGYNQEDSLVMNRASIERGMFRTEHVRSYKAEVDNKEIQEKRRKAEDIVNFGKTESKIGRVDSLDDDGFPYIGASLQSGDIVIGRFAESGADHGVKLKHTERGMVQKVVLSSNDDGKNFAVVSLRQVRSPCLGDKFSSMHGQKGVLGFLESHENFPFTTQGIVPDIVINPHAFPSRQTPGQLLEAALGKGIACGGSKKHATPFSTLSIDAITEQLHR

SEQ ID NO: 583 - protein, 1147 aa, Gossypium raimondii
MDGTEIERPTLRLTNIPQTAVAKDLLDFFESKLGPDSVFAIEISTDRNNWKSRGFGRVQFAAPQAKSDALRLSRHDHLLFKSHSLKLSRTYDDIIPRPIRADHRLDGGVLHAGFMSSDDCLRVLERWEGVRGWIMPERRRLEFWVWTDGECYKLDFLFDDIFETVGCCFDGSACNALLLRVRYAPRIYQKVSGPNVASKFSTDRYHICKEKFDFLWVRTTDFSRIKSIGQSTSFYWEFNAGFSISDMSTYLPCYREDIQSPSLEARREFSSPSEIVPLVKFPSDSKLAYEILFQLNALVHTQKISIAAVDTDLIGILSGLPVETAVMILQKLRLLQSPCYNPVSFVKAKLPTGKNYRIPLSVSERLKNHNVMSCRRALITPTKIYCLGPELETANYVVKNFAEYASYFMRVTFVEEDWSKLSANAISTGVHLGVFSRPFKTKIYDRILYVLQNGIVIGDKRFEFLAFSASQLRSNSVWMFASNDEVKAEDIREWMGCFKKIRSISKCASRMGQLFSSSMPTLVVPVQDVEIIDDIEVKTDGINYCFSDGIGKISLPFARQVAEKCGLNHIPSAFQIRYGGYKGVVAVDRNSFWKMSLRDSMLKFESKVRMLNVTKWSESMPCFLNREIVTLFSTLGIKDEVFERMQEEQLCLLGKMLTNREAALDTLQSLGGVNSKNILVEMLQFYEPNVQPYLSMMLQAHYENLLSDLKSRCRIFVPKGRILIGCLDETGTLNYDQVYLCIKMKKAELECADQSYFRKVDEETAIVIGKVVVTKNPCLHPGDVRVLEAVYEPQLEEKGLVDCLVFPQKGERPHPNECSGGDLDGDQFFISWDKDLIPCQTEPPMDYTGRRPRIMDHEVTLEEIQKFFVDYMINDTLGAISTAHLVHADREPDKACSENCLALATLHSMAVDFAKTGAPAEMPRALKPREFPDFMQRGNKPMYTSSGVLGKLYRATINSTVQTRSKFVWTKEMAELVYDHDLEVNGFESLISVAETHKEMYEERMSLLMSYYDVEYEDEILTGNIYNKAQFLLRDNRRYGEMKERIVLSVKDLQREAKEWFKSSCSKADEHQKLASAWYYVTYHPNYFQERMNSLSFPWIVGDILLRVKSRNKFLNSREIQRNRPKFDNVYIKSPRRHTSGDESSME

SEQ ID NO: 584 - protein, 1196 aa, Gossypium raimondii
MELEGSVKETVVTQVSVGGFDRHVKARDLMKYLENAVGVVWRCRLKTSWTPPESYPNFEITDTSVIQRKDNYKKVEPHAFVHFASPEAVTWAVDAAGRTELAFNNQLLKVSLGPENPYYLNRRRRDTAPFMLPDVSLEIGALASCDEFFVGWRGPPSGVEFLVDPFDCTCKFCFSRDTAFSFKGTNERAVIKCDFKVEFLVREINEVKQYSEQTGFVVLLQLASSPWVWYRTADDDFEKSVPFDLLDDDDQWIRTTDFTASGAIGRCNTYRVLVRPRHGLKLKKAMYYLRERRVPVKDLRSQLRICDEPYFGRSMSDHFYYTYKEGIPFEIMFLVNAVLHKGIFNQHQLSMDFFKLLRNQSMEVNVAALRHIYSSRHPVYDAYKRLKDVHDWLLKNPKLFRSPPQLDDIVEIRRLVITPTKAYCLLPEVELSNRVLRKYKDVADRFLRVTFMDEGMQTMNANVLTYYNAAIVRDVTSTSFSQKTGVFKRVKSILTDGFYLCGRKYSFLAFSANQLRDRSAWFFAEDGKINVLQIIGWMGKFANRNIAKCAARMGQCFSSTYATVEVPSGQVNMHLPDIQRNGYDFSDGIGKITPDLAMEVAQKLKLDLNPPCAYQIRYAGCKGVVACWPEEGDGIRLSLRSSMIKFFSHHTTLEICSWTRFQPGFLNRQIITLLSTLGVPDKVFWGMQKSMVSKLDKVLVDTDAAFEVVISSCGEQGHTPAIMLSAGFKPQTEPHLRGMLTCVRASQLWGLREKSRIFIHSGRWLMGVLDELGVLEQGQCFIQVSNPSLQNCFLKHGSRFAETKKNFEVIKGLVVIAKNPCLHPGDVRILEAVDAPGLHHLYDCLVFPQKGERPHTNEASGSDLDGDLYFVTWEEALIPPSKKSSQPMQYNPDEPRELHRPVTHKDIIEFFSKNMVNEHLGSICNAHVVHSDLSDHGASDEKCIHLAELAAIAVDFPKTGKIVSMPAHLKPQLYPDFMGKEEFQSYKSNKILGRLYRDIKDAYDEDVSESSGLNFCASDINYDADLEITGSADYIADAWAKKCSYDGQLIGLLKQYKVKREEEVVTGQIWSMPKYASKKLGDLKEKLGHSYGSLRKEFRQLFENMDSDFEQLNEDEKNKLYERKASAWYQVTYHPEWVQKTLEFQKPDGDEGVVMLSFAWIAADYLARIKVRHQGTENLDFAKPVNSLVRYLADRI

SEQ ID NO: 585 - protein, 652 aa, Gossypium raimondii
MVIFCEELNRLNSIDPLLGITNMANELAFDLIYGVGDEKDIFELSYATFAEELQLQEILKESMMGSEKELEDAASEANQKLECLVSHGLSNTECAISHVSEIHEPQSFNKQGSARWRPQQRFGYIEQQRINWDDKGRDRFRWRKPTGWHNIRGRRVGDVPQTSSSKEFHAKTSSWGEGSPLVGTGNIEDPKGKGKAIDDGWLLVSKWKSESRGGNSVDKQQVDLGHPNHLKGSKDDDTSAVHEDDCESLDDEDDFDSDDSQKSYESRKKSKWFKEFFERMDALNAEEIDQTLWHCPACQGGPGAIKWYRSISDLIAHSKKIGSRRVKLHQELAMLLEGELCIRGTSVSPPADPIVGTWKGLKEEARDHQVVWPPMVVIMNTMTSNSKDGKFVGMGSHELLEHFSSFPALKAQHSYGPQGHRGLSVLIFESSAVGYLEAERLHQNFLDQGLDKFAWNSCTNEVLPGGERQLYGFMAVKEDLDCFNQHCQGKSKLKYELKSYQEAVLNEIKKMREDSQQLIRLKDKLEEEIKRAKTLERSVDDLSRNLQQRMKDICIFERRVKSLHEDNKEEVESQEIFYKDQIKILEARVKELDHKLKESGASPLHTGEPEPAMSGLLEEEHTPYQYNSNLGIDEDSSLENGKLPSKSNENGD

SEQ ID NO: 586 - protein, 635 aa, Gossypium raimondii
MSSRKGGSKGKEVSGVSRPKVDQLSHGVAEMNMDSSQDDGEWEVIQRKPKNTGGSSGAKPWGSQNSNPKPWNGGMRGNAGPGRGTGGNAWANHGADSRIASGRGNSRPQIVNKSLDNHQVPSNPVIRPPLEHGWNWQSRTGSNPSKGFQDGYEKDNVNAEAEKDNDVDDIEDDSDDVAADDSDNELLTDEFDSDSSQKSHETRKKNRWFKKFFDSLDKLRVEEINDPARQWHCPACQGGPGAIDWYRGLQPLGTHAKTKGSKRVKLHRELAELLDEELRRRGTSVIPAGEAFGKWRGLKDDEKDHEIVWPPMVIIMNTRLQQDDNDKWIGIGNQELLDYFSSYAAVKARHSYGPQGHRGMSLLIFESTARGYLEAERLHKHFAEQGTDREAWEHRQVLFYPGGTRQLYGYMANKEDLDIFNQHSQGKSKLKFEMRSYQEMVVNQIRQMSEANQELIFYKNKFAIQQRLKTALEESFGVVSEKLRKTMEENRIVRQRTKMQHEQNKEEMDFQEQFFKEQIKFIHEARDEEEEKFEKLQQQQREKFVKQSTPNTSNTEEYRRRADEIAKFIKLQDEEMEAFVSERDKLITVHKEKMAAMRQRHWQEEVELEKEFDTELSRLMEKYTPTMPGMDKYIY

SEQ ID NO: 587 - protein, 458 aa, Gossypium raimondii
MSSRKGGSKGKEVSGVSRPKVDQLSHGVAEMNMDSSQDDGEWEVIQRKPKNTGGSSGAKPWGSQNSNPKPWNGGMRGNAGPGRGTGGNAWANHGADSRIASGRGNSRPQIVNKSLDNHQVPSNPVIRPPLEHGWNWQSRTGSNPSKGFQDGYEKDNVNAEAEKDNDVDDIEDDSDDVAADDSDNELLTDEFDSDSSQKSHETRKKNRWFKKFFDSLDKLRVEEINDPARQWHCPACQGGPGAIDWYRGLQPLGTHAKTKGSKRVKLHRELAELLDEELRRRGTSVIPAGEAFGKWRGLKDDEKDHEIVWPPMVIIMNTRLQQDDNDKWIGIGNQELLDYFSSYAAVKARHSYGPQGHRGMSLLIFESTARGYLEAERLHKHFAEQGTDREAWEHRQVLFYPGGTRQLYGYMANKEDLDIFNQHSQGKSKLKFEMRSYQEMVVNQIRQMSEFDSIAYKT

SEQ ID NO: 588 - protein, 439 aa, Gossypium raimondii
MSSRKGGSKGKEVSGVSRPKVDQLSHGVAEMNMDSSQDDGEWEVIQRKPKNTGGSSGAKPWGSQNSNPKPWNGGMRGNAGPGRGTGGNAWANHGADSRIASGRGNSRPQIVNKSLDNHQVPSNPVIRPPLEHGWNWQSRTGSNPSKGFQDGYEKDNVNAEAEKDNDVDDIEDDSDDVAADDSDNELLTDEFDSDSSQKSHETRKKNRWFKKFFDSLDKLRVEEINDPARQWHCPACQGGPGAIDWYRGLQPLGTHAKTKGSKRVKLHRELAELLDEELRRRGTSVIPAGEAFGKWRGLKDDEKDHEIVWPPMVIIMNTRLQQDDNDKWIGIGNQELLDYFSSYAAVKARHSYGPQGHRGMSLLIFESTARGYLEAERLHKHFAEQGTDREAWEHRQVLFYPGGTRQLYGYMANKEDLDIFNQHSQGSLLLKTMVICMQG

SEQ ID NO: 589 - protein, 644 aa, Gossypium raimondii
MADATDSFPDLRSVYKSSGHQVNRLSQNVANMKLASAQDGEKENSLGSNNKGAENVGFPQDSTPNVWGHPNVIQKLRMQGNLGSEKVTHKAWPTQNAVSRTQQGDRTWGNSSIKSPSSEYGRNDPDQAGFTFSNNSWDGQIKTDHEVGDKLDDEIGDNENVDDEYGNGVSNIEYDSDDIDDYVSGSDEDEKSHEARKESKWFYFFFESLEKLTVEEILSPVRRWHCPACQGGPGAINWYRGVQPLLTHSMTKTTRRAKLHRVFAGLLVEEMRRRGAFIKPVNDAFGRWEGLTDRVADHEIVWPPMVIIMNTRYEQDENGKWIGMGNQELLNYFSSYAAVKARHSYGPQGHRGMSLLIFESSAAGYLETARLHKHFKEQGRDRDAWDCSRVPFCPGGKRQLYGYIAMKEDLDLFNQHSQGKSKLKFETRSYQEMVESQIKKINDDSQQLNLLKKKVAQEQQHSQVLAESLGRLSEKLRQTTEEYGIMRQQTRLQHEQNKEELGAKEQYFKEKINVIYQAIKLKEDNFEKLQRAARERVERSNATLINNEDQHSATELEENSRSITIQEKKMEEFEAEREKLMKSHQDGRLAITQRYWEELIELEEGFEKELTLLMGKYNPDRLEEETTDSLEGRDKRGARDIETE

SEQ ID NO: 590 - protein, 539 aa, Gossypium raimondii
MADATDSFPDLRSVYKSSGHQVNRLSQNVANMKLASAQDGEKENSLGSNNKGAENVGFPQDSTPNVWGHPNVIQKLRMQGNLGSEKVTHKAWPTQNAVSRTQQGDRTWGNSSIKSPSSEYGRNDPDQAGFTFSNNSWDGQIKTDHEVGDKLDDEIGDNENVDDEYGNGVSNIEYDSDDIDDYVSGSDEDEKSHEARKESKWFYFFFESLEKLTVEEILSPVRRWHCPACQGGPGAINWYRGVQPLLTHSMTKTTRRAKLHRVFAGLLVEEMRRRGAFIKPVNDAFGRWEGLTDRVADHEIVWPPMVIIMNTRYEQDENGKWIGMGNQELLNYFSSYAAVKARHSYGPQGHRGMSLLIFESSAAGYLETARLHKHFKEQGRDRDAWDCSRVPFCPGGKRQLYGYIAMKEDLDLFNQHSQGKSKLKFETRSYQEMVESQIKKINDDSQQLNLLKKKVAQEQQHSQVLAESLGRLSEKLRQTTEEYGIMRQQTRLQHEQNKEEVAFLKLCIPLLLLPIMVAKLGQEGCPGTTFSMFHYLVKW

SEQ ID NO: 591 - protein, 572 aa, Gossypium raimondii
MADATDPFPDLGSVYKVSGRCQVNRDVADIKLASSVDGRESKNRVAANSGLHKDSTSNVWGHPNLIQKLKMQTTSNVRPTVDGSCLSSRRHGSASTQQGAGTCPVQAGFTLPNSSENRVDEYDNNDPDVVYDNDDLDDYDFDFDEDEKSHEARKKSKWFNAFFERLEKLTVEEIISPAQQWHCPACQGGPGAIDWYRGVQPLMTHSMTKMTRRAKMHRVFAELLVEEMRRRGTFIKPANDAVGKWEGLNVRVADHEIVWPPMVIIMNTKYEQDETGKWSGMGNQELLNYFSSYAAIKARHSYGPQGHRGMSVLIFESSAAGYLEAVRLHKHFKEQGRDRDAWDHSQVPFCPGGKRQLYGYIAIKEDLDVFNRHSQGNSKLKFELRSYQEMVESQIKKINDNSQQLTRLKKKVAQEQQHSQVLAESLGRLSEKLHQTIEPKNHIVRQRAILQHEQNKEELIAKEQYFKEKINTIYQSIDCKEDNFEKLQRAASERVKQSNMNPIHDKDECSAIELHEKNIGEFNAEREKLMKSRQDRRLTITLRYWEDLVKLEEGFEKEFTLLMEKYTHRILH

SEQ ID NO: 592 - protein, 572 aa, Gossypium raimondii; identical to SEQ ID NO: 591

SEQ ID NO: 593 - protein, 645 aa, Gossypium raimondii
MSSRKGNGNPFVSGGINNPSSKGKDISGSSSSKVEQLSQGVADMNLGLPQDDGEWEVIQRKPKNRTGSSAARPWGPQNSNGKPRGAMRTNAVSGRASGNAWDAHNTDSRMATGRGNARPQTCNKAIENNNVPPHPVIRPPLQYGWNWQSRTGSNPSGGLQDDHGKNNVNTEVEEVNDIDDVEDDSDDNAIDDSDDELLTDDFDSDSSQKSHETRKNNRWFKKFFSSLDALRIEEINDPARQWHCPACQGGPGAIDWYRGLQPLMTHAKTKGAKRVKLHRELAELLDEELCRRGTSVIPSGEAFGKWKGLKDEEKDHEIVWPPMVMIMNTRLEQDENDKWIGMGNQELLDYFSSYAAVKARHSYGPQGHRGMSVLIFESTARGYLEAERLHKHFAEQGTHREAWERRRVLFYPGGKRQLYGYMAMKEDLDSFNQHSQGKSRLKFEMRSYQEMVVKQIRQMSEDNQQLIFYKNKVAKEQRQKVALEESFGIVSERLRKTMEENRIVRQRTKMQHEQNKEEMDFQEQFFKERIKFIHEARDEKEESFEKLQQQQREKVKQSNPNPSNTEEYRRRADEIAKFIKFQDEEMQAFVAERDKLIKAHEEKMVGMRERHWQEEVELEKEFDAELSHLMEKYTPDGSKVNPGNT

SEQ ID NO: 594 - protein, 645 aa, Gossypium raimondii; identical to SEQ ID NO: 593

SEQ ID NO: 595 - protein, 645 aa, Gossypium raimondii; identical to SEQ ID NO: 593

SEQ ID NO: 596 - protein, 645 aa, Gossypium raimondii; identical to SEQ ID NO: 593

SEQ ID NO: 597 - protein, 645 aa, Gossypium raimondii; identical to SEQ ID NO: 593

SEQ ID NO: 598 - protein, 645 aa, Gossypium raimondii; identical to SEQ ID NO: 593

SEQ ID NO: 599 - protein, 693 aa, Gossypium raimondii
MGSLVPFQDLNLCPEPPLPATVNISTSATPSATINRTTTFNFLTPKIEPKQEPFDEPTPTQTIHQQENFLFSVSNSTPDFIPNPETTPPANASSSADDQNALYSEYFRISELFRSAFAKRIQKYGDVEVLDPDSRAIVPVPEQSQLTPETSPTDGSNLERALSVVVSRKKAGRSNELVRVTNLGIDDQRHFRDLVRRTRMMYDSLRVLVISEEEKRTGPGNGRRARGDLRAAAVMRDRELWLNRDKRIVGAIPGIEIGDVFFFRMELCVVGLHGQIQAGIDTLPASQSSSGEPIATSIIISGGYEDDEDSGDSIIYTGQGGQDKFGKQCMHQKLEGGNLALERSMHYGIEVRVIRGFKYENRVSGKVYVYDGLYKILDCWFDVGKSGFGVYKFRLSRIEGQPEMGSSIMKFAESLRTKPLSTRPMGYLTLDISMKKERVPIFLYNDIDNDHDPMYYDYLVNTVFPLNVFGQGSNSTGCDCVSGCTEGCFCAMKNGGDFAYDYGGILLRGKPVIFECGNFCQCPPSCRNRVAQHGLRNRLEIFRSRETGWGVRSLDLIQAGAFICEYAGVVLTRDQAEVFKMNGDTLIYPNRFSERWAEWGDLSRIFPEYVCPSYPSIPPLDFAMDVSRMRNAACYISHSSSPNVLVQCVLYDHNNLMFPHLMLFAMENIPPMRELSIDYGVADEWTGKLSICN

SEQ ID NO: 600 - protein, 405 aa, Gossypium raimondii
MGFQIFGFQKVVFQYVKCFEILLLKSVAHRVSGAEFLLELRTKAKIFVQKGRSMMGCLDETRTLNYGQVFVQFSGSRSNQRDIVQGKVIVAKNPYLHPGDVRVLRAVNVPDLHHMVDCVVFHRKEPGTPHPNECSGTDLDGDTYFLCWDPELIPYKQIDAMDYSPAPTTKLDHEVTIEEIEEYFTNYINLTKLFSIAVDFPKTGVPAEIPQDLRVKEFPNFMEKPDKPSYQSHNVIGKLFREVKNLAPNECSIKFLTREKMQRFYDPDMEVEGFEDYIDDAFFYKSKYDYKLGNLMDYCRVKTEAEILSGGIMKMSRSFTKKRDAEAISMAVRSLRKEARSWFNEKRSELDEEIDDAYAKASAWYYVTYHPSYWGQYNEGMNRDHFLSFPWCVYDKLVQIKKENA

SEQ ID NO: 601 - protein, 1110 aa, Gossypium raimondii
MGKTIQVYGFLSNVSAGEVKTFLEGYTGRETVYALKIRQHKKGGRAYAIVQFTRSSAAELIIRLANQRLYYGRSYLKAREMETDIVPKPRAFLHTMERVTVNFGCQVSVEKFYVLWKAENVTLNFGTGMRKLEFLVSYCRSKYKLELFYENIWQIELRCPDSQTSKHLLIQLFGAPRIYEKEVRASELVFDDPLLNYFKDVPDDQWVRTTDFTRSNCIGQSSVLCLELPHNLRLPNFRENFAYYKENESRLVLESGSSYSCNLSLVPIVCPLRVIDLPFEILFKVNLLVQNGCIPGPALDDTFYRLVDPCRMDKVYIDHALEKLYYLRECCYEPSRWLFEEYKNFSRSRKYQGSPAISLDEGLVYVRRVQITPSRVYFCGPEINVSNRVLRQFHNDIDNFLRISFVDEELEKIHSINVQARGRRTSIYERILSTLRNGVLIGDKRFEFLAFSSSQLRENSAWMFASRKGLTAADIRSWMGNFSKIRNVAKYAARLGQSFSSSTETLSVSKDEINLIPDIEIMKDGIKYVFSDGIGKISAKFAKKVAAKCRLKGCTPSAFQIRIGGFKGVVAIDPTSSWKLSLRKSMEKYESENTKLDVLAWSKYQPCFLNRQLITLLSTLGVPDRAFEKKQREVIEQLNALLTDPLEAQEALELMSPGENTNILKEMLLCGYKPDAEPFLSMMLEAFRASKLLELRTKARIFVQKGRSMMGCLDETRTLNYGQVFVQFSGSRSEQRCIVQGKVIVAKNPCLHPGDVRVLRAVNVPDLHHMVDCVVFPQKGTRPHPNECSGSDLDGDIYFVCWDPELIPYKQMDPMDYSPAPTTILDHEVTIEEIEEYFTNYIVNDSLGIISNAHTAFADREPGKAMCHPCLELAKLFSIAVDFPKTGVPAEIPQELRVKEYPDFMEKPDKPSYQSHNVIGKLFREVKNLAPNECSIKFLTREKMQRFYDPDMEVEGFEDYIDDAFFHKSKYDYKLGNLMDYYGVKTEAEILSGGILKMSRSFTKKRDAEAISMAVRSLRKEARSWFNEERSELDEEIDDAYAKASAWYYVTYHPSYWGQYNEGMNRDHFLSFPWCVYDKLIQIKKEKAAVREALDLSSLEHRFQRRLHLH

SEQ ID NO: 602 - protein, 395 aa, Gossypium raimondii
LVSPIAYLSSTFRASKLLKLRTKARIFVQKGRSMMGCLDETRTLNYGQVFVQFSGSRSDQRDIVQGKVIVAKNPCLHPGDVRVLRAVNVPDLHHMVDCVNQIFRPHPNECSGSDLDSDTYFVCWDPELIPYKQINAMDYSPAPTTKLDHEVTIEEIEEYFTNYIVNDKNLTKLFSIAVDFPKTGVPAEIPQDLRVKEFSDFMEKPDKPSYQSHNVIGKLFREVKNLAPNECSIKFLTREKMQRFYDPDMEVEGFEDYIDDAFFYKSKYDYKLGNVMDYYRVKTEAEILSGGIMKMSRSFTKKRDAEAISIAVRSLRKEAGSWFNEKGSELDEEIDDAYAKASAWYYVTYHPSYWGHFPWCVYDKLVQIRKKMQLFREALDLSSPEHRFQHGLHLH

SEQ ID NO: 603 - protein, 1654 aa, Gossypium raimondii
MPGGELSTDGTEPFMASKVKAFSTPSPIVEISRKDEPIMEKKEKDPRKIARKYQLELCKKAMEENIIVYLETGCGKTHIAVLLIYELGHLIRKPQNRVCIFLAPTVALVQQQARVIEDSLDFKVGTYCGNCRHLKNHHDWEIEIKEYEVLVMTPQILLRSLYHCFIRMDLIALLIFDECHHAQIKSNHPYAEIMKVFYDKATASMLPRIFGMTASPVVGKDASSQVNLPKSINSLENLLDAKVYSVGDKEELESFVASPVVRVYDYGPVNFGSSCSTIIYCSKLEEIKRQCIPFVRKNGDIQSARNTKKLLNRMHDNIIFCLENLGIWGALQACRLLLTGNNSERNELIEDEGILSDDSVCDRYLVHAADVFASDCTRDGSANDLSDVEILKEPFFSKKLLRLVGILSTFRLQPNMKCIIFVNRIVTARSLSYILQNLKFLLFWKCHFLVGVHSGLKSMSRKTMKNILEKFRTGELNLLIATKVGEEGLDIQTCCLVIRFDLPETVASFIQSRGRARMPLSEYAFLVNSGNEKELDLIKNFKKDEDRMNVEISFRTSTEVSIGLEERIYMVDSSGASISSGYSISLLHHYCSKLPHDEYFFPKPSFYYFEDSGGTICNIILPSNAPINQIASTPQSSVNAAKKDACLKAIEELHKLGALTDHLLPLQNSVLEEETLLVSSDSGSSEDEDSRGELHEMLVPAVLKESWTNLENCVLLYAYYIKFNPNPKDRSYKEFALFVKSPLPKEAERMELDLHLSRRRSVMTKLTPSGVAEFKREEIMQAQHFQEMFFKVILDRSELLSEFITLGNVFLSSSSSTFYLLLPVILSNCENKVTVDWGIVQRCLSSPLFKPPVAAAKIENFPSDVCLHLVNGCRSIRDIENSLVYATHKRAFYFITSIVGEKNGYSPYRDSGTLNHVEHLNMSGIHLKYPEQPLLHAKPLFKLHNLLHNRKPEDSEANELEEYFIDLPPELCQLKIIGFSKEIGSSLSLLPSIMHRLENLLVAIELKHVFSASFAEGAEVTALRVLEALTTEKCQERFSLERLETLGDSFLKFAVARHLFLLHDALDEGELTRRRSNVVNNSNLFKLATRRNLQVYIRDQPFDPYQFFPLGHPCPVICTKETKGTVHPQSSCQVDHTKSEVKCSRNHHWLHKDTISDVVEALVGAFIVDRGFQAATAFLRWIGIRVDFQGSQLNSICAASKRFMPLSSLLDIGDLENLLGYQFLHKGLLLQAIVHPSFNRHGGGCYQRLEFLGDAVLDYLITSYLFSLYPKLKPGQLTDLRSVSVNNKSFANVAVDRRLHKFLMCDSCHLNEAIEKYVDFITSSSPDRGLFEGPKCPKALGDLVESCFGAILLDTGFNLNRVWKIMLSILDPIKSLSSVQLNPIREVQELSQCYNWDLQFLVAKVGRNFSVDAKVNAGDVPLCVSYSNINRKEAIRTTAHQLYVKLKALGYAPKSKSLEEVLKGSPKNEAKLIGYDETPIDVSVTDIVGFENMKLQESLVNDFNPKTRSIKRTTSSGVSCISPGSRPPPSFEVKAARGSASGIEAKGKPPNCSIVDPSCGIDSPSKGESHGRTARSQLYEICAINCWKPPLFECCKEEGPSHLRSFTYRVIVEIEEAPDMILECFSSPRTTKKAAAEHAAEGALWYLKHGGYLQ

SEQ ID NO: 604 - protein, 1504 aa, Gossypium raimondii
MTPQILLRSLYHCFIRMDLIALLIFDECHHAQIKSNHPYAEIMKVFYDKATASMLPRIFGMTASPVVGKDASSQVNLPKSINSLENLLDAKVYSVGDKEELESFVASPVVRVYDYGPVNFGSSCSTIIYCSKLEEIKRQCIPFVRKNGDIQSARNTKKLLNRMHDNIIFCLENLGIWGALQACRLLLTGNNSERNELIEDEGILSDDSVCDRYLVHAADVFASDCTRDGSANDLSDVEILKEPFFSKKLLRLVGILSTFRLQPNMKCIIFVNRIVTARSLSYILQNLKFLLFWKCHFLVGVHSGLKSMSRKTMKNILEKFRTGELNLLIATKVGEEGLDIQTCCLVIRFDLPETVASFIQSRGRARMPLSEYAFLVNSGNEKELDLIKNFKKDEDRMNVEISFRTSTEVSIGLEERIYMVDSSGASISSGYSISLLHHYCSKLPHDEYFFPKPSFYYFEDSGGTICNIILPSNAPINQIASTPQSSVNAAKKDACLKAIEELHKLGALTDHLLPLQNSVLEEETLLVSSDSGSSEADEDSRGELHEMLVPAVLKESWTNLENCVLLYAYYIKFNPNPKDRSYKEFALFVKSPLPKEAERMELDLHLSRRRSVMTKLTPSGVAEFKREEIMQAQHFQEMFFKVILDRSELLSEFITLGNVFLSSSSSTFYLLLPVILSNCENKVTVDWGIVQRCLSSPLFKPPVAAAKIENFPSDVCLHLVNGCRSIRDIENSLVYATHKRAFYFITSIVGEKNGYSPYRDSGTLNHVEHLNMSGIHLKYPEQPLLHAKPLFKLHNLLHNRKPEDSEANELEEYFIDLPPELCQLKIIGFSKEIGSSLSLLPSIMHRLENLLVAIELKHVFSASFAEGAEVTALRVLEALTTEKCQERFSLERLETLGDSFLKFAVARHLFLLHDALDEGELTRRRSNVVNNSNLFKLATRRNLQVYIRDQPFDPYQFFPLGHPCPVICTKETKGTVHPQSSCQVDHTKSEVKCSRNHHWLHKDTISDVVEALVGAFIVDRGFQAATAFLRWIGIRVDFQGSQLNSICAASKRFMPLSSLLDIGDLENLLGYQFLHKGLLLQAIVHPSFNRHGGGCYQRLEFLGDAVLDYLITSYLFSLYPKLKPGQLTDLRSVSVNNKSFANVAVDRRLHKFLMCDSCHLNEAIEKYVDFITSSSPDRGLFEGPKCPKALGDLVESCFGAILLDTGFNLNRVWKIMLSILDPIKSLSSVQLNPIREVQELSQCYNWDLQFLVAKVGRNFSVDAKVNAGDVPLCVSYSNINRKEAIRTTAHQLYVKLKALGYAPKSKSLEEVLKGSPKNEAKLIGYDETPIDVSVTDIVGFENMKLQESLVNDFNPKTRSIKRTTSSGVSCISPGSRPPPSFEVKAARGSASGIEAKGKPPNCSIVDPSCGIDSPSKGESHGRTARSQLYEICAINCWKPPLFECCKEEGPSHLRSFTYRVIVEIEEAPDMILECFSSPRTTKKAAAEHAAEGALWYLKHGGYLQ

SEQ ID NO: 605 - protein, 1503 aa, Gossypium raimondii
MTPQILLRSLYHCFIRMDLIALLIFDECHHAQIKSNHPYAEIMKVFYDKATASMLPRIFGMTASPVVGKDASSQVNLPKSINSLENLLDAKVYSVGDKEELESFVASPVVRVYDYGPVNFGSSCSTIIYCSKLEEIKRQCIPFVRKNGDIQSARNTKKLLNRMHDNIIFCLENLGIWGALQACRLLLTGNNSERNELIEDEGILSDDSVCDRYLVHAADVFASDCTRDGSANDLSDVEILKEPFFSKKLLRLVGILSTFRLQPNMKCIIFVNRIVTARSLSYILQNLKFLLFWKCHFLVGVHSGLKSMSRKTMKNILEKFRTGELNLLIATKVGEEGLDIQTCCLVIRFDLPETVASFIQSRGRARMPLSEYAFLVNSGNEKELDLIKNFKKDEDRMNVEISFRTSTEVSIGLEERIYMVDSSGASISSGYSISLLHHYCSKLPHDEYFFPKPSFYYFEDSGGTICNIILPSNAPINQIASTPQSSVNAAKKDACLKAIEELHKLGALTDHLLPLQNSVLEEETLLVSSDSGSSEDEDSRGELHEMLVPAVLKESWTNLENCVLLYAYYIKFNPNPKDRSYKEFALFVKSPLPKEAERMELDLHLSRRRSVMTKLTPSGVAEFKREEIMQAQHFQEMFFKVILDRSELLSEFITLGNVFLSSSSSTFYLLLPVILSNCENKVTVDWGIVQRCLSSPLFKPPVAAAKIENFPSDVCLHLVNGCRSIRDIENSLVYATHKRAFYFITSIVGEKNGYSPYRDSGTLNHVEHLNMSGIHLKYPEQPLLHAKPLFKLHNLLHNRKPEDSEANELEEYFIDLPPELCQLKIIGFSKEIGSSLSLLPSIMHRLENLLVAIELKHVFSASFAEGAEVTALRVLEALTTEKCQERFSLERLETLGDSFLKFAVARHLFLLHDALDEGELTRRRSNVVNNSNLFKLATRRNLQVYIRDQPFDPYQFFPLGHPCPVICTKETKGTVHPQSSCQVDHTKSEVKCSRNHHWLHKDTISDVVEALVGAFIVDRGFQAATAFLRWIGIRVDFQGSQLNSICAASKRFMPLSSLLDIGDLENLLGYQFLHKGLLLQAIVHPSFNRHGGGCYQRLEFLGDAVLDYLITSYLFSLYPKLKPGQLTDLRSVSVNNKSFANVAVDRRLHKFLMCDSCHLNEAIEKYVDFITSSSPDRGLFEGPKCPKALGDLVESCFGAILLDTGFNLNRVWKIMLSILDPIKSLSSVQLNPIREVQELSQCYNWDLQFLVAKVGRNFSVDAKVNAGDVPLCVSYSNINRKEAIRTTAHQLYVKLKALGYAPKSKSLEEVLKGSPKNEAKLIGYDETPIDVSVTDIVGFENMKLQESLVNDFNPKTRSIKRTTSSGVSCISPGSRPPPSFEVKAARGSASGIEAKGKPPNCSIVDPSCGIDSPSKGESHGRTARSQLYEICAINCWKPPLFECCKEEGPSHLRSFTYRVIVEIEEAPDMILECFSSPRTTKKAAAEHAAEGALWYLKHGGYLQ

SEQ ID NO: 606 - protein, 977 aa, Gossypium raimondii
MSGRGGGERGSGRGGGRRGRGQGRGRGQPSQSSSRGGGGRARGRGSSGSTATYNPPPPQMAPAQPPPQMAVATPVPPSGAPFSHPSSSSGVGSLSREVSEKLTMEPVAVTTAPPLPPSSSKAIRFPPRPGFGTVGTKCVVRANHFLVDVANADLHHYDVTITPEVTAKKVNRAIMKQLIDVYKESHLGRRCPAYDGRKSLYTAGPLPFESKELVIKLPEEDRSAGSSRPARKERQFKVAIKLASKPDLHYLREFLSRKHFECPQEAIQVLDVVLRAKPSQTYTEVGRSFFHTSLGPRGELGNGIEYWSGYYQSLRPTQMGLSLNIDVSARSFYEPILVSEFVAKHFRRSNLSKPLSDQDRIKVKKALKGVRVKLIYMDYAKTCKIIGVSRDPISQLTFTHDDKRTNVSVVKYFREKYNVVLKYPSLPALQSGSEARPVYLPMELCSIVEGQRYTKKLNEQQVRSLLRATCQRPNIREGNITKMVQVNNFEVEELVTKEFGMHVRKELALINARVLNPPVLKYHDSGRDKIVNPSCGQWNMINKKMVNGGKVDFWSCVNFSSEYRNMSEDFCAGLVNMCNSKGMVFRQTPSIAMRSARADRIDQTLMDVYKESAGLNKPLKLLIIILPDQTGSYGKIKRICETELGIVSQCCKPAQASKFSNQYFENVALKINAKVGGRNTVLNDAVLRRIPLVTDVPTIIFGADVTHPPPGEDSSSSIAAVVASMDWPEVTKYRGIVSAQTHRVEIIEDLYKQTRDPQKGLVEGGMVRELLLAFYRSTKQKPSRIIFYRDGVSEGQFSQVLLYEMDAIRKACSSLQEGYMPRVTFVVVQKRHHTRLFPTDRNKTDRSGNILPGTVVDTSICHPTEFDFYLNSHAGIQGTSKPTHYHVLLDENGFSADILQVLTNNLCYTYARCTKSVSIVPPAYYAHLAAYRARYYIEDEMSDSGSTGGGRKPKDKVVEVRPLPSIKDNVKEVMFYV

SEQ ID NO: 607 - protein, 977 aa, Gossypium raimondii; identical to SEQ ID NO: 606

SEQ ID NO: 608 - protein, 971 aa, Gossypium raimondii
MSGRGGGERGSGRGGGRRGRGQGRGRGQPSQSSSRGGGGRARGRGSSGSTATYNPPPPQMAPAQPPPQMAVATPVPPSGAPFSHPSSSSGVGSLSREVSEKLTMEPVAVTTAPPLPPSSSKAIRFPPRPGFGTVGTKCVVRANHFLVDVANADLHHYDVTITPEVTAKKVNRAIMKQLIDVYKESHLGRRCPAYDGRKSLYTAGPLPFESKELVIKLPEEDRSAGSSRPARKERQFKVAIKLASKPDLHYLREFLSRKHFECPQEAIQVLDVVLRAKPSQTYTEVGRSFFHTSLGPRGELGNGIEYWSGYYQSLRPTQMGLSLNIDVSARSFYEPILVSEFVAKHFRRSNLSKPLSDQDRIKVKKALKGVRVKLIYMDYAKTCKIIGVSRDPISQLTFTHDDKRTNVSVVKYFREKYNVVLKYPSLPALQSGSEARPVYLPMELCSIVEGQRYTKKLNEQQVRSLLRATCQRPNIREGNITKMVQVNNFEVEELVTKEFGMHVRKELALINARVLNPPVLKYHDSGRDKIVNPSCGQWNMINKKMVNGGKVDFWSCVNFSSEYRNMSEDFCAGLVNMCNSKGMVFRQTPSIAMRSARADRIDQTLMDVYKESAGLNKPLKLLIIILPDQTGSYGKIKRICETELGIVSQCCKPAQASKFSNQYFENVALKINAKVGGRNTVLNDAVLRRIPLVTDVPTIIFGADVTHPPPGEDSSSSIAAVVASMDWPEVTKYRGIVSAQTHRVEIIEDLYKQTRDPQKGLVEGGMVRELLLAFYRSTKQKPSRIIFYRDGVSEGQFSQVLLYEMDAIRKEGYMPRVTFVVVQKRHHTRLFPTDRNKTDRSGNILPGTVVDTSICHPTEFDFYLNSHAGIQGTSKPTHYHVLLDENGFSADILQVLTNNLCYTYARCTKSVSIVPPAYYAHLAAYRARYYIEDEMSDSGSTGGGRKPKDKVVEVRPLPSIKDNVKEVMFYV

SEQ ID NO: 609 - protein, 879 aa, Gossypium raimondii
MSGRGGGERGSGRGGGRRGRGQGRGRGQPSQSSSRGGGGRARGRGSSGSTATYNPPPPQMAPAQPPPQMAVATPVPPSGAPFSHPSSSSGVGSLSREVSEKLTMEPVAVTTAPPLPPSSSKAIRFPPRPGFGTVGTKCVVRANHFLVDVANADLHHYDVTITPEVTAKKVNRAIMKQLIDVYKESHLGRRCPAYDGRKSLYTAGPLPFESKELVIKLPEEDRSAGSSRPARKERQFKVAIKLASKPDLHYLREFLSRKHFECPQEAIQVLDVVLRAKPSQTYTEVGRSFFHTSLGPRGELGNGIEYWSGYYQSLRPTQMGLSLNIDVSARSFYEPILVSEFVAKHFRRSNLSKPLSDQDRIKVKKALKGVRVKLIYMDYAKTCKIIGVSRDPISQLTFTHDDKRTNVSVVKYFREKYNVVLKYPSLPALQSGSEARPVYLPMELCSIVEGQRYTKKLNEQQVRSLLRATCQRPNIREGNITKMVQVNNFEVEELVTKEFGMHVRKELALINARVLNPPVLKYHDSGRDKIVNPSCGQWNMINKKMVNGGKVDFWSCVNFSSEYRNMSEDFCAGLVNMCNSKGMVFRQTPSIAMRSARADRIDQTLMDVYKESAGLNKPLKLLIIILPDQTGSYGKIKRICETELGIVSQCCKPAQASKFSNQYFENVALKINAKVGGRNTVLNDAVLRRIPLVTDVPTIIFGADVTHPPPGEDSSSSIAAVVASMDWPEVTKYRGIVSAQTHRVEIIEDLYKQTRDPQKGLVEGGMVRELLLAFYRSTKQKPSRIIFYRDGVSEGQFSQVLLYEMDAIRKACSSLQEGYMPRVTFVVVQKRHHTRLFPTDRNKTDRSGNILPGTVVDTSICHPTEFDFYLNSHAGIQVK

SEQ ID NO: 610 - protein, 864 aa, Gossypium raimondii
MSGRGGGERGSGRGGGRRGRGQGRGRGQPSQSSSRGGGGRARGRGSSGSTATYNPPPPQMAPAQPPPQMAVATPVPPSGAPFSHPSSSSGVGSLSREVSEKLTMEPVAVTTAPPLPPSSSKAIRFPPRPGFGTVGTKCVVRANHFLVDVANADLHHYDVTITPEVTAKKVNRAIMKQLIDVYKESHLGRRCPAYDGRKSLYTAGPLPFESKELVIKLPEEDRSAGSSRPARKERQFKVAIKLASKPDLHYLREFLSRKHFECPQEAIQVLDVVLRAKPSQIYTEVGRSFFYTSLGPRGELGNGTEYWSGYYQSLRPTQMGLSLNIDVSARSFYEPILVSEFVVKHFRRSNLSKPLSDQDRIKVKKALKGVRVRLIYMDYAKTCKIIGVSRDPISQLTFPLDDKRTNVSVVKYFREKYNVVLKYPSLPALQSGSEARPVYLPMELCSIVEGQRYTKKLNEQQVRSLLRATCQRPNIREGNITKMVQVNNFEVEELVTKEFGMHVRKELALINAQVLNPPVLKYHDSGRDKIVNPSCGQWNMINKKMVNWGKVDFWSCVNFSSEYWNMSEEFCAELVNMCNNKGMVFCQTPSIAMRSACADRIDQILMDVYKESAGLNKPLQLLIIILPDQTGSYGKIKRICETELGIVSQCCKPVQAAKFSNQYFENVALKINAKVGGRNTVLNDAILRRIPLVTDVPTIIFGADVTHPPPGEDSSSSIAAVVASMDWPEVTKYRGIVSAQTHRMEIIQDLYKQTKDPQKGLVEGGMVRELLVAFFKSTRQKPSRIIFYRGGVSEGQFSQVLLYEMDAIWKACSSLQEGYMPRVTFVVVQKRHHTRLFPTDRNKTDGSGNILPGDKQGHTLPRFV

SEQ ID NO: 611 - protein, 864 aa, Gossypium raimondii
MSGRGGGERGSGRGGGRRGRGQGRGRGQPSQSSSRGGGGRARGRGSSGSTATYNPPPPQMAPAQPPPQMAVATPVPPSGAPFSHPSSSSGVGSLSREVSEKLTMEPVAVTTAPPLPPSSSKAIRFPPRPGFGTVGTKCVVRANHFLVDVANADLHHYDVTITPEVTAKKVNRAIMKQLIDVYKESHLGRRCPAYDGRKSLYTAGPLPFESKELVIKLPEEDRSAGSSRPARKERQFKVAIKLASKPDLHYLREFLSRKHFECPQEAIQVLDVVLRAKPSQTYTEVGRSFFHTSLGPRGELGNGIEYWSGYYQSLRPTQMGLSLNIDVSARSFYEPILVSEFVAKHFRRSNLSKPLSDQDRIKVKKALKGVRVKLIYMDYAKTCKIIGVSRDPISQLTFTHDDKRTNVSVVKYFREKYNVVLKYPSLPALQSGSEARPVYLPMELCSIVEGQRYTKKLNEQQVRSLLRATCQRPNIREGNITKMVQVNNFEVEELVTKEFGMHVRKELALINARVLNPPVLKYHDSGRDKIVNPSCGQWNMINKKMVNWGKVDFWSCVNFSSEYWNMSEEFCAELVNMCNNKGMVFCQTPSIAMRSACADRIDQILMDVYKESAGLNKPLQLLIIILPDQTGSYGKIKRICETELGIVSQCCKPVQAAKFSNQYFENVALKINAKVGGRNTVLNDAILRRIPLVTDVPTIIFGADVTHPPPGEDSSSSIAAVVASMDWPEVTKYRGIVSAQTHRMEIIQDLYKQTKDPQKGLVEGGMVRELLVAFFKSTRQKPSRIIFYRGGVSEGQFSQVLLYEMDAIWKACSSLQEGYMPRVTFVVVQKRHHTRLFPTDRNKTDGSGNILPGDKQGHTLPRFV

SEQ ID NO: 612 - protein, 864 aa, Gossypium raimondii
MSGRGGGERGSGRGGGRRGRGQGRGRGQPSQSSSRGGGGRARGRGSSGSTATYNPPPPQMAPAQPPPQMAVATPVPPSGAPFSHPSSSSGVGSLSREVSEKLTMEPVAVTTAPPLPPSSSKAIRFPPRPGFGTVGTKCVVRANHFLVDVANADLHHYDVTITPEVTAKKVNRAIMKQLIDVYKESHLGRRCPAYDGRKSLYTAGPLPFESKELVIKLPEEDRSAGSSRPARKERQFKVAIKLASKPDLHYLREFLSRKHFECPQEAIQVLDVVLRAKPSQTYTEVGRSFFHTSLGPRGELGNGIEYWSGYYQSLRPTQMGLSLNIDVSARSFYEPILVSEFVAKHFRRSNLSKPLSDQDRIKVKKALKGVRVKLIYMDYAKTCKIIGVSRDPISQLTFTHDDKRTNVSVVKYFREKYNVVLKYPSLPALQSGSEARPVYLPMELCSIVEGQRYTKKLNEQQVRSLLRATCQRPNIREGNITKMVQVNNFEVEELVTKEFGMHVRKELALINARVLNPPVLKYHDSGRDKIVNPSCGQWNMINKKMVNGGKVDFWSCVNFSSEYRNMSEDFCAGLVNMCNSKGMVFRQTPSIAMRSARADRIDQTLMDVYKESAGLNKPLKLLIIILPDQTGSYGKIKRICETELGIVSQCCKPVQAAKFSNQYFENVALKINAKVGGRNTVLNDAILRRIPLVTDVPTIIFGADVTHPPPGEDSSSSIAAVVASMDWPEVTKYRGIVSAQTHRMEIIQDLYKQTKDPQKGLVEGGMVRELLVAFFKSTRQKPSRIIFYRGGVSEGQFSQVLLYEMDAIWKACSSLQEGYMPRVTFVVVQKRHHTRLFPTDRNKTDGSGNILPGDKQGHTLPRFV

SEQ ID NO: 613 - protein, 864 aa, Gossypium raimondii
MSGRGGGERGSGRGGGRRGRGQGRGRGQPSQSSSRGGGGRARGRGSSGSTATYNPPPPQMAPAQPPPQMAVATPVPPSGAPFSHPSSSSGVGSLSREVSEKLTMEPVAVTTAPPLPPSSSKAIRFPPRPGFGTVGTKCVVRANHFLVDVANADLHHYDVTITPEVTAKKVNRAIMKQLIDVYKESHLGRRCPAYDGRKSLYTAGPLPFESKELVIKLPEEDRSAGSSRPARKERQFKVAIKLASKPDLHYLREFLSRKHFECPQEAIQVLDVVLRAKPSQTYTEVGRSFFHTSLGPRGELGNGIEYWSGYYQSLRPTQMGLSLNIDVSARSFYEPILVSEFVAKHFRRSNLSKPLSDQDRIKVKKALKGVRVKLIYMDYAKTCKIIGVSRDPISQLTFTHDDKRTNVSVVKYFREKYNVVLKYPSLPALQSGSEARPVYLPMELCSIVEGQRYTKKLNEQQVRSLLRATCQRPNIREGNITKMVQVNNFEVEELVTKEFGMHVRKELALINAQVLNPPVLKYHDSGRDKIVNPSCGQWNMINKKMVNWGKVDFWSCVNFSSEYWNMSEEFCAELVNMCNNKGMVFCQTPSIAMRSACADRIDQILMDVYKESAGLNKPLQLLIIILPDQTGSYGKIKRICETELGIVSQCCKPVQAAKFSNQYFENVALKINAKVGGRNTVLNDAILRRIPLVTDVPTIIFGADVTHPPPGEDSSSSIAAVVASMDWPEVTKYRGIVSAQTHRMEIIQDLYKQTKDPQKGLVEGGMVRELLVAFFKSTRQKPSRIIFYRGGVSEGQFSQVLLYEMDAIWKACSSLQEGYMPRVTFVVVQKRHHTRLFPTDRNKTDGSGNILPGDKQGHTLPRFV

SEQ ID NO: 614 - protein, 845 aa, Gossypium raimondii
MSGRGGGERGSGRGGGRRGRGQGRGRGQPSQSSSRGGGGRARGRGSSGSTATYNPPPPQMAPAQPPPQMAVATPVPPSGAPFSHPSSSSGVGSLSREVSEKLTMEPVAVTTAPPLPPSSSKAIRFPPRPGFGTVGTKCVVRANHFLVDVANADLHHYDVTITPEVTAKKVNRAIMKQLIDVYKESHLGRRCPAYDGRKSLYTAGPLPFESKELVIKLPEEDRSAGSSRPARKERQFKVAIKLASKPDLHYLREFLSRKHFECPQEAIQVLDVVLRAKPSQIYTEVGRSFFYTSLGPRGELGNGTEYWSGYYQSLRPTQMGLSLNIDVSARSFYEPILVSEFVVKHFRRSNLSKPLSDQDRIKVKKALKGVRVRLIYMDYAKTCKIIGVSRDPISQLTFPLDDKRTNVSVVKYFREKYNVVLKYPSLPALQSGSEARPVYLPMEMVQVNNFEVEELVTKEFGMHVRKELALINAQVLNPPVLKYHDSGRDKIVNPSCGQWNMINKVFCQTPSIAMRSACADRIDQILMDVYKESAGLNKPLQLLIIILPDQTGSYGKIKRICETELGIVSQCCKPVQAAKFSNQYFENVALKINAKVGGRNTVLNDAILRRIPLVTDVPTIIFGADVTHPPPGEDSSSSIAAVVASMDWPEVTKYRGIVSAQTHRMEIIQDLYKQTKDPQKGLVEGGMVRGGVSEGQFSQVLLYEMDAIWKACSSLQEGYMPRVTFVVVQKRHHTRLFPTDRNKTDGSGNILPGTVVDTSICHPTEFDFYLNSHAGILGTSKATRYHVLFDENGFSADILQVLTNSLCYTYARCTKSVSIGHAIILRMRCRIVGLLVEAESRKTRL

SEQ ID NO: 615 - protein, 690 aa, Gossypium raimondii
MKQLIDVYKESHLGRRCPAYDGRKSLYTAGPLPFESKELVIKLPEEDRSAGSSRPARKERQFKVAIKLASKPDLHYLREFLSRKHFECPQEAIQVLDVVLRAKPSQIYTEVGRSFFYTSLGPRGELGNGTEYWSGYYQSLRPTQMGLSLNIDVSARSFYEPILVSEFVVKHFRRSNLSKPLSDQDRIKVKKALKGVRVRLIYMDYAKTCKIIGVSRDPISQLTFPLDDKRTNVSVVKYFREKYNVVLKYPSLPALQSGSEARPVYLPMELCSIVEGQRYTKKLNEQQVRSLLRATCQRPNIREGNITKMVQVNNFEVEELVTKEFGMHVRKELALINAQVLNPPVLKYHDSGRDKIVNPSCGQWNMINKKMVNWGKVDFWSCVNFSSEYWNMSEEFCAELVNMCNNKGMVFCQTPSIAMRSACADRIDQILMDVYKESAGLNKPLQLLIIILPDQTGSYGKIKRICETELGIVSQCCKPVQAAKFSNQYFENVALKINAKVGGRNTVLNDAILRRIPLVTDVPTIIFGADVTHPPPGEDSSSSIAAVVASMDWPEVTKYRGIVSAQTHRMEIIQDLYKQTKDPQKGLVEGGMVRELLVAFFKSTRQKPSRIIFYRGGVSEGQFSQVLLYEMDAIWKACSSLQEGYMPRVTFVVVQKRHHTRLFPTDRNKTDGSGNILPGDKQGHTLPRFV

SEQ ID NO: 616 - DNA, 3965 bp, Zea mays
ggagaggaagcaggacctgggagacctcgcctcgtccgtcctcctgcctacttccttgcttttggtaggtgctgcttgttttatcttgaaatgggctctcatgatggcgaggatgaagagttgccacccccccctccggtgccaccagatgtgattcccattaaagctgaagatgctgtgggtgaatcaccagcaaaccatatattaaagccaaagagattactgatggacaggcctggtataggaagaaaagggcagccgacccagctctattcaaatcactttaaagtcgctgtgaagagtacagaagacgtcttctttcactactatgtaaacctgaagtatgaggatgatcgacccgttgatggtaaagggatcggcagaaaggtgattgataaactgcagcagacatatcgtgcagagctttctaacaaggactttgcatatgatggagaaaagagcctgtttacagttggtggtcttccacaaaaaaagaatgagttcaccgttgtcttggaggacgtatctactggaaagactgctgccaatgggagccctggaggtaatgacagtcctggaggtggtgataggaagagagtgaggaggccataccagacgaaaactttcaaagtggagataaattttgcagcagaggttcctatgagtgctattggtcaagtcattagaggcgaagaatctgagaactccctggaggcgcttcgtgttcttgatatcatactgaggcagcattccgcagaacaaggctgccttttggttaagcaatcatttttctacaacaacccttcatgctttgttgacttgggtggtggtgtgatgggttgtcgtggatttcattcaagcttccgtggcacacagagtggactttccctcaatgttgatgtctcaacaacaatgatcgtgaaacctggccctgttattgattttcttctttctaaccagaatgttaatgatcctagcagaattgattggcaaaaggccaagcgtgctctcaagggcttgaggattagaaccactcctgcaaattcagaattcaagatttttggtctcagcgagaggatctgcaaagaacaaacgtttccgctgaggcagagaaatggtagcaacggagattgtgataccattgaaataactgtctatgactactatgcaaagaaaggaatcgatctaaagtattctggtgatttcccctgtataaatacagggaaggcaaagcgcccaacatattttccaatcgagctatgctcgcttgttccgcttcaaagatacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgtttcagttgctccaaaatttacccaagttgaaggaaggatccttcaagccccaaagctgaaagccggcaatggtgatgatatcttttcacgaaatggacggtggaatttcactaataggaagttttatgaaacctgctctgtgaataagtgggcggtcgttaatttctctgcacgttgtgatgttcggaatcttatccgtgacctgatgaggaatgcatctgcaaagggaattcaaatggaggaaccttttgatgtgtttgaagagagtccctctatgaggcgtgcacctgtgtcaagaagggtggatgatatgtttgggcagataaaatcaaaacttcctggagctcctaggttcctcttgtgccttctccctgagaggaaaaattgtgaaatctatggtccttggaagagaaagtgcctggccgagtttggtattgtcacacagtgtctagctccattaagagtcaatgatccgtacctgcttaatttgctgatgaagatcaatgcaaagcttggtggtctgaactcgttgctgcaagttgaagcatcttcgtcaataccacatgtgtcgcaagtacccaccatcatcttaggtatggatgtttcacatggtcatccaggacaagatagaccttcggttgcagcggtggttagttctcgtcaatggcctcttatctctagatatagagcatcagtgcacacccaatctgccagactagaaatgatgtcctcgttgtttaagccgcggggtactgatgatgatggcctcatccgggaatcactgatcgacttctacactagctctggaaagcgaaaaccagaacacataattattttcagggatggagtcagtgaaagtcagtttacccaggtcatcaacattgagctggatcagatcatcgaggcatgtaagtttctggatgagaagtggtcacccaagttcactgtgattgttgctcaaaagaaccaccacaccaagttctttcagacggcatcaccagacaatgttcttcctggaactgtggtggatagtaaagtttgccatcctaagaacttcgacttctacatgtgtgcacatgctgggatgattggaacaacaaggccgacccactatcatgttctgcacgacgagataggtttcagtgccgacgagatgcaggagtttgttcattcgctctcttacgtgtaccagaggagcacgacagccatctcagtggttgctccagtgtgctacgcccacctcgctgcagcccaggtgagcacgttcctgagattggaggagatgtcagacgcgtcctccagccagggaggagggcatacctcggctggcagtgctcctgtgccggagctgcctcgcctgcatgacaaagtcaggagctccatgttcttctgctagctgatgtgcgtgcgcatcaggatcgagctccatgttttgtgttagtaaggcctagttagtaaggctgtagaaagaatgtttaatgtttgcatgctaaagtccaaacaatcaaaaccactactatatctaccagagcactgatcgatcaaacaacaagagtcagcatcaatcaatcaaaaccaccactattctatctaccgatcaatctactctatacctgaagcactcactcgctcgcaaacaaccaagggatcatggatccttgagtagctccattgtccagtccctgaccttgacgaagcatttcatggacagcctctcgtacgccatctcgtacatccggaggttcatgtaggcgaagctcaagtaggtggcgatgcactcttggtgcctgtggtacagcgccgggatggtcagagcggccaccacacttgcgtagcaggcggtcgggaaatctgtaacgctgccgacgatggacacgctccacaggcagaggaaggctctgtagaagagcagcgagtccctgcccagagcgatgtcccggaaagcgtccgaggcggcgtccagagcagagcgcagcagcgccgccgcctcgtccacggcctgctgcggaacgcgcagctccgggacgggaggctgcggcctgttcaggaggcgcgccgctttggcccacaggaagagcacggtgaggagcaggagcagcacgttggaggcgagggacaccaaggtgtagccgccgtacaagagcagccaggaggagacggtgcccgccagcaggcaggcgctcacgtcggcgcggccccggcgccacagcagcacgtcccagactgctgcagcaatccgatccgattccgatccagatatattagttagtagatccaatctcgggcggccaatccgtaataataattggctgagagaaaaggtgggagagagtaccgaatcctccgacggcacatgtcccggcgccgccgccgccgccgccaacaccaacaccagcatccaccaccatcgtcgtagttaatactaagggaagggaactagagaaggaagggaggggccgatgcaacggaagaaatggatggaattcgaccaacagctagctagagcgaagcagaacccaatcccaatcaaaacccgag

SEQ ID NO: 617 - DNA, 4052 bp, Zea mays
ggagaggaagcaggacctgggagacctcgcctcgtccgtcctcctgcctacttccttgcttttggtaggtgctgcttgttttatcttgaaatgggctctcatgatggcgaggatgaagagttgccacccccccctccggtgccaccagatgtgattcccattaaagctgaagatgctgtgggtgaatcaccagcaaaccatatattaaagccaaagagattactgatggacaggcctggtataggaagaaaagggcagccgacccagctctattcaaatcactttaaagtcgctgtgaagagtacagaagacgtcttctttcactactatgtaaacctgaagtatgaggatgatcgacccgttgatggtaaagggatcggcagaaaggtgattgataaactgcagcagacatatcgtgcagagctttctaacaaggactttgcatatgatggagaaaagagcctgtttacagttggtggtcttccacaaaaaaagaatgagttcaccgttgtcttggaggacgtatctactggaaagactgctgccaatgggagccctggaggtaatgacagtcctggaggtggtgataggaagagagtgaggaggccataccagacgaaaactttcaaagtggagataaattttgcagcagaggttcctatgagtgctattggtcaagtcattagaggcgaagaatctgagaactccctggaggcgcttcgtgttcttgatatcatactgaggcagcattccgcagaacaaggctgccttttggttaagcaatcatttttctacaacaacccttcatgctttgttgacttgggtggtggtgtgatgggttgtcgtggatttcattcaagcttccgtggcacacagagtggactttccctcaatgttgatgtctcaacaacaatgatcgtgaaacctggccctgttattgattttcttctttctaaccagaatgttaatgatcctagcagaattgattggcaaaaggccaagcgtgctctcaagggcttgaggattagaaccactcctgcaaattcagaattcaagatttttggtctcagcgagaggatctgcaaagaacaaacgtttccgctgaggcagagaaatggtagcaacggagattgtgataccattgaaataactgtctatgactactatgcaaagaaaggaatcgatctaaagtattctggtgatttcccctgtataaatacagggaaggcaaagcgcccaacatattttccaatcgagctatgctcgcttgttccgcttcaaagatacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgtttcagttgctccaaaatttacccaagttgaaggaaggatccttcaagccccaaagctgaaagccggcaatggtgatgatatcttttcacgaaatggacggtggaatttcactaataggaagttttatgaaacctgctctgtgaataagtgggcggtcgttaatttctctgcacgttgtgatgttcggaatcttatccgtgacctgatgaggaatgcatctgcaaagggaattcaaatggaggaaccttttgatgtgtttgaagagagtccctctatgaggcgtgcacctgtgtcaagaagggtggatgatatgtttgggcagataaaatcaaaacttcctggagctcctaggttcctcttgtgccttctccctgagaggaaaaattgtgaaatctatggtccttggaagagaaagtgcctggccgagtttggtattgtcacacagtgtctagctccattaagagtcaatgatccgtacctgcttaatttgctgatgaagatcaatgcaaaggtttgggacatgattttgtctttcttttgcactgtattgttccctggttcatgattatattatcctctttcctctgtttttaactagcttggtggtctgaactcgttgctgcaagttgaagcatcttcgtcaataccacatgtgtcgcaagtacccaccatcatcttaggtatggatgtttcacatggtcatccaggacaagatagaccttcggttgcagcggtggttagttctcgtcaatggcctcttatctctagatatagagcatcagtgcacacccaatctgccagactagaaatgatgtcctcgttgtttaagccgcggggtactgatgatgatggcctcatccgggaatcactgatcgacttctacactagctctggaaagcgaaaaccagaacacataattattttcagggatggagtcagtgaaagtcagtttacccaggtcatcaacattgagctggatcagatcatcgaggcatgtaagtttctggatgagaagtggtcacccaagttcactgtgattgttgctcaaaagaaccaccacaccaagttctttcagacggcatcaccagacaatgttcttcctggaactgtggtggatagtaaagtttgccatcctaagaacttcgacttctacatgtgtgcacatgctgggatgattggaacaacaaggccgacccactatcatgttctgcacgacgagataggtttcagtgccgacgagatgcaggagtttgttcattcgctctcttacgtgtaccagaggagcacgacagccatctcagtggttgctccagtgtgctacgcccacctcgctgcagcccaggtgagcacgttcctgagattggaggagatgtcagacgcgtcctccagccagggaggagggcatacctcggctggcagtgctcctgtgccggagctgcctcgcctgcatgacaaagtcaggagctccatgttcttctgctagctgatgtgcgtgcgcatcaggatcgagctccatgttttgtgttagtaaggcctagttagtaaggctgtagaaagaatgtttaatgtttgcatgctaaagtccaaacaatcaaaaccactactatatctaccagagcactgatcgatcaaacaacaagagtcagcatcaatcaatcaaaaccaccactattctatctaccgatcaatctactctatacctgaagcactcactcgctcgcaaacaaccaagggatcatggatccttgagtagctccattgtccagtccctgaccttgacgaagcatttcatggacagcctctcgtacgccatctcgtacatccggaggttcatgtaggcgaagctcaagtaggtggcgatgcactcttggtgcctgtggtacagcgccgggatggtcagagcggccaccacacttgcgtagcaggcggtcgggaaatctgtaacgctgccgacgatggacacgctccacaggcagaggaaggctctgtagaagagcagcgagtccctgcccagagcgatgtcccggaaagcgtccgaggcggcgtccagagcagagcgcagcagcgccgccgcctcgtccacggcctgctgcggaacgcgcagctccgggacgggaggctgcggcctgttcaggaggcgcgccgctttggcccacaggaagagcacggtgaggagcaggagcagcacgttggaggcgagggacaccaaggtgtagccgccgtacaagagcagccaggaggagacggtgcccgccagcaggcaggcgctcacgtcggcgcggccccggcgccacagcagcacgtcccagactgctgcagcaatccgatccgattccgatccagatatattagttagtagatccaatctcgggcggccaatccgtaataataattggctgagagaaaaggtgggagagagtaccgaatcctccgacggcacatgtcccggcgccgccgccgccgccgccaacaccaacaccagcatccaccaccatcgtcgtagttaatactaagggaagggaactagagaaggaagggaggggccgatgcaacggaagaaatggatggaattcgaccaacagctagctagagcgaagcagaacccaatcccaatcaaaacccgag

SEQ ID NO: 618 - DNA, 4033 bp, Zea mays
ggagaggaagcaggacctgggagacctcgcctcgtccgtcctcctgcctacttccttgcttttggtaggtgctgcttgttttatcttgaaatgggctctcatgatggcgaggatgaagagttgccacccccccctccggtgccaccagatgtgattcccattaaagctgaagatgctgtgggtgaatcaccagcaaaccatatattaaagccaaagagattactgatggacaggcctggtataggaagaaaagggcagccgacccagctctattcaaatcactttaaagtcgctgtgaagagtacagaagacgtcttctttcactactatgtaaacctgaagtatgaggatgatcgacccgttgatggtaaagggatcggcagaaaggtgattgataaactgcagcagacatatcgtgcagagctttctaacaaggactttgcatatgatggagaaaagagcctgtttacagttggtggtcttccacaaaaaaagaatgagttcaccgttgtcttggaggacgtatctactggaaagactgctgccaatgggagccctggaggtaatgacagtcctggaggtggtgataggaagagagtgaggaggccataccagacgaaaactttcaaagtggagataaattttgcagcagaggttcctatgagtgctattggtcaagtcattagaggcgaagaatctgagaactccctggaggcgcttcgtgttcttgatatcatactgaggcagcattccgcagaacaaggctgccttttggttaagcaatcatttttctacaacaacccttcatgctttgttgacttgggtggtggtgtgatgggttgtcgtggatttcattcaagcttccgtggcacacagagtggactttccctcaatgttgatgtctcaacaacaatgatcgtgaaacctggccctgttattgattttcttctttctaaccagaatgttaatgatcctagcagaattgattggcaaaaggccaagcgtgctctcaagggcttgaggattagaaccactcctgcaaattcagaattcaagatttttggtctcagcgagaggatctgcaaagaacaaacgtttccgctgaggcagagaaatggtagcaacggagattgtgataccattgaaataactgtctatgactactatgcaaagaaaggaatcgatctaaagtattctggtgatttcccctgtataaatacagggaaggcaaagcgcccaacatattttccaatcgagctatgctcgcttgttccgcttcaaagatacaccaaagctttgtctacgctacaaaggtcatcccttgtggagaagtctagacagaagcctgaagaaaggatgaccgttctaaatgatgcactgcaacgcagtaactacgattctgaccccatgttgagggcatgtggtgtttcagttgctccaaaatttacccaagttgaaggaaggatccttcaagccccaaagctgaaagccggcaatggtgatgatatcttttcacgaaatggacggtggaatttcactaataggaagttttatgaaacctgctctgtgaataagtgggcggtcgttaatttctctgcacgttgtgatgttcggaatcttatccgtgacctgatgaggaatgcatctgcaaagggaattgtatggtttagcttttcacatatcttctattgtagcagttttctgctgctgacgttttcttctggcagcaaatggaggaaccttttgatgtgtttgaagagagtccctctatgaggcgtgcacctgtgtcaagaagggtggatgatatgtttgggcagataaaatcaaaacttcctggagctcctaggttcctcttgtgccttctccctgagaggaaaaattgtgaaatctatggtccttggaagagaaagtgcctggccgagtttggtattgtcacacagtgtctagctccattaagagtcaatgatccgtacctgcttaatttgctgatgaagatcaatgcaaagcttggtggtctgaactcgttgctgcaagttgaagcatcttcgtcaataccacatgtgtcgcaagtacccaccatcatcttaggtatggatgtttcacatggtcatccaggacaagatagaccttcggttgcagcggtggttagttctcgtcaatggcctcttatctctagatatagagcatcagtgcacacccaatctgccagactagaaatgatgtcctcgttgtttaagccgcggggtactgatgatgatggcctcatccgggaatcactgatcgacttctacactagctctggaaagcgaaaaccagaacacataattattttcagggatggagtcagtgaaagtcagtttacccaggtcatcaacattgagctggatcagatcatcgaggcatgtaagtttctggatgagaagtggtcacccaagttcactgtgattgttgctcaaaagaaccaccacaccaagttctttcagacggcatcaccagacaatgttcttcctggaactgtggtggatagtaaagtttgccatcctaagaacttcgacttctacatgtgtgcacatgctgggatgattggaacaacaaggccgacccactatcatgttctgcacgacgagataggtttcagtgccgacgagatgcaggagtttgttcattcgctctcttacgtgtaccagaggagcacgacagccatctcagtggttgctccagtgtgctacgcccacctcgctgcagcccaggtgagcacgttcctgagattggaggagatgtcagacgcgtcctccagccagggaggagggcatacctcggctggcagtgctcctgtgccggagctgcctcgcctgcatgacaaagtcaggagctccatgttcttctgctagctgatgtgcgtgcgcatcaggatcgagctccatgttttgtgttagtaaggcctagttagtaaggctgtagaaagaatgtttaatgtttgcatgctaaagtccaaacaatcaaaaccactactatatctaccagagcactgatcgatcaaacaacaagagtcagcatcaatcaatcaaaaccaccactattctatctaccgatcaatctactctatacctgaagcactcactcgctcgcaaacaaccaagggatcatggatccttgagtagctccattgtccagtccctgaccttgacgaagcatttcatggacagcctctcgtacgccatctcgtacatccggaggttcatgtaggcgaagctcaagtaggtggcgatgcactcttggtgcctgtggtacagcgccgggatggtcagagcggccaccacacttgcgtagcaggcggtcgggaaatctgtaacgctgccgacgatggacacgctccacaggcagaggaaggctctgtagaagagcagcgagtccctgcccagagcgatgtcccggaaagcgtccgaggcggcgtccagagcagagcgcagcagcgccgccgcctcgtccacggcctgctgcggaacgcgcagctccgggacgggaggctgcggcctgttcaggaggcgcgccgctttggcccacaggaagagcacggtgaggagcaggagcagcacgttggaggcgagggacaccaaggtgtagccgccgtacaagagcagccaggaggagacggtgcccgccagcaggcaggcgctcacgtcggcgcggccccggcgccacagcagcacgtcccagactgctgcagcaatccgatccgattccgatccagatatattagttagtagatccaatctcgggcggccaatccgtaataataattggctgagagaaaaggtgggagagagtaccgaatcctccgacggcacatgtcccggcgccgccgccgccgccgccaacaccaacaccagcatccaccaccatcgtcgtagttaatactaagggaagggaactagagaaggaagggaggggccgatgcaacggaagaaatggatggaattcgaccaacagctagctagagcgaagcagaacccaatcccaatcaaaacccgag

SEQ ID NO: 619 - DNA, 1658 bp, Zea mays
aagaagcaactatgatgcagagcccatgttgaaggcatgcgggattacaattgctagaaatttcacagaagttgatggtagggtattgcagccacctaagcttacagctgggaatggtgaagacatttttacacgcaatggtagatggaacttcaacaataagaggctcattagagcttgtagtgtcgagaaatgggcggtggtaaacttttctgcacgatgcaatgtcagggatcttgtccgggatctcatcaagtgtggaggcatgaagggcattatggttgatgctccttttgctgtatttgatgagaatccttcaatgagacggtcacctgctataagaagggttgaagacatgtttgaacaagtgaaaactaagcttcctggagcaccaaagtttcttttgtgtgttctagctgaaaggaagaattctgatatttatgggccttggaagaagaaatgccttgctgaatttgggatcgttacacaatgtgtggcaccaactagagtgaacgaccagtatcttacaaatgtcctacttaagataaatgcaaagctgggtggcatgaattcgttgctccaaattgaaacatccccagcaattcctcttgtatccaaggtcccaactataatcttgggaatggatgtgtcacacggttctcctggacattctgatgtaccatctattgctgctgttgttagttctcgtgaatggcctcttatctcgaaatacagagcttctgtccgcacccaatcacctaaaatggaaatgattgactcattgtttaagccacgggaagctgaagatgatggtctgatccgggagtgtctgattgacttctacaccagttctgggaagagaaagcctgaccaagttatcatattcagggacggtgttagcgaaagtcagtttaatcaggtgctgaacattgagttgcaacaaatcatcgaggcttgcaaatttcttgatgagaaatggaatcccaagttcacgttgattattgcccagaagaatcatcacactaaatttttcattcctggaaagccagataatgtcccaccaggaactgtggtggacaacaaagtctgccatccaaagaacttcgatttctacatgtgtgcgcatgctggaatgatcgggactacgaggccaactcactaccacatcctgcatgatgagataggcttcagtcctgatgatctgcaggagctggtgcattcgctctcttatgtgtaccaaaggagcacaacagccatatcagtcgttgctcccatctgctacgcacatctggcagctgctcaggttggccagttcataaagttcgatgagatgtcggagacgtcctccagtcatggcgggcatacttcggcgggcagcgttccggtccaggagctgccgcgcctgcatgagaaagaaggctcgagctggtacgatgttaaatgttagttttttaagcgtcgctgcggctatgttggtgcctcaggaagacttggaacctggttaggatgtcgttaaatctaccccttatcgttcctggttcgttgggctgttgttcttattgtccgtcctggtgtctgatttctgctttgttgcatgcaagtgtgaggcccagcttgatattgaaaagtttggcgtacatgtcgttcatttggcactc

SEQ ID NO: 620 - DNA, 1777 bp, Zea mays
aagaagcaactatgatgcagagcccatgttgaaggcatgcgggattacaattgctagaaatttcacagaagttgatggtagggtattgcagccacctaagcttacagctgggaatggtgaagacatttttacacgcaatggtagatggaacttcaacaataagaggctcattagagcttgtagtgtcgagaaatgggcggtggtaaacttttctgcacgatgcaatgtcagggatcttgtccgggatctcatcaagtgtggaggcatgaagggcattatggttgatgctccttttgctgtatttgatgagaatccttcaatgagacggtcacctgctataagaagggttgaagacatgtttgaacaagtgaaaactaagcttcctggagcaccaaagtttcttttgtgtgttctagctgaaaggaagaattctgatatttatgggccttggaagaagaaatgccttgctgaatttgggatcgttacacaatgtgtggcaccaactagagtgaacgaccagtatcttacaaatgtcctacttaagataaatgcaaagctgggtggcatgaattcgttgctccaaattgaaacatccccagcaattcctcttgtatccaaggtcccaactataatcttgggaatggatgtgtcacacggttctcctggacattctgatgtaccatctattgctgctgttgttagttctcgtgaatggcctcttatctcgaaatacagagcttctgtccgcacccaatcacctaaaatggaaatgattgactcattgtttaagccacgggaagctgaagatgatggtctgatccgggagtgtctgattgacttctacaccagttctgggaagagaaagcctgaccaagttatcatattcagggacggtgttagcgaaagtcagtttaatcaggtgctgaacattgagttgcaacaaatcatcgaggcttgcaaatttcttgatgagaaatggaatcccaagttcacgttgattattgcccagaagaatcatcacactaaatttttcattcctggaaagccagataatgtcccaccaggaactgtggtggacaacaaagtctgccatccaaagaacttcgatttctacatgtgtgcgcatgctggaatgatcgggactacgaggccaactcactaccacatcctgcatgatgagataggcttcagtcctgatgatctgcaggagctggtgcattcgctctcttatgtgtaccaaaggagcacaacagccatatcagtcgttgctcccatctgctacgcacatctggcagctgctcaggttggccagttcataaagttcgatgagatgtcggagacgtcctccagtcatggcgggcatacttcggcgggcagcgttccggtccaggagctgccgcgcctgcatgagaaagtgaggagctcgatgttcttttgctgagccgtggttttacttttttggtggatggtgaacccctctagttatgtcggtagacgctcttggatgacgctctagttgtggtccaggaaggctcgagctggtacgatgttaaatgttagttttttaagcgtcgctgcggctatgttggtgcctcaggaagacttggaacctggttaggatgtcgttaaatctaccccttatcgttcctggttcgttgggctgttgttcttattgtccgtcctggtgtctgatttctgctttgttgcatgcaagtgtgaggcccagcttgatattgaaaagtttggcgtacatgtcgttcatttggcactctggact

SEQ ID NO: 621 - DNA, 3118 bp, Zea mays
cggaaagaagcccggccgggtcggaaggggagcagttctcgccttctcggggaggtcgccagcgggttgggcagaggctttgcagcttttgggtcagacgcagtgttctccaaggctcactaaatggagtctcacaatggcgaggctgatgatttgcctccaccaccccctttggctgctggtgttgaaccacttaaagccgatgaaacaaagatgccattgaaacctaggagtctggtccagaggaatggctttggcagaaaggggcagcagataaagctgataacaaaccacttcaaagtttctctcatgaaggctgaagattttttctatcattactatgtcaatttgaagtatgaagatgatacaccggttgatcggaaagggtcgggaagaaaagtgatcgaaaaactgcagcaaacttatgctgctgaacttgcaaataaagattttgcatatgatggtgagaagagcctgtttacaattggtgcccttcctcaagttaaaatggaattcactgttgtggatgaagacgtttcaactggaaagactcctgcaaatggcagtccaggcaatgatagtcctcctggaagtgacaggaaaagggtccgaaggccttacaatacaaagacatataaggttgaactatcttttgcggcaaaaatccctatgagtgcaatctcacaggctttgaggggtcaggagtcagagcacactcaggaagcaattcgagtgattgacattattctgaggcagcactcagctaagcagggttgcctattagtaaggcaatcgttcttccacaataatccttccaattttgttgacctgggtggtggtgtagtgggatgtagagggttccattctagttttcgtgcaacccagagtggactttcactcaatatcgatgtgtccaccacaatgatagtgaaacctggtcctgtcattgactttctgattgccaatcagaaagttaatgatccaagcatgattgattgggcaaaggccaagcgctcactgaagaacttaaggataaaaacaagtccggcgaaccaagaacagaagattgttggtctcagcgacaggccttgccgtgagcaattattcacactgaaacataaaaatggtgaatctgaagagatcactgtttttgattactttgtaaagaaccgtggcataaagctggaatattctggtgatcttccttgtatcaatgtgggaaaaccaaagcgtccaacttattttccagttgagttatgcagtcttcttcctttgcaacggtacactaaagcattgagcacacttcaaagatcatcactcgttgagaaatctaggcagaaaccacaagaaaggatgtctgttttgtctgatgtgctgcaaagaagcaactatgatgcagaacccatgctgaaggcttgtgggattacaattgctagaaatttcatagaagttgatggtagggtactgcagccccctaagcttaaagctgggaacggagaagacatttttacgcgcaatggcagatggaatttcaataataagaagctcattagagctagcagtgtcgagaaatgggcagtagtaaacttttctgcacgatgcaatgtccgggatcttgtccgtgatctcatcaagtgtggaggcatgaagggcattatggttgatgcaccatttgctgtatttgatgagaatccttcaatgagacggtcacctgctgtaagaagggttgaagacatgtttgaacaagtgaaaactaagcttcctggagcacccaagtttcttttgtgtgttctagcggaaagaaagaattccgatatttatgggccttggaagaagaaatgccttgctgaatttgggatcgttacacagtgtgtggcaccaactagagtcaatgatcagtatcttacaaatgtcttgttaaagattaacgcaaagttgggtggcttgaattcgttgctccaaattgaaacatccccagcaattcctctcgtatccaaggtcccaactataatcttgggtatggacgtatcacacggatctcctggacattctgatataccgtctgttgctgctgttgttagttctcgtgaatggcctcttatctcaaaatacagagcatctgtccgcacccaatcaccaaaaatggaaatgattgactcgttgtttaagccacgggaaactgatgacgatggtctgattcgggagtgtctgattgacttctacaccagttcagggaagagaaagcccgaccaagtcatcatcttcagggacggtgttagtgaaagtcagtttaatcaggtgctgaacattgagttgcaacaaatcattgaggcttgcaaatttcttgatgagaaatggaatcccaagttcacattgatcattgcccagaagaatcaccacactaaatttttcattcctggaaagccagataatgttccagctggcactgttgttgacaacaaagtctgtcatccaaggaacttcgatttctacatgtgttcacatgctggaatgattggaactaccaggccaactcactatcacatcctgcatgacgagataggcttcaatcctgatgacctgcaggagctggtgcactcgctctcttatgtgtaccaaaggagcacaacagccatatcagttgttgctcccatctgctacgcccaccttgcagccgcccaggttgggcagttcataaagttcgacgagatgtcggagacttcatctagccatggggggcatacctcggcgggcagcgtccctgtacaggagctgccccgtctgcatgagaaagtgaggagctccatgttcttctgctgagcagcagggaatgtgtcccttggttttacctttttgggtgtatggtcgggggttctgaacccatgaacttgttgcctcacttggttccagcctcaggaagaactttgtaggatgctgaatggtaggatttttaagcatcgttgcagttgtgctgggtggcacgctgcaaccattttggctagcttgttgcagcacttggtgccttcctgagaggaagtagacttggaacctggtagcacgtccttaaaccatccttttaagcgttgctggttcggcctctgagctgtgtttgtcgtgc

SEQ ID NO: 622 - DNA, 2831 bp, Zea mays
gggcgctccattttggagatttcgcaacctctgcctcgttctgccatttttttttcttgcctgcaccaacgtcatctaaccagtcattagttggtgaaatcctccactcccctgcagaccacgtcagccttcaccttgccgtctccgttacgcgccgcgagcccgcgagcgtttggggagttttggagcggaggaggcaagggaggacggacagggaagtttggttgtggaaatggatgtggtggaatcctcgccgtcgtcgtcgccgatatcgtctccggccgggtcttcggagtccatagacctcaacttcctgccgttcctcaagagggagcccaagtcggagcccgcgtcaccagagctcgggcccctgccgctgcctgcgcccccaacccagacgccccagcagcagcatgcagcggctccggctcctgaggccacggcgcctctgtcgccagcgactcctgacctctcgtccgctccggtgatggcgccgctgcagtcgctgccgcctaacctggacgaggacgcgctccttcgggagtactaccgcctcgcgggcctctacctctcgtctgcgaggtccggggcgatcatcccagcgctagctccggaggcggccgcaccggcggtggtgcagtcggggtccgggtctgtcgtgaagaagcgccggccgcgttcgtcggacctcgtgcgggtctcctcgctcggcgtgcaggaccagatctacttccgcgacctcgtgcgcagggcgcgcatcactttcgaatgcctccgcgggcttctactcagggacgacgagcgcgccgagtccctcggccttgcggccgtcgccgggttcggcgttgccagggaccggcgccgcgtccgcgcggacctgcgtgccgcagcgctcatgggggaccacgacctctggctcaatcgcgaccgccgcatcgtcgggccgatgcccgggatctcggtgggtgacgctttcttcttccgcatggagctttgcgtgcttggactccatggccaggtgcaggccggaattgattatgtcagtgcagggaggtctgcatctggggagcctatagccacatctataattgtatctggtgggtatgaggatgatgatgatcacggcgatgtacttgtgtacactgggcatggcggccgtgatcccaacctccacaagcattgcgtcgatcagaagctggagggcggcaatcttgccctcgagcgcagcatggcttatggtattgagattcgtgtaatccgtgctgtcaagtcaagacgaagccctgttggtaaggtttacttctacgatggcctctacaaggttgttgactactggctcgaccgtgggaaatctgggtttggtgtttataagtatagactgctgcggattgagggccaagaacccatgggtagtgtgaattatcgagtagctgaacagcttaaggtggatgtgtttgctataaggccaacagggtatttgagctttgatatctccatgggccgtgataccttgtcagttgcactcttcaatgatgttgatgatgatcaggacccactcttattcgaatatctggcacgtccaatatttcctacctctgctgtccaggggaagtttgctgaaggtggtggtggtggttgtgattgtgctgagatttgctcaattggatgtaactgtgcagggaggaatggtggcgagtttgcatatgataggactggaaccctgctacgaggcaagccactggtatatgagtgtgggccatactgcagatgcccacctagttgccccaacagggttagtcagaaggggcttcaacataggcttgaggtattccggtcaagggagactgggtggggagttcggtctttggatctcattaaggctggcacattcatttgtgagttcagcgggattatccttactcaccagcagtcagaggttgtggcagcaaacggcgattgcttggtgcgtccaagtaggtttcctccaaggtggttggattggggtgatatatctgatgtctaccctgattatgtggcgccagaccatccttctattcctgagttaaaatttgcaattgatgtgtcaagggcaaggaatgtggcatgctatttcagccacagttgcagtccaaacgtgtttgtccagtttgtgctgtttgatcattacaatgtgtcttacccccacctcatgatctttgccatggaaaacattccaccgttgagggagctaagcattgactatgggatggttgacgaatggattggacagttaactatgtagctggagtatctatttagaaggcagtaatctccttcttttacctttatttttgaagttttcattatgcttcactttgggatcatcaagccaactgctggctaaaattcctcagctgtccagcagtggaggtttccaactagcataatgttcctctggcgttgaaagaggcttgcataaggtgaccaagctatcatcaacagaacatcagccgttcattgtatatgttgcctgataacctaggtgccttagccaattttctagatgatctcgcttttgaagtataatgtgtgctgctgtaggaagcttgtttggcgtggctggcgctgagtttcagccttaaccttcgtgttatgagttgtcgctgttggaactcattttctgtacatatatctgtaaattatctagctggaaatgtgcccgcttctgttgggaaatgttggtccatatgtggcaaagttatttggataccttgtggaattgaagattccgcggagccaggtttgtccgtaggtcattgcattaatgattttgtgaaattatttgtggtgaa

SEQ ID NO: 623 - DNA, 2495 bp, Zea mays
gctctattttggggagattttgcaacctctccctgactgcgccatttttttttctcgcctccaccaacgtcagctctccagtcaccagttggacaagcgggacgggacaacatcctcaccagccgcaatcctccactcctccccgcagccctcgaccctcgtcagcctctccagttcacctcgccgtctccgtcatgccccgcgagggtttggggaattttggagcggaggaggaggcgagggatggtggacaggaaggtttggttacggaaatggatgtggaggaatcctcgccgtcttcgtcgccgatgtcgtctccggccgggtcgtcagattccatagacctcaacttcctgccgtttctcaagagggagcccaaatcggagccgtcgtcaccagagctcgggcccctgccgctgcctgtctccctcacccagacgccgccgcagcagcatgcagcggcggcggctccagcaactgaggcctcggtgcctccgcctccggcgactcctgacctctcgtccgcgtcgatgatgaccccgctgcagtcgctgccgcctaacccagacgaggactcgctccttcgggagtactaccgccttgcgagactatatctctcgtctgcggggtccggggcgatcgtcccgacaccggcaccggaggcggccgcaccggcggtggtacagtccggggccgggtccgtcgtgaaaaagcgccggccgcggtcatcggagctcgtgcgggtctcctcgctcggtgtgcaggatcagatctacttccgcgacctcgtgcgccgggcgcgcatcactttcgagtgcctccgcgggctgctactcagggacgacgagcgtgctgagtccctcggcctcgctggtgccgccgggtttggcgttgccagggaccggcgccgcgcccgcgcagacatgcgtgccgcagcgctcatggcagaccacgacctctggctcaatcgcgaccgccgcatcgtggggccgatgcctgggatctcggttggtgacgctttcttcttccgcatggagctctgcgtgcttggcctccatggccaggtacaggcaggaattgattatgtcagtgcagggaggtcggcctctggggagcctatagccacatctataattgtatctggtgggtatgaggatgatgacgatcatggcgacgtacttgtgtacactgggcatggcggccgggatcccaacctccacaagcattgcgtcgatcagaagctggagggtggcaatcttgccctcgagcgcagcatggcttatggtattgagattcgtgtaatccgtgccgtcaaatcaagacgaagccctattggtaaggtatacttctatgatggcctctacaaagttgttgactactggctcgaccgtgggaaatctgggtttggtgtttataagtataaaatgctgcgcattgagggccaagaacccatgggtactgtgaattatcgagcagctgaacaacttaaggtggatgtgtttgctgtaaggccaacaggttatttcagctttgatatctccatgggccgagagaccttgccagttgcactctataatgatgttgacgatgatcaggacccactcttatttgagtatctaacacggccaatttttcctacctctgctgtccaggggaaatttgctgagggtggtggtggtggtggttgtgattgtgctgagatttgctcaattggatgtaactgtgcaggaaggaatggtggcgagtttgcatataataagactggaaccctgctacgaggcaagccactagtatatgagtgtgggccatattgcaggtgcccacctagttgtcctaacagggttagtcagaaggggcttcaacataggcttgaggtattccggtcaagggagactgggtggggagttcgttctttggatctcattaaggctggcacattcatttgtgagttcagtgggattgtccttactcaccagcagtcagaggtcatggcagcgaatggtgattgcttggtgcgtccaaataggttccctccaaggtggttggattggggtgatatatctgatgtgtaccctgattatgtggcgccagaccatcctgttattcctgagttaaactttgcaattgacgtgtcaagggcaaggaatgtggcatgctatttcagccacagttgcagtccaaacgtgtttatccagtttgtgctgtttgatcattacaatgtgtcttacccccacctaatgatctttgccatggaaaacattccaccattgagggaactaagcatcgactatgggatggttgatgaatggactggacaattaaccatgtagctggagtaacctatttaaaaggcagtgttctctttctttcttttccctttatttttggaattctcataatgcttcacctggggatcatcaagccaactggactaaaattcctcagctggtaattctccttattcctcatgtgctatttttctttgggtacttcat

SEQ ID NO: 624 - DNA, 2246 bp, Zea mays
accactcaccacagtctccagtctccactgcatctaaaaaaaaacgtaaaacccccaccacgccgtagcggagagaagagaagagaggagcgcgcgatcgatgtcgggctccggcgatcgtcgcggcggcggtcctccgggttcccatagtggctgggaaaccatggggaagaagtcgaagaaacccgggcaagccggggggagacagtgggcaccatggagttccacaaatgtgacacctaacacagcaaggccagcatggggtggcagtggttcctcgcacccttctggaaccagctgggctcaagctccagatcatggtgctgctaccagaggcaatcctagaccgccatcacaaacatcgcgccctgttctggctccacctctggcaaatggttggcagtggcaatccaggcctcgcccatctggatctgaagtcaagaaggatgatgctcctccatctggttctgtccctgaggtggagaatgttgatggcaacaatacatcagatgatgatgatgatgatgacgatgatttgagtgatgatatcagtgatgactatgattctgacgcaagtgagaaaagttttgagactcgaaaaacgaacaagtggttcaaagagttctttgaagtattgaatacattgagtttggaacaaattaatgaacaaactcggcaatggcattgcccggcatgcaaaaatggacctggggcgattgactggtacaaagggctgcagcctttagtgagtcatgctagaacaaagggttctacaagggttaaacttcacagggaattggctgcattgctggaagaggagctttctcgcaggggaacttcagtgttaccagcgggtgaacaatttgggaaatggaaaggactgcaagaaagcactgatcgtgagatagtgtggccaccaatggttattgttatgaataccttcttggaaaaagatgaagatgataagtggaagggcatgggaaaccaagagctccttgattattttggagaatatgaagcaagtaaagcacgtcatgcctatggtccctctgggcaccgtggtatgagcgtgttaatatttgaaagctcagctgtgggctacatggaagctgaacgtctgcataaacactttgttaatcaaggtacagacaggaattcatggcacctacgcaaggttcgatttgtgcctggtgggaaaaggcaactatatggtttcttagcaaacaaagaggatatggaggcatttaacaagcattgccatggtaaaagccgtctgaagtatgagatgaggtcttacaatgagatggtggtgattcaaatgaaacagatgagtgaagacaaccaacaactgaattacctgaagaacaagatggttaagacagagcagcgatctaaagcagtagaagaatcattgggtgttgttacccagaagctacgtgagactattgaagaaaatatatttgttaggagtaaagcaaaagagaagcacatggagtacgaggaagagatgaagtcccaggaggaaatttttcatggtctaattgaggatattcacaaggccacagaggataaagaaaagcagtttgagaagttgttgcaggaagagcgctcaaaggccagacgctttgatgttgattctggaactatgaaagatcgtcagctaaggaaggaatatgtgcagaagttcattgattgccaagtcaaggatgtggcagagtttgaagttgagcgagatgagctgatcaaagtccacgaggacaagaagttgaagctcaagaaagaatacatggatctggagctggagctggagaaggagtttgacgcagccctgacgggcctgatggagaagcataagccagataccttcgaggcctccagctcgtaagggggcttcagcggctaagcgctttccttaggccccagctaagcttggagcagtctcgtacatgctcctgcttgcttatccatgaaataatgcctggacagtctgtagatgttgcgaaaacatggtgccccctgtggttgccgcgtgtgtagtaagtatctctcagtcgtagtgtggttgaagcatctgaactcttgagcggtttgcctgtgatggcatatgggtcaaactacaactggagtgtgatatctagtttatatggtccagcgctcttgttgactgcgggtggtggtttgccccggataatttactgattatgtctgctccgatcgtcaaagtgcctctttctgttttttttctt

SEQ ID NO: 625 - DNA, 2863 bp, Zea mays
gctatctcctccagcatccacccaacggatccgcggcaaccgaccacccatgggatcgctccggggcgcggcagcctcctccgcggcgccgcgcgcgggcgacctggtgaccacgcaggttagccttggtggatttgatgccaccgtcaaggcgctcgatctcgccgacttcctcgagttgaatgcgggctcggtctggcgctgccgcctcaagacctcctggactccgccggacgcctatcccgacttccttctccccaccgtcacctccgccgccgcgccgccgccacagtacgatcgcgtgcctccgcacgccttcgtccactttgcgcgcccggagggcgcgcgcgccgccgccgacgcagcgggccgatccgagctcatcctctccggcaaacccctgcgcgccgcctccgcacaggacagctcccttcgggcatcccgccgccgtagtgtctcgccattccgcttccctggctcgcgcctcgaggtcggggatctcccggcctcggacgccttcatcgccgcctggcgcggcccggcctctgggctcgagttctccgtcgacccgttcgacgggtcttgccacttcatcttcgcccgcgacaccgctttcaaagtccgggagttccgcgagtctgtggtgatgcgctgcgacgtcaagctccagttccccgtccgcgatgttgcggaagtcagggtgttccggctcgactgctcgctgctgatccggctatcggccgcaccgctggtctgttaccgcacggcggatgacgacatccacgtgtccgtgccgttcgacctgctcgacgacgatgacccgtggatacggaccacggacatcactccaagtggtgcgattgggcggtgcggtgcgtatagaatcacattctcgccgcggttctggccaaagatggaacgcgcgctgacgtacatgagggataggagggtggcgatccttgattgcgttggagggtggggggccaggagggggctcaccgtgcgtgatgagcctgagtttggggagcggatgcaggacctgttcttctgcgtgcagcacgccgagggtctcaagtttccggtgttgttcctcgtgaatgctctggtgcacaagggagtaataagtcaacaccacctcacgcctgaattcttcggtttgctccagaggaaggaggatgatgtgaatgtggctgccttgagggaattttggggggacaaatttccagtttttgatgcatgtgggaggctgaagaatctgcaggatagggttgccaggtacctgaaacatcttcgcaacaagattggggatgtcaattctgaggtgaggaggctggtaatcacgcccaccaaggcttattgcatgccaccagaagtggagcgctctaatcgcgtcatccggcattatagtgaagtctcagaccggtttctgagggttacttttatggatgagagaatgcagatgctcaacagtaatgtgctgaatttctctgctgcacaaatcgtcaaagatttgatgtcaaactcgttcctgcataagacaacagtgtacaagcgtgttaaaacgtttttgacagagggattccacatgtgtggcaggaagtactcgtttcttgcattctcatctaaccagctgagggacaggtcagcatggttcttcgcagaggacagaacgacaacagtggaaaccattaggaaatggatggggcggttcacaagtaagaatgtagcaaagcatgccgctcggatggggcagtgcttctcctctacatatgctacggtggtgctgcagccgcatgaggtaaatgagtgtcttgatgaagttgaacataacgggtacattttctctgatggaattggcaagattacgtgcgaccttgcactcgaagttgctcagaagctgcaattgacagataatcccccatctgcttaccagattaggtatgcaggcttcaagggtgttatatctgtctgggaaggaaaaaatgatgggatacgactttccctgaggccgagcatgcacaagtttgagtctaaccatactgtgttagaggtggtctcgtggacaaagtttcagccaggattcttaaatcgtcagattattacattactgtcctccttgaatgtcccggatgctatctttgctcaaatgcaggaagccatgttatctaatctcaacaatattttgtcagactctgatgttgcttttgacattgtaaccgcctcttgtgctgagcaaggaaccactgcagcactgatgttgagtgctggcatttcacctggaactgagccacacctgaaagcaatgctgttagctataaggtcctcacagctgctaggtcttttggagaagacaaggatttttgtgcccaagggaaggtggttgatgggctgccttgatgaacttgggatccttgagcaagggcagtgctttatccgggcatcatctccatcactcaataattgtctggtgaagtatggatcaagattgtctgcagcaaacacaaatgcagagaccattctgggtactatcgtaatggcaaagaatccatgccttcatccaggggatgtccgaatccttgaagctgttgatgtgcctgaactgcatcaccttgttgattgcttggtcttccccaagaaaggtgagaggccgcacgcgaatgaagcatctgggagtgatcttgatggggatctatacttcgtaacatgggatgaaaaccttataccacctggtaaaaagagttggaaccctatggactactccccagctgaagcaaaacaactgccacgcgcagtatcccaacatttttggactatgtctttatatggttatatcgtcttctactccctccagtctggtttctaa

SEQ ID NO: 626 - DNA, 5706 bp, Zea mays
atggaggtttctcaccggggaagaagaccctcgccggagccgaggagaaatccgtcgattgccggagatttggggatccaatcgatgaaccgaacgcgctgcgacgaagccttcgacgagacgaacgcagcgcatccccatcacgaacgtcggcggactgccggacgccgtccgccgggacacaacttagccgaggagtggccgacgggcccggcgacgcgggcgatcctgaccggcttcgacgccggcctctcggcgcgtggcctcgccgacgagttggagcgcttggcaggcaccgtctggcgctgcaggatcaagacttccgtcacgccgcccgagtcctacccggacttccagctctcagtccacgccgccgccgccgccgccgtgttccaccaggacgagccgccgcgggacggtcgcgtggcccctcatgccttcgtccacttcgagcaccgcaatgccgcggaccgcgctggcgacttcttcacgacgcgcatcctcgcgcagagcagacacatgctacatggccatgcggcgcgccggcgggatggtgtcaccgacgccgccaaaccgatgctcttccccaactcgtgcatcgagatcggcgacgtcgtggcgccggacaccttcctcgtcgcgtggcgcgggaccgacgacagcgcctcggcgctcgacttcgtggtggacccgtctggcggcagctgccggctgctgttcgcccgctacaccgccttcacgtgccccgacaggcgccggcccgcggcgctgctgtgctgcgacgtgaagctcgagttcgcgctcgcccacgtcgccgaggccctggcgttccaggccgacgactcgctggtcctccggctctccgccgcgcccctcgtgtactaccgcacgtcgggcgacgacgtccacggccgcgtgcccttccaactcgtcgacgccgacgacgacccgtggatacggaccaccgacgtgacccggagcggcgccatcggccggtgcttggcgtacagggtctccttcgcggtgcagttctggccgacgatgagggtcgcgctggagtgcatgcagaggcagggggtccccgtccacgtacgcgacagacggtgccggggcttcaccgtgctcgaggaggcaggcttggtgcagccgatgcgggacgcgttcttctccccgcggcacgacgacgacgcaggggcagggctacggttcccggtgctgtacttggtcaacgtgctgatgcacaacggggtagtcaatccgcaccagatgacaccggagttcttcggtttgctgatgaggacacgcgaagatgtgaacgttgctgcgctgacggaactgttcggtgcaaagcttggagtctgtgataatccatgctggagggaatactgtatgccggtggagcgctccaaccgcgtcatccggcattaccacgagctgtcagatcgcttcttgagggttacttttacggacgagggtatgctgccgctgaaccctaacgcgctgaccctccgtgcggtgccctcgacgtcgacgcccagcacatcccggcagatgacaagcgtctacaggcgtgtccagacggccctgacggaggggctcatcatgtgtggcaggaggtactcgttcctcgcgttctcagccagccagctgaagcagaagtcggcctggttcttcgcggaggacggagcgacaacggtggcaggcataaaggagtggatggggcagttcccgatcaggaaccccgcgaagcacgccgctcggatggggctgtgcttcacgtcttcctacgcgacggtgacgatgcagcccggcgaggtggacgaggacctcgaggacgttacgcgcaacgggtacaacttctccgacgggatcggggtgatcacggaggacctcgcgctggaggtcgccgagatgctgccgctggcggacaggttcgccccgtccgcgtaccagatcagaagagaggtattcgaggagacgagagtagcgatggcgcgcagccgtactcgcagccccgagtcgactcgtcgtcttgctcatcgccttcgcgctatcaagccatccaagtccaaccaacagcatccccatcacgaacgtcggcggactgccggacgccgtccgccgggacacaacttcgccgaggagtggccgacgggcccggcgacgcgggcgatcctgaccggcttcgacgccggcctctcggcgcgtggcctcgccgacgagttggagcgcttggcaggcaccgtctggcgctgcaggatcaagacttccgtcacgccgcccgagtcctacccggacttccagctctcagtccacgccgccgccgccgccgccgtgttccaccaggacgagccgccgcgggacggtcgcgtggcccctcatgccttcgtccacttcgagcaccgcaatgccgcggaccgcgctggcgacttcttcacgacgcgcatcctcgcgcagagcagacacctgctacatggccatgcggcgcgccggcgggatggtgtcaccgacgccgccaaaccgatgctcttccccgactcgcgcatcgagatcggcgacgtcgtggcgccggacaccttcctcgtcgcgtggcgcgggaccgacgacagcgcctcggcgctcgacttcgtggtcgacccgtccggcggcagctgccggctgctgttcgcccgctacaccgccttcacgtgccccgacaggcgccggcccgcggcgctgctgtgctgcgacgtgaagctcgagttcgcgctcgcccacgtcgccgaggccctggcgttccaggccgacgactcgctggtcctgcggctctccgccgcgcccctcgtgtactaccgcacgtcgggcgacgacgtccacggccgcgtgcccttccaactcgtcgacgccgacgacgacccgtggatacggaccaccgacgtgacccggagcggcgccatcggccggtgcttggcgtacagggtctccttcgcggtgcagttctggccgacgatgagggtcgcgctggagtgcatgcagaggcagggggtccccgtccacgtacgcgacagacggtgccagggtttcaccgtgctcgaggaggcaggcttggtgcagccgatgcgggacgcgttcttctccccgcggcacgacgacgacgcaggggcagggctacggttcccggagctgtacttggtcaacgtgctgatgcacaacggggtagtcaatccgcaccagatgacaccggagttcttcggtttgctgatgaggacacgcgaagatgtgaacgttgctgcgctgacggaactgttcggtgcaaagcttggagtctgtgataatccatgctggaggttgaagaacgcgcaggacaaggctgccaagaatctcgatcttgtctgtcgcagcagcagcagcagaagaaaggctagtgattgcgatgctgaggtgcgaaggctgatcgtcactccaaccagggaatactgtatgccgcctcaagtggagcgctccaaccgcgtcatccggcattaccacgagctgtcagatcgcttcttgagggttacttttacggacgagggtatgctgccgctgaaccctaacgcgctgaccctccgtgcggtgccctcgacgtcgacgcccagcacgtcccggcagatgacaagcgtctacaggcgtgtccagacggccctgacggaggggctcatcatgtgtggcaggaggtactcgttcctcgcgttctcagccagccagctgaagcagaagtcggcctggttcttcgcggaggacggagcgacaacggtggcaggcataaaggagtggatggggcagttcccgatcaggaaccccgcgaagcacgccgctcggatggggctgtgcttcacgtcttcgtatgcgacggtgacgatgcagcccggcgaggtggacgaggacctcgaggacgttacgcgcaacgggtacaacttctccgacgggatcggggtgatcacggaggacctcgcgctggaggtcgccgagatgctgccgctggcggacaggttcgccccgtccgcgtaccagatcaggtacgcggggttcaagggcgtcgtggctgtctcgccgccggggccgggacaagaagaccgtgggacgcggaggatgtcgcttcggcccagcatgaggaagttcgagtccacgcacaacgtgctggaagtggtgtcctggaccaagttccagccagcgttcttgaaccgccagatcataacgctgctcaccaccctgggcgttcccgacgactccttctggcagctgcaggaagcgatgctaggcaagctcaggcgggttttgtcggacagcgatgtggcgtacgaggtcgtgaccaactcttgccctgagcaaggaagcaccgcagggctgatgctgggcgctggcttcgctcctgcgactgagccacacctgagagcgatgctactggccatctgcacctcgcagatgcagggccttctgaacaaaacgtggatctttgtgcccaagggaaggtggctgatgggctgtctcgacgagtttgggatccttgaacaggggcagtgctttctccgggtctcgacgccatcactcggcagccgctgcgtgaaccgttctccgatatttccctcggaatataagggcgatgccaatgcacaggtgattactggtacggttgtgatggcgaagaacccatgccttcatccaggggacgttcgtatccttgaagctgtggatgtccctgatctgtatcaccttgtcgactgcttcgtcttccccaagaaaggtgagaggccacacgccgacgaagcttccgggagcgacctcgacggcgacgtctacttcgtgacgtgggacgagagccttgtacctcctgggaggaagagctgcaccccgatggactactccccggctaaaacaaagcaacttccacacgacgtacaccaacaagataccattgatttctacttggagagcatggtatacgacaaccttggtcgaatatgcaacgcccatgctgctcatgctgatcggagcgacgacggagctatggatcccaagtgcattgagttagctcggctcgcatctatcgccgtggactccgccaagaccggggaaattgtgagaatgccaccagccctttcaccaaaagagtaccccgacttcatggggaaggaggacgccatctcttacagatccgaaaagatccttggaaggctctatcggtcagtcctaggggaaaatgacggcgattttctgtcacgaggcgcatgcatttcagatgagattcgatatgacgccgatctagaagtccctggcgcctcagactttcttcaggatgcttggcgatgcaggtgcctgtacgaagctcggctgaatgccctgctcgatcaatacaatgtgcgcagtgaggctgagctcgtgacaggggagatatggtcacttgccggatgcagcaagaagtatcagcatcaattaaaagagaggatcaactatgcgtactccaaagtccaccaagagttccggatcatctttgagagcattggtgcctctactgacaacaaaaacctggcgtatgagatgaaggcgtccgcgtggtaccaagtaacgtatcaccctgaaatcatccgatcaagggagcctggtgatgaggatgcacctacgagacttagctttgcatggatcgcagttgattacttggcacaaataaagatgaagcgccacgtagactag

SEQ ID NO: 627 - DNA, 3726 bp, Zea mays
atggcgcgcagccgtactcgcagccccgagtcgactcgccgtcttgctcatcgccttcgcgctatcaagccatccaagtccaaccaacagcatccccatcacgaacgtcggcggactgccggactccgtccgccgggacacaacttcgccgaggagtggccgacggggccagcgacgcgggcgatcctgaccggcttcgacgccggcctctcggcgcgtggcctcgccgacgagttggagcgcgtggcaggcaccgtctggcgctgcaggatcaagacttccgtcacaccgcccgagtcctacccggacttccagctctcagtccacaccgccgccgccgccgtattccaccaggaccaggacgagccgccgcgggacggtcgcgtggcccctcatgccttcgtccacttcgagcaccgcaatgccgcggaccgcgctggcgacttcttcacgacgcgcatcctcgcgcagagcagacacctggtacatggccatgcggcgcgccggcgggatggtgtcaccgacgccgccaaaccgatgctcttccccgactcgcgcatcgagatcggcgacgtcgtggcgccggacaccttcctcgtcgcgtggcgcgggaccgacgacagcgcctcggcgctcgacttcgtggtggacccgtctggcggcagctgccggctgctgttcgcccgctacaccgccttcacgtgccccgacaggcgccggcccgcggcgctgctgtgctgcgacgtgaagctcgaattcgcgctcgcccacgtcaccgaggccctggcgttccaggccgacgactcgctggtcctccggctctccgccgcgcccctcgtgtactaccgcacgtcgggcgacgacgtccacggccgcgtgcccttccaactcgtcgacgccgacgacgacccgtggatacggaccaccgacgtgacccagagcggcgccatcggccggtgcttggcgtacagggtctccttcgcggtgcagttctggccgacgatgagggtcgcgctggagtgcatgcagaggcagggggtccccgtccacgtacgcgacagacggtgtcggggcttcaccgtgctcgaggaggcaggcttggtgcagccgatgcgggacgcgttcttctccccgcggcacgagcacgacgacgacgcagggctacggttcccggagctatacttggtcaacgtgctgatgcacaacggggtagtcaatccgcaccagatgacaccggagttcttcggtttgctgatgaggacacgcgaagatgtgaacgttgctgcgctgacggaactgttcggtgcaaagcttggagtctgtgataatccatgctggaggttgaagaacgcgcaggacagggctgccaagaatctcgatcttgtctgtcgcagcagcagcagcagcagaagaagaaaggctagtgattgcgatgctgaggtccgaaggctgatcgtcactccaactagggaatactgtataccgcctcaagtggagcgctccaaccgcgtcatccgacattaccacgagctgtcagatcgcttcttaagggttacttttacggacgagggtatgctgccgctgaaccctaacgcgctgaccctccgtgcggtgccctcgacgtcgacgcccagcacgtcccggcagatgacaagcgtctacaggcgtgtccagacggccctgacggaggggctcatcatgtgtggcaggaggtactcgttcctcgcgttctcagccagccagctgaagcagaagtcggcctggttcttcgcggaggacggagcgacaacggtggcaggcataaaggagtggatggggcagttcccgatcaggaaccccgcgaagcacgccgctcggatggggctgtgcttcacgtcttcctacgcgacggtgacgatgcagcccggcgaggtggacgaggacctcgaggacgttacgcgcaacgggtacaacttctccgacgggatcggggtgatcacggaggacctcgcgctggaggtcgccgagatgctgccgctggcggacaggttcgccccttccgcgtaccagatcaggtacgcggggttcaagggcgtcgtggctgtctggccgccggggccgggacaagaagaccgtgggacgcggaggatgtcgcttcggcccagcatgaggaagttcgagtccacgcacaccgtgctggaagtggtgtcctggaccaagttccagccagcgttcttgaaccgccagatcataacgctgctcaccaccctgggcgttcccgacgacgccttctggcagctgcaggaagcgatgctaggcaagctcaggcgggttttgtcagacagcgatgtggcgtacgaggtcgtgatcaactcttgccctgagcaaggaagcaccgcagggctgatgctgggcgctggcttcgctcctgcgactgagccacacctgagagcgatgctactggccatctgcacctcgcagatgcagggccttctcaacaaaacgtggatctttgtgcccaagggaaggtggctgatgggctgtctcgacgagtttgggatccttgagcaggggcagtgctttctccgggtctcgacgccatcagtcggcagccgctgcgtgaaccgttctccgatatttccctcggagtataagggcgatgccgatgcacaggtgattactggtacggttgtgatggcgaagaacccatgccttcatccaggggacgtccgtatccttgaagctgtggatgtccctgatctgtatcaccttgtcgactgcttcgtcttccccaagaaaggtgagaggccacacgccgacgaagcttccgggagcgacctcgacggcgacgtctacttcgtgacgtgggacgagagccttgtacctcccgggaggaagagctgcaccccgatggactactccccggctaaaacaaagcaacttccacgcgacgtacaccaacaagataccattgatttctacttggagagcatggtatacgacaaccttggtcgaatatgcaacgcccatgctgctcatgctgatcggagcgacgacggagcgatggatcccaagtgcatcgagttggctcggctcgcatctatcgccgtggactccgccaagaccggggaaattgtaagaatgccaccagccctttcgccaaaagagtaccccgacttcatggggaaggaggacgccatctcttacagatccgaaaagatccttgggaggctctaccggtcagtcctaggggaaaatgacggcgattttctgtcacgagatgcatgcatttcagatgagattcgatacgacgccgacctagaagtccttggcgcctcagactttcttcaggatgcttggcgatgcaggtgcctgtacgaagcccgactgaatgccctgctcgatcaatacgatgtgtgcagtgaggctgagctcgtgacaggggagatatggtcacttgctggatgcagcaagaagtatcatcatcaattaaaagagaggatcaactatgcgtactccaatctccaccaagagttccggagcatctttgagagcattgatgcctctactgacaacaaaaacctggcgtatgagatgaaggcgtccgcgtggtaccaagtaacgtatcaccctgaaatcatccgatcaagggagcctggtgatgaggatgcacctacgagacttagctttgcatggatcgcagttgattacttggcacaaataaagatgaagcgccacgtagactag

SEQ ID NO: 628 - DNA, 3644 bp, Zea mays
ccgtgacatcgccgggatcccgcccggacctcacccggcgatatgtcgacggcggctcccgcgccgggctccacggccacggtgcgggtatccaacatcccggcctcggccatcgccgcagagctgctcgccttctttgactccgccgtcaccatcgctggcgcgaccttcgcctgcgagatagtcgccgctcaccgcggctggctcagccgcggccacggtttcgtccagtttgattcctccgccgccgccacccacgccatcgacctcgcctcctctggccgcctgccccccttcctcggctcctgcctatccgtctcccccgcccgcgctgacctcctgccccgcgcgcccgacctctccctccgcgctgccagcgcgagcctcattctaggcaaccgcgtcgccgagcgcgagctggaggtggcctactcctgcgacggcgtgcgggccgaggtcatcccgaggatgcggcgtgtggacctctacctgaagcacgattcccagagctacaagcttgaggttctctttgaggacatcaatgagtgctttgggtgccacctcgatgggacgggcgccatcttgctgcagctgacttatgcaccaagaatacacattgcaatttctgggtctacagttaaatcaaggtttacagatgatcgctttcatgcatgcaaggaggacgccaaatttgcatgggtcagagcactagatttcacacctaatagctcttttggcgagtgttccactcttgtcctgaaactgagcaaaggtgcatcagtatcatatattcttgaaagtttacccttctcaggagaattaggggaattggccattgcttcgatggatgtgtttggctcctcctccaatgtggttcctcttgttgactgcccaaatggcttttctgtgccttatgaagtactttttcgtctgaactctcttgttcacatggggaagctagttgccaggcatgttaatgctgatctgtttaaagtccttgaagatctgtcaatcgatactttaaggagaatatttgagaaaatgagcaaattaaaatctacctgctatgaacctttgcaattcatcagacatgaggctcatagcatgaatatgagaaagaaagccttgtccaacaagagggagagtggaaaattgatgaggtgttacagaattcacatcacaccatcaaaaatatactgcttggggcctgaggaagaagtttcaaattacgtggttaagtaccattctgagtatgcttctgactttgctcgagttacttttgttgatgaagattggagcaagctttctcccaatgcattgtcagctagaactgaacaaggtttcttttctaaacccttgaaaactggcctgtatcatcgtattctctccattctaaaagaaggattttgcattggccccaaaaaatatgaatttttggccttttcagcaagtcagcttcgtggtaattctgtttggatgtttgcttcaaatagttctctgactgctgagaatataaggaggtggatgggccactttgaagatatccgttcagtctccaagtgtgcagctagaatgggccaactgtttagctcatccaggcaaacatttgaagtctcatcatatgatgtagaagtaattccagatattgaagtcacaactgatggcactaaatacatattttcagatggtatcgggaagatttctactagatttgccagacaagtcgccaaattaattggcttagacccagctcatcctccttctgcttttcaaataaggtatgggggctataaaggagtcatcactattgaccctacatcctttttcaatctttctctgcgacctagtatgaagaagtttgaatcgaagagcactatgctgaacattacaaattggagtaagtctcagccatgttatgtgaaccgtgaaattatctctcttctttcaacattggggataaaggatgaagtatttgaatcgatgcaacaagatgacatgcacgaatcagatggaatgctaacaaataaagaagctgctttgtctgtcctagggaaaattggtggcggtgataccaagacggcagctgatatgcttctgcaaggctatgaaccaagttcagagccttacctattaatgattcttaaagcccatcgggctaataggctgaccgacataagaactcggtgtaagattcatgtccagaaaggccgtgttcttattggttgtttggatgaaacttgcaaattagagtatggccaagtttacatcagaattacaaagaatcacaaggagcagaagtacagtgaacagccgttcttttgcaacgatgatggcaaaacagctgtaattgtaggaaaagttgcaatcacaaaaaacccttgtctccatcctggtgatgtcagagtacttgaagctgtatatgaccctggattggatgctaggggtcttattgattgtgttgtatttcctcagagaggggaaaggcctcatccgaatgaatgctccgggggcgatttggatggcgacctcttctttattacttgggatgacaaactgattccggagaaggttgatgcacctatggactacactgcaacgaggccacgcataatggaccatgctgttacacttgaggaaattcagaagcacttcgtcagttacatgataaacgataccctcggtgccatctccaccgcccacttgatccacgcagaccgtgatccactgaaagctcgcagccccgagtgcgtccagctggccgctctgcactccatggcggtcgacttcgccaagacgggagctccagccgagatgcccctggcgctgaggccccgggagtttccggacttcatggaacggtgggagaggccaatgtacgtctccaacggcgtcctcggcaagctctaccgcgctgccctgcggcacgaggaggacgcagaagcgctcctgcctgcgggcccaccgagctgcgtgtacgacccggacctcgaggtcgccggtttcgacgagttcctggacgcagcggaggagcggtacgaggcgtacgccgagaggctgggcgccctgatgacctactactcggcggagcgcgaggacgagattctgacaggcaacatccggaacaagctggtgtacctgcggcgggacaacaagcgctacttcgagatgaaggaccgcatcatcgccgccgtcgacgcgctgcacgcggaggtgagggggtggctcagggcgtgcaaggaggacgacgcgtcgagggtggcgtcggcgtggtaccacgtgacctaccacccggaccgccgcggggagaagcggttctggagcttcccgtggatcatctgcgacaccctgctggccatcaaggcggcgcgcaggtgccggaagcgggtggaagacgccgccgtgcccatggactgcgacggttcctagacggaggtgccactgtggcagtgaagtgagcctgtgatgcgagtggaaactgtagtaataagatgcagtaccgctgagcgctgattgctgtaaaaagaagttagcgcgggttgtcttgagctcctcctaacaggcgtacgtatggtggaaccgtggaatcatgatttgccgcccttgctgatgactagaagcaggtacggttagctaagccgttacgt

SEQ ID NO: 629 - DNA, 4940 bp, Zea mays
gtgatacttgataggctataagctgctagtgcttgtggaatggaagagccacagaaggacagtgggcaaccatcaaaaagttctgattctgagctagaagctatggtattggatgataatggagcgggaaaatcccatagtatggaggaaaacagggattctcctatagatgtcgatggtgggcagtcatctatggatgtggatatcaagggaaaatcatccctcagtgatgatgttaatggaaagtcttcttccgagccatattccaatgctccaattgacatgagtgtcgaaagcctagagaagttttgcaaagaagcgtcaaggtccttctttgatgaagttggtctgattagccatcagataaattcctacaatgagtttgtctcgcatgggctccaggagctttttgattcgcttggggaagtgattgttgaacctggctatgatccttcgaagaaaggatcaggtggctggaagcatgccatcatcaagtttgggagagtgaagcttgaaaagcctgtgttttggactggcaaggatgaaggttctgttgattttaaaccttggcatgctcgtctccagaatatgacatatgcttcaagacttatagtagaagtgactattcaggtttattctttggagaaaagtgacaaatctaaaacagggaatgatggttttgttcaaaaaaggaacttcatgaatgaaactcattggatatttattggcctccttccggttatggtcaaatcaaacttatgtttgctgcatagcctcaacgaaagtgagtgcctgttcgacgcaggtggatactttttggtcaagggaatggagaaggtattcattgctcaagagcaaagatgtctaaggaggctttggattagtgaccgaccttgctggactatctcttttatgtctgaaatcaagcgtagacgtatatatattaaactagttgaatctacaaggagtgaagatttcagtgagagcaaaatcattaccatttcctttttgtatgcgacaatgccagtttggttgttgttctttgcacttggaatatcatcagataaggaagtgtttgatatgatagatatgcaagattgtgatgcttctgttatcaacacgatatctgcaactatcaaagaatctgataaactgtgtgaagacttccgtaaatcagataaagctcgtcaatatgttgatgagttggtaaaaagttcgagatttcctccagcggagtcctttgatgactatattgctaggtttctctttcctgatattagtggaaatagaaacaaagcacttttcttagggtacatggttaaatgtctgctaatggcttttactgggaagcgtaaatgtgataataaggatgatttcaggaacaaaaggctggacctacctggtgaattgcttggaagggaacttagggcacagcttaggctggcagagaaacgcatggttaaggccatccaaagagatttgaatagtgaccgtgagttacaagatcttgaacgttatatagatgcatcaattgttactaatggtctaaatcgtgccttttccactggttcttggtgccatccgtacaaaagagctgaacgatgctcaggaattgttgcgactctaaggagaactaatcctcttcaaatgatgtctgacttgaggaaaacccggcagcgggttgcttacgctgggaaagctggtgatgcaagatatccgaatccatcctattggggaaagctatgctttatgtccactccggatggtgaaaactgtggacttgtaaaaaatctagctgttactgctattgttagctcaagggtgatgcagcccttgattgagagcttcatttcttgtggaatgagtaagctgaatgacattcctactgaacacattcaaagaatggataagatctttttgaatggcaattgggtgggatcttgtgaaaattcagcttcatttgtatttcgattgaggtgcatgagacgcagcagtctgattgatcctcaggttgaaattaaaagggacaagcaccacaatgaggttcgcgtgtttactgatgcagggcgaatcctcagaccccttcttgtggttgagaatctgaataaaatcagaaaacctaaggggcgctcattctctttccatgaattaatgcaacaagaaataattgagttcattggtgttgaagaggaggaagatatacaatgtgcgtggggaatcaggcatttgtttgagagtgaaggtgcgatatctagttatactcactgtgaactggatccttcctttcttctgggattaagctgtggtatcattccttttgcaaaccacaattttgctcggagggtattgtaccaatctgaaaaacactcgcaacaagctattgggtactcaacgacaaatccacacatcagagttgatactctttctcatcaactatattatcctcagaggcctcttttcaaaacagttatagccgactgtcttggcagatcagattatgcttcttttggaagaaaaaatgatttcgcgagaccagaatattttaatggacaaaatgcaattgtagcagtcaatgttcatcaggggtttaaccaagaggattccctggttatgaatagggcttctcttgaacgaggtatgtttaggactgaacacctcaggagctataaggcagatgtagaaaacaaggatggaaccaaacgactgaaattgaaggaaaaaatagactttggaaaaacagaaagcaaaagaggacgtgttgacaatcttgatgatgatggcttaccttacgttggtgcaagtcttcagaccaatgacattgttattggcaaagtctcagaatctggagaagaccacagtattaagctgaagcatacagaaaagggaatggttcagaaagtattgctttcagcaaatgatgaagggaagaattttgctgtggttactctaagacaggttcggacaccttgccttggagataagttttccagcatgcatggccaaaaaggtgttgttggttttctagaatctcaagagaacttcccatttactcacgaaggtatagtcccggatattgtgataaatccacatgccttcccaacacgtcaaactcccggacagctgcttgaagctgctctggggaagggaatagcttgcaaaggtacaatgagatatgcaacaccattcaccacagcatcagttgacgttattgcagaacagttgcacagggctggttattcacgatggggatctgagaacgttctaaatgggcgaacaggtgaaagagtgcaatccttggttttcatgggccctaccttttaccagaggctgattcatatgtccgaagataaggtgaaattccgtaacactgggccggtgcaccccctcacgaggcagcctgttgccgacaggaaaaggtttggtggagttaagtttggagaaatggagcgtgactgcctcctcgcccatgggtcagctgccaacctgcatgaacgcctcttcctgcttagtgacttctcccagatgcacatctgccagacatgcgagcgcgtggctaatgttgtcatgaggtctgtccccggaggcaagaagatccgtggcccctactgcggcttctgcaagtcttcggagaacatagtgagaatcaatgtgccctatggcgcgaagctgctctaccaggaactcttcagcatggggatctgcctcaagtttgagacccaagtctgctagaacttgtagacctgcttgcatccagttattacatatgtacatacagctagcctatgaggatctccaagctggtgtgccggtgtgtgatgctggcatagtaaggatgggcgagctagaaaccctgttgtgtttatgtgctgttttctccctgctcatgtggtaaactatgctaaagtgaatgaacactcgtttcctgttccctctttgaatgcgctgtgttagcatgcccttttgtttgaagattgcgtcttttgtggagcaccttgtattgctccgtagggatcacaccccttaccgccggcgatggccgacgatttgagataagatataatatttctggtcgtccttgttaaagagttcatgcatatacagtacacaagaaatgtcgatcgaatatagctagtaaaacaacttcaagaaacatgtacatgcggttggatggatcctttctcatcgatgatttgtctgcattgattcatccaaatcaagatacaagaggcagcatgagatgatctgtctgtgtctgcattgatccaaatcaagacacaatagagggacagcatgaggacgaacagagacaaatccatcgccccgtgcttgagtttctccacgagctagtaagagatcagcaagatcctctctagctaactacctgagggaaacgaacagcaggggaggaccaagaagtgatgagtgggggaactccatgcgagccctctggcctctcctcccacaggctacatcttgaggacgaagaagaacagtcctcgatgcgtcttcacctagctgctgcttaatttacgagtgatgctcttcgatccaaaggtacttatactacaaatacccctccccctctctctctctgtctccatcgccccaatgcaaagccggtctttctatagctcatagctgctggaatttggacctggctttgaaacatgtcgtgcactcgcgttgggtttgaaagagatgacttgcgttgcagcgagcgagcgacacaggtcaggtcacactgcaggggggaagcgaagcacgagtgtacatgcattgaacctggacgccctctttagcttttgcgtttgggcatacagtatttttattttggccttctgggatttgggaatacgagtcatcgattccctcagtgtcgtcccgtcacagctttttttttccgttgcctttatgctgcatgcccattcagcagtcacgca

SEQ ID NO: 630 - DNA, 4130 bp, Zea mays
gtgatacttgataggctataagctgctagtgcttgtggaatggaagagccacagaaggacagtgggcaaccatcaaaaagttctgattctgagctagaagctatggtattggatgataatggagcgggaaaatcccatagtatggaggaaaacagggattctcctatagatgtcgatggtgggcagtcatctatggatgtggatatcaagggaaaatcatccctcagtgatgatgttaatggaaagtcttcttccgagccatattccaatgctccaattgacatgagtgtcgaaagcctagagaagttttgcaaagaagcgtcaaggtccttctttgatgaagttggtctgattagccatcagataaattcctacaatgagtttgtctcgcatgggctccaggagctttttgattcgcttggggaagtgattgttgaacctggctatgatccttcgaagaaaggatcaggtggctggaagcatgccatcatcaagtttgggagagtgaagcttgaaaagcctgtgttttggactggcaaggatgaaggttctgttgattttaaaccttggcatgctcgtctccagaatatgacatatgcttcaagacttatagtagaagtgactattcaggtttattctttggagaaaagtgacaaatctaaaacagggaatgatggttttgttcaaaaaaggaacttcatgaatgaaactcattggatatttattggcctccttccggttatggtcaaatcaaacttatgtttgctgcatagcctcaacgaaagtgagtgcctgttcgacgcaggtggatactttttggtcaagggaatggagaaggtattcattgctcaagagcaaagatgtctaaggaggctttggattagtgaccgaccttgctggactatctcttttatgtctgaaatcaagcgtagacgtatatatattaaactagttgaatctacaaggagtgaagatttcagtgagagcaaaatcattaccatttcctttttgtatgcgacaatgccagtttggttgttgttctttgcacttggaatatcatcagataaggaagtgtttgatatgatagatatgcaagattgtgatgcttctgttatcaacacgatatctgcaactatcaaagaatctgataaactgtgtgaagacttccgtaaatcagataaagctcgtcaatatgttgatgagttggtaaaaagttcgagatttcctccagcggagtcctttgatgactatattgctaggtttctctttcctgatattagtggaaatagaaacaaagcacttttcttagggtacatggttaaatgtctgctaatggcttttactgggaagcgtaaatgtgataataaggatgatttcaggaacaaaaggctggacctacctggtgaattgcttggaagggaacttagggcacagcttaggctggcagagaaacgcatggttaaggccatccaaagagatttgaatagtgaccgtgagttacaagatcttgaacgttatatagatgcatcaattgttactaatggtctaaatcgtgccttttccactggttcttggtgccatccgtacaaaagagctgaacgatgctcaggaattgttgcgactctaaggagaactaatcctcttcaaatgatgtctgacttgaggaaaacccggcagcgggttgcttacgctgggaaagctggtgatgcaagatatccgaatccatcctattggggaaagctatgctttatgtccactccggatggtgaaaactgtggacttgtaaaaaatctagctgttactgctattgttagctcaagggtgatgcagcccttgattgagagcttcatttcttgtggaatgagtaagctgaatgacattcctactgaacacattcaaagaatggataagatctttttgaatggcaattgggtgggatcttgtgaaaattcagcttcatttgtatttcgattgaggtgcatgagacgcagcagtctgattgatcctcaggttgaaattaaaagggacaagcaccacaatgaggttcgcgtgtttactgatgcagggcgaatcctcagaccccttcttgtggttgagaatctgaataaaatcagaaaacctaaggggcgctcattctctttccatgaattaatgcaacaagaaataattgagttcattggtgttgaagaggaggaagatatacaatgtgcgtggggaatcaggcatttgtttgagagtgaaggtgcgatatctagttatactcactgtgaactggatccttcctttcttctgggattaagctgtggtatcattccttttgcaaaccacaattttgctcggagggtattgtaccaatctgaaaaacactcgcaacaagctattgggtactcaacgacaaatccacacatcagagttgatactctttctcatcaactatattatcctcagaggcctcttttcaaaacagttatagccgactgtcttggcagatcagattatgcttcttttggaagaaaaaatgatttcgcgagaccagaatattttaatggacaaaatgcaattgtagcagtcaatgttcatcaggggtttaaccaagaggattccctggttatgaatagggcttctcttgaacgaggtatgtttaggactgaacacctcaggagctataaggcagatgtagaaaacaaggatggaaccaaacgactgaaattgaaggaaaaaatagactttggaaaaacagaaagcaaaagaggacgtgttgacaatcttgatgatgatggcttaccttacgttggtgcaagtcttcagaccaatgacattgttattggcaaagtctcagaatctggagaagaccacagtattaagctgaagcatacagaaaagggaatggttcagaaagtattgctttcagcaaatgatgaagggaagaattttgctgtggttactctaagacaggttcggacaccttgccttggagataagttttccagcatgcatggccaaaaaggtgttgttggttttctagaatctcaagagaacttcccatttactcacgaaggtatagtcccggatattgtgataaatccacatgccttcccaacacgtcaaactcccggacagctgcttgaagctgctctggggaagggaatagcttgcaaaggtacaatgagatatgcaacaccattcaccacagcatcagttgacgttattgcagaacagttgcacaggtaagtgtttcttctaacggatgaatagctgcttgccttaattcagtaacccaccccttgcacatgaaacgaagatctgagaccctttcaaagggttgggcattttttagcctcttctaggtgaactttgtaattgttaagcttattaatacatcttataagaaccttggacgtcattaatgcaccctatgctctcaagtcttaactctgttagtactttactgcttattacacatacagaagaagaaaagggaaaggtagggaaacaatgtacacagagagagagaacagaatggctggtggccatcctcatattttgtatatgagtaaacatgtatcagtaatttcacatgtatctttttgtcatattttgcaccaaaatggtggaaacacacgagtttccttcccgtttcccttttacttgtattactatcagttgctgcttatctaacggagacatccatattggtaccgctaaatataaaactgagtgcactcacacactactatgttctcagtgaggatcttacttcagataatcaagtgatgtatctgattttttttgtgtgtgtttagacttgttttcgtctgtgacttgtttagttaattttcaagattttatgtatcttgttgcattgcagggctggttattcacgatggggatctgagaacgttctaaatgggcgaacaggtgaaagagtgcaatccttggttttcatgggccctaccttttaccagaggctgattcatatgtccgaagataaggtgaaattccgtaacactgggccggtgcaccccctcacgaggcagcctgttgccgacaggaaaaggtttggtggagttaagtttggagaaatggagcgtgactgcctcctcgcccatgggtcagctgccaacctgcat

SEQ ID NO: 631 - DNA, 3951 bp, Zea mays
atggggaaaccacaaaccgatggtgaccagtcacctgtaaactcagatactgatgtgatggattgcctgaacttcgatggccatggagatgttgaagacccccacaaggaggttgcaaaaggggagcagcagccttctggcgaagttgatgaacagcagtctgttatggatgttgatttgacatgtataacatctgtgggagatgaagggaatgaaaagcagaatgctatggatgtggatttgaaagaaatactatctgaggaagatggaggggaaggaaaggcttcttcagatctaccctcacaagtaccagtggatttcaacgttgcaagcctcgagaagttctgtaaagaagcagcaagatcgtttttcagtgaaactggactggttagccatcagataaactcgtacgatcattttgtctcccatggactccaagagctctttgattctcttggggaaatcactgtggaacctgattatgacccttcaaataaacatggtgcttggaaacatgcaactgtcaaatttggtagggttaagcttgatgagccagtgtttatgcttgaaaattctgaccttgaagagcaagatctcaaatttaagcctagacatgctcgcctccagaagatgacatatgcgtctaggatgaatgtggaaatgactgttcaggtttatatattcgacacaagtgacaaagccaaaactggcaaggatacacatgttcataaaagagagataatgacagaaactaaacaaatcaacattggattgttacctgtaatggtgaagtcgaatttgtgctggctgcataaatctcaaaaaggtgactgcccgtttgattttggtggctactttttgatcaaaggaacagaaaaggtattcattgctgaagagcaaaggtttttatcaaggatttgggtcacagaccaccccagctgggatgcaagttacctatctcagatcagacgagaaaagatcaatataaaacttgttccgtccaaaagcaatgaaagctgcaaagtcataaacatttgcttcatgggtacgattatgccaatttgggtagcattttttgcacttggtgtatcgtcagacaaggaagcttttgatatgattgatatcctagactgtgatgctgacatagttaacataatatcattaactattaaagaatctcatgaagaatttgaaggcttccgcactccaggtagagcccgtcaatatgttgatgagctgatcagaaaatcaaagtttccgcccaaagaatcctttgatgagtatgtttgtaggtatatgtttcctggtgtcaatgggtttaggagcaaggcacttttcttgggttacatggtcaaatgtctgctaatggcatactctggcaatcgaaaatgtgataataaggatgatctccgtaacaaaaggctagatctttcctgccaattgcttcggagagaactctggactcatattaaaagagcagaaaggcgcatggttaagctcatgcagagagatttgagcaatgatggcaacttgcaagaccttaggcgttatgtggatgcatcaattattaccaatggattgaaccgggccttctccactggttcttggcggcatccttataaaaaagaaaggtgttcaggggttgtagcaacccttcggagaacaaatccacttcaaatgatgtctgatgttaggaagacgcgacagtggtttgcatatgctggaacggctggagatgcaagatacccgaatccatcctactggggaaaattgtgttttttgtccaccccggatgctgaaaaatgtggatttgtgaaaaaccttgctgttactgctgtggttagttctgtagtgaggaaaccgttgattgatacatttgtttcttgtggaatgaagaaactggatgatatttctctacaagatatttctgggaaggacaggattttcttgaatggaagcttgctaggagtatgtgcagacccacacgaattgactttgcgtttaagaagcttgaggcgtagcaagctaattgatcctcaggttgaaatcaaaagggacaagcaccataaagaagttcgtgtattttctgatccaggcagaattatgagaccacttcttgtagttgaaaatctaagaagaatcacaagaccaaaagatggactatactcttttcaggaacttatagatcaaaacatagttgagctgattggtgttgaagaagaggaggatatccaatgtgcgtacggaattagacatctattctccagcagggagaaagaagactggtcttcttctggctatactcattgtgaacttgatccttctttcttgctagggctgagctgcagtctcattccctttggcaaccatgataacgctaggagggttcagatgcaagctgaaaaaatatcacagcaggctatcggctactcccctacaaattctcagtacagactggacaccctttcacatcaaatgttctatccacaaagacccttgtttagaactgtggtgtcctacggtcttggagaggcgaagacagactgcagctccggacgaaaagacgacttcaacacaccagaatatttcaacggacaaaacgcgatagtctcagtgaacgttcatcagggattcaaccaagaagactctctggtgatgaatagggcctccttagagcgtggcatgtttcgcacgctacatttcaagagctacaaagcacaggtcgagaacaaagagatcacaaggcgtctcaagcacagggaaaacatcaatttcggtaaagtgcagagcaagagggggaaggtcgacagtctggacagtgatggcttaccatacgtcggagcaagtcttcagagtggtgacattgtcattggtaaggtcacggagtctggtgaagatcatagcgccaaactgatgcatactgagaaagggatggtggacaaggttgttctttcggcgaacgatgatggggttaactttgcaactgttactctaagacagtctcgctcgccatgcgtcggagacaagtttgccagcatgcatggacagaaaggagttgttggcctgttggattctcaggagaatttcccattcacttcccaagggattgttccagacatggtcataaacccacatggttttccaactcgtcaaactcctggacagctgcttgaggctgctctggggaagggcatcgcccttggtgggaaggtcaggtacgcaacgccgttcaccactccgaccgtggaggtgatcgccgaacagctgcacaaggccgggttttgcaggtggggtgaggagagcgtgctgaacgggcagaccggcgagcggatgaagtcgctggtgttcatggggccgaccttctaccagcggctggtccacatggcggaggacaaggtgaagttccggaacacgggtccggtgcacccgctcacgcggcagccggtggaggacaagaagcggttcggcggcgtcaagttcggggagatggagcgcgactgcatgctggcgcacggcgccgccgccaacctccacgagcggctcttcaccctcagcgacttctcgcggatgcacatctgccaggcctgcgagcgggtggccaacgtcatcgtgcgggccgccgagggcggcggcggcaagaaggtgcgcgggccctactgcttgttctgccgctccgcggagcgcgtcgtccgggtcgacgtgccgtacggctccaagctgctgtaccaggagctcttcagcatgggcatctgcctcaagtttgaaaccgaggtccgctagaacgaacgccatggcagttcaccagtgagactccctcgatgcatatgcaagtatgcaactgcactgcctaggatcttggtgctttatgggctggtgttgaaacctgcagttttggcggcacgattttctgggcatgcattcagtagcaggcactggttgatactgtgattc

SEQ ID NO: 632 - DNA, 1536 bp, Zea mays
ccttgatccccgctaaggtactcaccatgaaaagccgtatctgtctcggcggacaggacccgctcgtcactgagaccgggacccgcagagcattgcttgaccgctggcccgcctccgcctgttagaaccaccgggcatcgtcgacgccgccggttgcccattaaacccccgtccccgtctcgaggtgatcatcccgcagcgctacaacgcccgaactctccgtccctcactctcagtctccgacacattctacgaaccgcctcccactaccgctcattgccgccggtcgccggagacgcgctgcaccgccagctgtccgccttcgcccgccgaccccggcctgccgcagcttccccttcacccgccagggtataagctgccagtgcttgtgtcatggaagagctacagaaagacagtgcgctaccatcaaatagctctgattctgagccagaagctatggaattggatgacaatggagcaggaaaatcccatagcatcgagggaaacagggattctcctatagacactgatgaaggccagccatctatggatgttgatattaagggaaaatcatctctcaacgatgatgttaatggaaagtcttcttctgagccattttccaatcctccaatcaacatgagtgtggaaagcctagagaagttttgcaaagaagcgtcgaggtccttctttgatgaagttggtctgattagccatcagataaattcctacaatgagtttgtctcgcatgggctccaggagctttttgattcgctgggtgaagtgattgttgaacctggctatgatccttcaaagaaaggatcaggtagctggaagcatgcaatcatcaagtttgggagagtgaagcttgaaaagcctgtgttttggactggcaaagatgaggtttctgttgattttaaaccttggcatgctcgtctccagaatatgacatatgcttcaagacttagagtagaagtgactattcaggtttattctttggagaaaagtgacaaatctaaaacagggaatgatggttttgttcaaaaaaggaacttcatgaatgaaactcactggatatttattggcctccttccagttatggtgaaatcaaacttatgtttgttgcatagtcttaaggaaagtgagtgcctgtttgatgcaggtggatactttttggtcaagggaatggagaaggtataactctgtgttctctgttgttaatgtattagtatgtaggaactttcaagtgtccttttgttgctggcatgggactatagctttcttagaacccattcagaaaacatgtacatgctcataagaggggggggggtccaaatatgattgtagctatgtaaaataggattctattgtatcgaaggatactttggcacagcatccgtttgagttggtctcctggtgccatatgccgcttcttgtgtttaaactatatataggtctaaatgccgaagtaccgatatgtgtatcagtattggaaggatatggatgcacggatacagcagtttttcaaaaaaaaaaaaa

SEQ ID NO: 633 - DNA, 3318 bp, Zea mays
gtaaaagtgatctaggtctcccgcgccgccgccgccgccgcctaagctgcttccacctccgctttctgtgcagaggactcctcgccggagaatagccggcggcggctcgagacgaaactacggtgctcgtctcccgccgcccgccgcccttcactccccagcatacctagtccctactctaatccgtacagagcaacgcatcaagtgatggcgaagccggaggagaagctgcgctgcaccaaggaacccttcatcgaggacgtcggcacccggaggataaagagcatccggttcagcgtgctctcgggcagcgagattcgcaagtcagcggaggtacaggtctggaacaaccggatctatgaccgcgacatgacgccggttcccaatgggttgctcgacccgcgaatgggaatcccgactaagagaggcaaatgcaatacctgccatggtgaatttagtgactgtccaggtcatttcggctacttgaagctcgcgcttccagtttttaacgtgggcttctttaactgtattctggacgtgttgaagtgcatctgcaagagctgtagtagagttcttcttatcgagaaagaccgcagggagtttctaaagaagatgagaaatcccagggcagatgcactacagaaaagtgctacaatgaaaaaagtgagggacaaatgcaaactatcctgctgcccccgttgtgattacagaaatggtgtagttaaaaaaggcagagcgggcttgatagtagttcatgattgtagcaaagttttggatggacatacagaagaattgaagaatgcactacaaaataagaaagaaaaggtgtctgctagttcagttctagtgttagaccctgcaactgttctatctctattcagaagaatgattgatgaggattgtgaattactaaaccttggtgataggccagagaaacttattgtgacagagattgcagtgccacctgttcctatacggccttctgttgttgttggtaatagtagaacaagcaacgaagacagcattacagttattttgaagagcattgttaatacaaactccatccttaaggagacccttcatactgggggtccattcaccaagtgctttgattgctggcaataccttcaacttcaagttgttgaatatgtgaatagtgatgccccttctcttcctgagtcacaacatcggggccttgttcaacgactcaaagggaagactggacgatttcgtggcaatttgtccggaaaacgtactgagtacacaggaagaaccgtcatatctcctgatccaaatttgaaaataacagaggtggctattcctgtgttgatggctcgagtcttgacttatcctgaaagggtttcaaactataacattgagaagctgagacaatgtatacgaaatggaccattcaaatatccaggggctaattttgttacacaacctgatggcatgaagcagagcttaaagtatggtgatagaaggattactgctcgggatttaaagtgtggatgtatagttgaaagacatttagaagatggagatgttgtcctctttaatagacagccgagcctgcatagaatgtcaattatgtgtcacagggcaaggataatgccatggagaacactcagatttaatgagtctgtttgcaacccttacaatgctgattttgacggagatgaaatgaatttgcatgtccctcagacagaggaagctcgcactgaagcgcttatgctcatgggggttcagaataatttatgtactcctaagaatggtgagatactggttgcttccacgcaagacttcttgacctcatctttcctagttacaagaaaagatactttctatgatagatcttcctttactcttttgtgctcataccttggtgatggaatggagaacattgatttgccaacaccagccttgattaaacctgttgagctttggactggtaaacaactatttagtgtgttagtccgacctaatgcgcacacaaaggtgtttctgaatcttgctgttcaagaaaaaatttattcaaagaaaaagggaaaaaaagaggggggagaggaggtaaaggaaacaatgtgtggaagggaaacaatgtgtcccaatgatggttatgtttatttccgaaatagtgaactgttatctggacaagtagggaaggccactttaggtaatgggaacaaggatggcctttactctgttcttttaagagattataattctcatgctgcagcaagctgtatgaatcgtttggcaaaatttagtgcaagatttatagggaaccatggtttttccattggtgtggacgatgtccaaccaggagaacatctaaatcggcaaaagaaaaaggaaatagacggagggtacaaaaaatgccatgatcttatttctttgtttgcgaaaggcgcgctcgcattgcatcctggttgcaacgcagcccaaacgctggagcataacatcactggtgtgttaaatgaaatcagatcaattgctggaaatgtgtgcatggatacgcttcactggaggaacagcccattgattatgtctcagtgtggttccaaaggttctccaatcaatatcagtcagatggttgcatgtgttggacagcaatcagttggagggcgtcgtgccccagatggttttctaaacagaactcttcctcactttcctataaattcaaagacccctgcagctaaaggttttgttgctaattcattctatactggtttgactgctactgagtttttcttccacacaatgggtggacgagaaggtcttgttgacacggcggtcaaaacagcagaaactggatatatgtcccgcagattgatgaaaggcttggaagatctctcagttttctatgatcagacagttcgaaatgctagcggtggtatagttcaatttttgtatggagatgatggcatggatcctgcaaagatggaaggaaaagatggcatgcccttaaatttggatcaattgtttatgaaagtcatggccacatgtcctcaaaggggatcagatacattatctccagtgggcatcaaacagatgttagaggataagttcttgcagcatgacacctcatctgatggtggctgtagtgcagagttcaagaaaaacttaactgaattccttgataaacgtatagaattaatgaaatgcacaagaagggcactccatctacatgaggatcatgtagaaaagaaagattcttgcctagaagaatctattgctgctattatatctggtatatctgcaaaacaacttcaggtgcgtgtttataatcttttgtaaccctttctattatcaaag

SEQ ID NO: 634 - DNA, 5107 bp, Zea mays
atggagctacatcgtgaacctcctgaagctattctgaatgccataaaatttgatctcatgacgagtacggatatggaaaaattgagcagcatgagcataatcgaagtgagtgatgtcactagtccgaagctaggattaccaaatggttccctgcagtgtgagacttgtggatcacaacgtggacgcgactgtgatgggcattttggtgtgactaaactggcggcaacagtacacaatccatacttcatcgatgacgttgttcactttctaaaccgaatatgtcctggctgtctcagcccaagggaaggcatagatacaaagagattggagagagaaaaggttcaagcaacatgcaagtattgttcgaaggatggctctaaactttaccctagcatagtctttaagacactgtcaagtccaagagtattattattcaagagtaaacttcacagaaacgccagcgtgatggaaagaatttcgattgttgcagaagctgctgacagaatgcctaatagatcaaagggtaaaggttcgcttgaaggcctgcccctggatttttgggattttgtaccttctgagaataaacaagtccagtcaaatatgaccaagataatattgtcgccctaccaagtcttctacatgttgaagaaaagtgaccctgaacttatcaaacaatttgtttcaaggcgggagctattgtttctatcatgtttaccagtaactcctaattgccatcgtgttgtagaaattggatatgggcttccagatggacgcctaacatttgatgacagaacaaaggcttacaagaggatggttgatgtcagtaggagaattgatgactaccgccagcatccacatttcagtgttcttgcaagttcacttgtctcaagccgggtttcagaatgcctaaagtcatccaagttgtactctaaaaaggcagatggagagacatccacagatacatatggaatgaaatggctaaaggatgttgttctcagcaaaagatcagataatgtttttaggagtattatggttggagacccaaaaattaagttatgggaaattggcattcctgaagatttatcctcaagcctggttgtttctgagcacgtcagttcttataattttcaaagtacaaatctgaagtgcaacctgcaccttctagccaagcaagaactatttattcggcgaaatggaaagctaatgtttcttcggaaggcagaccagctagaaataggtgacattgcctatagaccattgcaggatggtgatattattctcatcaacaggcctccttcagttcatcaacattcattgattgcattatctgcaaaaattctaccaattcactctgtcgtatcaatcaatccactatgctgtacaccttttgcaggagattttgatggtgattgtttgcatggatatatcccacaatctatacgctcaagggttgaacttgaagagctggtaagcttacacaaccagctgttgaatatgcaagacggtcgaaatttggtgtcactaacacatgactctctagctgctgcacatttgttaacaagtacagatgtttttctgaagaaatctgaattacagcagcttcaaatgctatgcctttcagtatcaacaccagcacccgcagttattaaatctatgaattttcaaggttctctgtggactggtaaacaacttttcagcatgcttcttccttcaggcatgaatttcagttgcgatacggagttacatatcatggacagtgaggtgcttacctgctcactgggttcttcttggctacaaaataacacatctggtcttttctctgtcatgttcaaacagtatggttgcaaggcacttgacttcctttcttcagcacaagaagtactatgtgagttcttaaccatgaggggtttaagtgtctctctttcagatctctacatgttctcagaccattactcaaggagaaaactagctgagggagttaagttggcactgtatgaagctgaagaagcttttcgagtcaagaaaatattgttagatccaattaacataccagttctgaagtgtcacgatgaaactgaagatgtaacttacagacaatctgattgtatccagagcaatccatcagttatcagatcttcaatcatggcatttaaagacgtcttccgtgatctcttaaaaatggtgcaacaacatgttagtaatgataactcaatgatggtgatgataaatgcaggaagcaagggtagcatgttgaaatatgctcaacaaactgcatgtattggtcttcaacttccagctagcaaatttcccttcagaattccttcccaactctcatgtattagctggaatggacagaaatcgttgaactatgaagctgagagtactagtgaacgtgtgggaggtcaaaacctttatgctgtgataaagaattccttcattgagggtttgaatccattggaatgtcttctgcacgctatatctggcagggcaaacttctttagtgaaaatgctgatgtaccagggacattgacaagaaaattaatgtatcacttgagagatatacatgttgcctatgatggaactgttagaagttcttatgggcagcaaatagtgcaattctcttatgatagtgttgatgacctagtagataaactcggcgccccggttggatgtcgggctgcttgttccatttcagaagctgcatatggagctttggaacacccggtcaatggtttagaggactcccctctcatgaatctacaagaagtatttaagtgtcacaaggctacaaattcaggggatcatattggtttgcttttcctgtcaaggcatttgaagaagtacagatacggtctggaatatgcatccctagaagttaaaaaccatcttgagcgagtgaacttctctgatttggttgaaaccatcatgattatatacgatggacatgacaaaataagaaacgaaggaatgtggaccacccattttcatataaacaaggcaatgatgaagaaaaaaagattaggattgagatttgttgtagatgaacttgcaaaagagtatgacaccaccagagatcagctaaacaacgcaatcccatcaattcgtatctcaaggagaaaatgtttagtaggtgacgagggtgttaaaagttcatcatgctgtatcgctgtcgtagcacatgctgaacgcaactccatctctcagttggacactatcaagacaagggtgattccaagcatactggatacactgctgaaaggttttttggaatttaaggatgttgagatccagtgtccacatgatggtgaacttcttgttaaagtttgtatgtctgagcattgtaaaggggggaggttctggcctactctacaaaatgcttgcattccagtaatggagttgattgactgggagctgagtcaaccaagcaatgtatctgatattttctgttcatatggcatagactcagcatggaaatactttgttgaatccttgaaatcagcgactactgatactgggaggaacattcgccgggagcacttgctggttattgcagatagcttgtctgtaactgggcagttccatgcattaagcagtcaaggtttaaagcagcagcgcactcggttatcgatctcgtctccattttctgaagcatgtttttctaggcctgcacaaagttttataaatgctgcaaagcaatgttcagtggacaatctgtgtggaagtctcgatgcagttgcttggggcaaagagcctttcaatgggacgtcagggccttttgaaattatgcactcgggaaagccacatgaaccagaacaaaatgagagcatctatgatttcctatgcagctctaaagttcggaattttgaaaagaatcatttggatacccgtagacaaagtactgaaaatgcttcgatatgtagattagcatgcaagtcttctaaaggcagtacgaccgtcaatggtgttgctataactatcgaccaggactttcttcatgctaaagtcagtatatgggataacattatcgatatgcgtacttccttacaaaacatgctaagagagtacccgttaaatggatatgtggcggagccagataaatcacagttaatcgaggccctgaaatttcattccagaggtgctgaaaagatcggtgtgggagtaagagaaattaagatcgggttgaatcctagtcacccaggtacaaggtgcttcattttgctgagaaacgatgataccactgaagacttttcttaccacaagtgtgttcagggtgctgcagactctatctcaccccagctcggaagttatttgaagaaactatattacagagcataagcttatgcaacactcccactagttcatttttttaactaaaacgtggcaaataaaaaagaacggatggagtaggattttggaaagtgttcctggcaacatcttgttctgatcagaccatattaccaatttctgataaggaaactacgtgtcgcattttaaggatgaggtgaaaactgaaagggtctggcgctcagaactcagaaggtcttctggactggaggtgtatgtcaactcaactcaatgggactatgtaaggtgggcctgagtcatgactgcggtttcatgcctgcaattctctagtcagtagtataaatactagtctgcgtgttttctaatatgaagatccatctattttattacttaaccatagcgtagatgattggtaacagatagatacattttatttactgattaaaatgcagcagcgactccccgaacttaaaacaggtaaacgggtgtggaaacttagtggctcattcaaaactgtctaaaatcgggtttgctcaaacaaagtgtcgacatggcatgtcatgttgaaatcatttgagtctctaaatttggtttacagacttttattagtgtgcttcaatcgtagcacaccaaatcagtattcggtttgagcatccgatttctgatggttttgcacaggccggccaagttatatgatctagttttttaacttaggggatctaattgatacaacatgccaagtttaagaatggctattgtatcttactcttatttattgaacaagtaatgcacattcccagtc

SEQ ID NO: 635 - DNA, 5107 bp, Zea mays; identical to SEQ ID NO: 634

SEQ ID NO: 636 - DNA, 2691 bp, Zea mays
atggacaacacccatcatctctggcccgcagaagctcatggcgcagctggtggagaatcccatcctgatcacgcactgcagccagctccacgacaacccatccctgggcctgcccctgcaggtcggcggcagctgcgagtcctactgctgcagcgccacgcagctcgacaattgcgaagggcatttcggcttcatcaagctgccggtgcccatctaccaccccagtcacatcaccgagctgggaagatactcaacctcgtctgcctccgcctcaagaaacccaagcagaaggacaccgggaaagaatgcagattcacctcatgttcatattgccagcacattcctgatgtgaaaaaagtacaatctggatccctactttgcttgaacaatgaaatagtgctgctcttacaaaccccagcattcctcttgttccaggacctcccaccgctatgcgtcagtcaagtgaagaaattcaacggtgcccgtagcttggaactgaaagcaccattaaagcaagaggttgccgtcaggttttggagcttccttgatcaatttggcttccacacaagtggtacatctcaccgccgccccttacatccaaaagaggatggatatgtgatggataacatgtccgtcccacccaattgcctgcacgtttcaaatattttagatgacaacacagaaatgtgccctcccgatacaccaaaaggcttgttgaggaaaattctacgcacgatagaacaaatcaaaagcttaaatatcagccaaacacgtgagttaggggcagatgatcttcaggtagctgtaggagattacatggatatgggaggaccagcagaggttttccagcatgtcacctttacaagacagcctgcaccaaaacagtggcataaaaagatgaaggccctcttccttagtaagagttcaagctactcatgccgtgcagtgatcactggtgatccatacattggccttgatgtagtaggggtgcctgatgaagtagctagaagaatgacagtacaagaatgtgtcacaaactacaacattgctcggctgcaagacatgatggagaaaggactatgcctaacatacactgatctcaataccaacacatatgacttggatggaaagaaaggaaacaagaagtgcatcatgccgagggttggtgaaactgtagagcgaagagtccttgacggggatctcgtcttcctgaatagaccaccaagcactgacatgcactcagttcaagccttatatgtccatgtccatgatgaccacaccataaagatcaaccctctcatctgtggcccacttggagcagattttgatggcgattgtgttcacatcttttccccaagatcagttccaggaagggttgaagctgcagagctcttcactgtggagaaacaactgttaaactcccacaatgcgaagctgaactttcagatcaagaatgattacctactagctctgaagataatgtgtgtcaggtcgtattctagagaaaaggcaagccaaattgccatgttctcgtcagggatgattctaccgggtgattggactattcctcagattctacagactaccgatgcattaagaaccctaccaagccacccaaacaaacaatctgttggagcctcagttactgccatcatctcatcaactctttcagaaaaaggtccaaggggggccataaagctcataaatcttctgcagcccctcctaatggaatcactgcttatggatggtttcagcataagcttgaaaggtcttgatggccggtgtgcaatgcagaaggcaaatcaaagtagttcgcttgagaccgataagttcaacaagttaactgtggactccattgttaattcctctgcccttggtctgctggttgacccaaaaaaagattcaactctgaagaaattagttgaacagattggtttcttgggacaacaactgcaaaggactggtaggttatactctagcaacttagtggaggactgctacaactttctggaaaggtgcagcggaagcaccaaatgttatgatccttcaaaaggacatgattttgttacgagttcattttacaatggtttaaatccatatgaggaattactccactcaatatcagtaagggaaaagatagagcgctcatcatctaaaggactggctgaatctggcaatctttttaagaacatgatggcaatgctccgagatgtcacagtatgctatgacggaaccatgagaacttcgtgcagcaactcaattgtacaatttgactcgacaaatgtatcaagttctgtgacaccaggtgatccagttggtatcttggcagccactgcatttgtaaatgctgcatacaaggcagtgttagatccagtttttggacattccgtcgagcacccgccgggcgcacaaaatcctcgcatgattgcctcgcgtaggcaaggtcacatgaatgtggcatccttgggcgcgctccagttgcgcttggggagcgcggcgccgcctagctcggcgatggccgccttcagctccggaaactccggccggagcgggtggccggcatcggggtcgaagacgtcttcgtcgctggagccgaagaagaagtcggagttgaccggaggtcatcgcggggaggaggaacgggagcagctcctcgtcagggaaaatttccctgcagccgaatatgtatag

SEQ ID NO: 637 - DNA, 1665 bp, Zea mays
atgcggacactgtttatcagcaaagggtcaggtttttcatctcgcagcgttctgacaggagatccatatattgggctaggtgttgtagggcttccttctgaagttgcaaagagaatgacattcgaagagcaggtaactgacataaacattaacagattgcaagacgtggtagacaagggactctgtttgacctacagagatggtcaagctacatatgccatcactgttggatcaaaagggtacacaacacttaaagttggtcagactatcagtcggaggatagttgatggggatgttgtgtttcttaacaggccacccagcacacataagcattctctccaagctttctacgcatatgtgcatgatgaccatacagtcaaaatcaatcctctcatgtgtggccccttttctgctgactttgacggggattgcgtacacatatattatccacaatcgcttgctgcaaaagctgaagccttggagctttttagtgttgagaggcaactcattagttcgcacagtgggaaggttaatctccagctaggtaacgactccttggtagctatgaaggctatgtctcatacaaccatgttacacaaggaattagcaaaccagttggcaatgtttgtgccattttcacttcttgctcctgctgtaatcaagccagttccatcttggacaatatcacagatagtgcaaggtgcatttccagctaacctgacttgccaaggggacacacacttggttagggacagcacaatcataaggctggaccttggcaaagaatctgttcaggactcattccctgatttggtgtcctccatccttcgtgagaagggtccaaaagaagctctgcaatttctgaatgtgttggagccattgttgatggagtttttacttcttgacggtttgagtataagtctgcgggattttaatgttcccaaggctttattggaggaagcacaaaaggacattcgaaatcagtcccttattcttgagcagtctaggtgctctacaagtcaattcgtagaattccgagtcgaaaacaatttgaaaaatgtcaaacagcagatttcagattctgttgggaaattctctgaccttggtctgctgattgatccgaaaaaggaagcctcaatgtcaaaagtagttcaacaagttggttttgttggcttgcaactgtatcgtgaaggcaagttgtattcaagacgcttggtagaggactgcttcacaaactttgttaataaacacttggccattggagatgagtatcctccagaagcgtatggtcttgtccaaagttcatattttcatggtctcaatccttatgaagagttgatacatgctatatccactagagaagctatgatccgctcctctagaggtctgtcagaacctggaactttgttcaagaatttaatggccatcttgagggatgtagttatatgttatgatggaactgtgagaaacatttgtagcaattctatcattcaacttaagtatggggaagatgatgaaactgattcttcaagtgttgtacctcctggtgaacctgtgggtgtcttagccgccacagctatctcgaaccctgcatacaaggctgtcttggattcctcccaaagtaacaatgcttcatgggagtcaatgaaggtagtaatgttataa

SEQ ID NO: 638 - DNA, 6143 bp, Zea mays
tctttccccagaggcaccctcaatcccctttcccctcctccctccagactctcggaggcgggcgcgcggatctgtcggccggggccgatccagtcgattccaccggacaaggccgccaaaaacacactcgctcgacgcagcgagcggggccggcccttcgtgccgcggggcgcccggtggcgagggccgcagcgcgcagcgatctgaaaccctaggtggtggtgggcgccgccgccgtgtgtagacgcgatggatgcgaggttcccgtactcgccggccgaggtggccaaggtcgagttcgtgcagttcggcatcctcagccccgacgagatcagacaaatgtcggtgattcaaatagaacacgcagagaccatggagaggggcaaaccgaagcctggtgggctcagtgaccctcgattggggactatcgaccggaaaattaagtgcgagacatgcatggcagggatggcagagtgtccaggccactttgggcaccttgagcttgccaagccgatgttccacatcggattcattaagactgtgctctccatcatgcgttgtgtttgctttaactgctccaagatcctcgcggatgaggatgaaaccaaatttaagcaggctttaaaaatccggaatccaaagaatagattgaagaggatatatgatgcttgcaagagcaaaaaagtctgtgcaggtggcgatgaccttgatgttcaggaacaggatactgatgagcctattaagaaaagaggtggctgtggtgctcagcagccaaatattacagtcgatggcatgaagatggttgctgagtttaaagctccaaagaagaaaactgatgatcaggatcaactccctgagccagtggaacgcaagcaaatcctctcagctgagagggtccttaatgttcttaagcgtataagtgatgaggactgtcttctgttgggcctgaatcccaaatatgcccgtcctgattggatgatacttcaagttcttcctgttcctccaccccctgttagaccatctgtcatgatggacacctcttccagaagtgaggatgatctgactcatcagttagctatgataatacgacataatgagaatttgaggaggcaagagagaaatggtgctccagctcacattataacagagtttgctcagctgttgcaatttcatattgcaacatacttcgataatgatcttcctggccaacccagggccacacaacgttctggaaggcctattaaatcaatttgcagcaggctgaaagctaaagaaggcaggattagaggaaacttgatgggcaagcgtgttgatttctcggcccgtacagttatcacaccagatccgaacataaacattgatgaattgggagtaccatggagtattgctttgaacctgacatatcctgaaactgtcactccatataatattgagaggttgaaggaacttgttgaatatgggcctcaccctcctccaggaaagaccggtgcaaaatatattatcagggaagatggtcagaggcttgatcttcggtatgtgaagaaaagcagtgatcagcatctggagcttggttacaaggtggagaggcatctcaatgatggggattttgttcttttcaatcggcaaccaagtcttcataaaatgtctatcatggggcatcgcatcaaaattatgccctactcaactttccggttgaacttgtctgtcacttcaccatacaatgctgacttcgacggtgatgagatgaatatgcatgtcccccagtcatttgagaccagagcagaagttctggagttaatgatggtgccaaaatgcattgtctctccacaatcaaataggcctgtaatgggtattgtccaagacacactgcttgggtgtcgcaaaattactaaaagggacactctaattgaaaaggatgtatttatgaacatcttgatgtggtggcaagatttcgatggaaagattcctgcacctaccattttgaaacctaggcctatttggactgggaaacaagtttttaacttaattatccccaagcaaataaatttaattcggttttcagcatggcattcggaagaagaaaaaggatttattactcccggtgatactatggtcaggatagagaagggagagcttctgtctggcacactttgcaaaaagagtcttggaacaggctccggaagtcttatccatgtcatttgggaagaggttggtccagatgctgcccggaagttcttaggacacacacagtggcttgtaaactactggcttcttcaaaatggtttcagtattggaattggggatactattgcagatgcatccaccatggaaacaattaatgatacaatatctaaagctaagaatgctgtgaaggagcttattaaaaaagctcatgagaagcagttggaagctgagccaggacgcactatgatggaatcatttgaaaacagagtgaaccaggttcttaacaaagcccgtgatgatgctggtagcagtgctcagaatagcttgtctgaaagcaacaatttgaaggctatggtcactgcaggttcaaaaggcagtttcattaacatttcacaaatgactgcttgtgtgggacagcagaatgttgagggcaagcggatcccttttggtttcattgatcggacgttgccacatttcacaaaagatgactatggtcctgaaagtcgtggatttgtggaaaattcttacctccgaggtctgacaccgcaagaatttttctttcacgctatgggtggtagggaaggtcttatagacactgctgtgaaaacctctgagactgggtatatccagaggagacttgtgaaagctatggaggacatcatggttaaatatgatggtactgtaagaaattctcttggagatgtcatccagttcttgtatggagaagatggcatggatgctgtttggattgaatctcaaaaattggactcattgaagatgaagaagcctgagttcgataatgtattccgttatgagctggatgatgagaattggagacctaactacatgctacctgaacatgttgacgatttgaagaccatacgtgaattcagaaatgtgttcgaggcagaggttcaaaagctagaagctgatcggtaccagcttgggtctgagatcaccacaactggtgacaattcgtggcctatgcctgtgaacctcaagcgactcatctggaatgctcagaagacattcaagattgattttagaagaccttctgacatgcacccgatggaaattgtggaagcgatagataaactgcaagaaagacttaaggttgtacctggtgatgatgctatgagcattgaggcccagaagaatgcaaccttgttctttaatatcctacttcgtagcacgtttgctagcaagagggtcttgaaggaatacaggcttacaaaggaagcttttgaatgggttattggtgagattgaatcgaggtttcttcagtctttggtggcccctggcgagatgattggatgtgtggctgcacaatctattggagaaccagcaactcagatgaccctgaataccttccattatgctggtgtcagtgccaagaatgtcacccttggagttcccaggttgagggagatcattaatgttgccaagaagataaagacaccatctttgtctgtttacctgaagcctcaggtgaaccagaagaaagaattggctaagaatgtccagtgtgctttggagtacactacactgcgtagtgttacccacgccacagagatatggtatgatcctgatcctctagggaccatcattgaagaggacacagagtttgttcagtcctattatgaaatgcctgatgaggacattgacccggataaaatttctccttggttgctgcgtattgagcttaaccgtgagatgatggttgataagaagttgagcatggctgatattgccgagaagattaaccgtgagtttgatgatgatttatcatgcattttcaatgatgataatgcggataagcttatcctccgtatccgcatcacaaatgatgaagctccaaaaggagaaatacaagatgagtctgctgaggatgatgtcttcctaaaaaagatagagggcaatatgttgacagagatggcgcttcgaggcattccagatatcaacaaagtgttcatcaaagaagggaaggtcaataccttctatcaagatgacggtttcaaagcagctaatgaatggatgcttgatacagaaggtgtgaatcttttagctgtcatgtgtcacgaggatgttgatgctacaaggacaacaagtaaccatctgattgaagtgattgaggtacttggaattgaggctgtccgtcgatctctcttggatgagcttcgggtggtgatatctttcgatgggtcatatgtgaactaccggcatctggccattctttgtgatacaatgacatacagaggtcacttgatggctattacaaggcatggtatcaaccgcaacgacactggacctcttatgagatgttcctttgaagagactgttgacatcttacttgatgctgctgtatatgctgaatctgaccacctgagaggtgttactgaaaacataatgcttggtcagcttgctcctattggtactggaggctgtgcactatatctgaatgaccagatgttgcagcaagcaattgaacttcaactcccaagctatgtcgaaggcctagactttggcatgactccagcacgatcacccatcactgggacaccttaccatgaaggaatgatgtcgccaagttatctgctgagtccaaacatcagggcttcgcctattaatacagatgcttcgttctcgccgtatgttgggcacatggcattctcaccattcccttcaccaggtggttactccccatcgtcagggggatacagcccatcttctccggttttcaccccagagaaaggatatagccctctctctccatcatatagccctgcatcaccaagctatagtcccacctcaccgtcttacactcctggctctcccacctacagtccaacaagcccgaattactccccaaccagcccgacgtactcgcctaccagcccatcgtactcacccacatctccgagctacagcccaacatcaccaagctacagccctacatcaccaagctacagccctacatctcctagctatagtcctacatcaccaagctacagccccacctcaccagtttatagcccaacctcaccagcatacagccccacatcacccgcttacagccccacatcgccatcctacagtccaacttcaccatcttatagccctacatcaccttcatacagccctacgtccccttcatacagccctacctccccctcatacagccctacctctccctcctacagcccgacatcacctgcttacagcccgacatcaccaggatacagcccaacgtcaccgagctacagccctacatctccgagctacagtcctacatctccgagctacaatccttcatcagccaagtacagcccttcacatgcatactctccaagcagccccaggatgagtccatacagccagacttctccaagctacagtccaacgtcaccgacttactctcctacatcaccatcatattcacaaccaagtccatcgtacagcccaacgagcccgttcaacacctctggaggacccagcccagactacagcccgacctctccaaattacagccctagcggaagctactcccccactgcaccgggctactccccgtcgtccacaggccagggtaatgacaaggatgataagagcgctcgttgaagaggcacaggagaacaaggcgctctagagcactcgatgaaggcactcggtgatggccacatgggaagatcgaggcacttttttttcccttgagtttttgtatggttgatgaactctgagagcaaacttgtatttttccgagctgctaatagcagaaatagttgtttatgtatgatactagaactaaggactggactgtgctgcgacttgataagtggttaaccgcgtggtcgcccctcagagagtaacacatgtagtaatgtttaatgataatatcgtgactgtacttggtactactatgctatggtgtactagtgtattgcatgcgcgcgtggagcaga

SEQ ID NO: 639 - DNA, 5028 bp, Zea mays
cttttcagtactgttattttaacttttgttcccctatataggcatatatctgattgatatgctgaccaatgatttttcaggaacaagaagatgcagagcaaagccacaaaagaaggaagaggaatccacagaaaacaacaagctggagaatggatctctggatgcaacagaagaggtgcatcatggagtcgaaaaaggtgatggacatgttacccgcaagagaccaaggagatcagcggcctgttctgatttcaaagagaaatccatacgcttatccgaaaaaaaatctgttgtcatggtcaagaagaatcggatggaggaggaagaagtagatgctgtcaatctgacaaaacttggaccagaagatccaccaccttgccggaagttgatcgattttatcttgcatgatgcagaagggaacccacaaccctttgaaatgtcagaaattgatgacttctttataacagctcttatcatgcccatggatgatgatctagaaaaagagcgtgaaagaggagtacgctgtgaaggatttgggcgaattgaggactggaatatttctggttatgatgaaggtactcctgtaatctgggtgtcaactgatgttgctgactatgaatgtgtgaaaccatcaaccaattacaaatcttattttgaccacttctatgagaaggctcaggtgtgtgttgaagttttcaaaaagcttgcaaaatcagttggtgggaatcctaaccagggcctggatgaattgcttgctagtgttgttcggtcaaccaatgccatgaaaggatatagtggaaccatgagcaaagatttggtgatatccattggagaatttgtatacaatcaacttgttggtttggatgagacatcaaacaatgatgatgaaaagtttgctaccctgccagttcttctttctctaagagaccagtgcagatctagggtggaactgaccaagttgccctctaacttctcgaacacaagtctgaaaattaaggactcagagtgtgatgagacagcagaagacgatgatgatgcaaaattagctagattacttcaacaagaagaagaatggaaaatgatgaagaaacagaggggtaggcgtggaacaccatcccagaaaaatgtctacataaaaatcagtgaagctgagattgccaatgactatccccttcctgcatactataagccatttagccaggaaatggatgaatacatatttgatagtgatgacagcatattttctgatgatgtgccagttaggatactcaataactggacactgtacaatgcagattccaggcttatatctttggaattgatccctatgaaatcaggggcagaaaatgatgtggttatctttggatctggtttcatgagagatgatgatggcagttgctgttctacagctgagtctgtgaaatcttcgtcttcctccagcaaagctgaccaactggatgcaggaatccctatttatttgagcccaatcaaagaatggattatagagtttggtggctcaatgatttgtataaccattcggactgatgtggcctggtacaagctacgccaaccaacaaaacaatatgctccatggtgtgagcctgtactgaaaacagcaaggcttgctgttagcatcattaccctgttgaaagagcagagtcgtgcctcaaagctttcttttgctgatgtcataagaaaagtagctgaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcgtgcaacaacaaccaggctcatcaacagaatctggagtgattactatgcacatcatttccctgaagattccaaggagggagatggaaatgaaacaaaagaaattgatgatgaacaagaagaaaatgaagatgaggatgctgaagatgaagggcagattgaagagaacatctcaaagactcctccatcaacacggtcccggaagttgctatcacaaacttgtaaggaaatcagatgggaaggtgaaacatctgggaaaacattgtctggagaaactctatataaatgtgcttatgttagggaactcagaatacctgttggtggaacagtggctctagaagatgattcaggagacacagtcatttgttttgttgagtacatgttccagaaagttgatggttcaaaaatggttcatgggaggattctgcaaaaaggttcacagacaattcttggcaatgcggcaaatgagagggaggttttcttaactaatgactgcttagaattcaaattagatgacatcaaggaattggtaatggttgatatccaatcaaggccttggggtcacaagtacagaaaagagaattctgaagctgataaagttgagcaggtcaaagcagaagagagaaagaaaaagggccagcccatggtatatttctgcaaaagcttgtactggcctgagaagggtgccttctttgccctctcccgagataaaatgggtcttggtagtggtttatgtagttcttgtgataatatagagccagattctgatgaattgaaaatattctcgaagaccagctttgtctacagaaaggttacatataatgtcaatgagtttttatacataagacctgatttttttgctgaagatgaggatcgtgcaaccttcaaggctggccgaaatgtgggtctaaagccctatgcagtttgtcaaatattgtccatccctgaaggggctggatctaaaaaactcaatccagcatcagcaaatatcagtgctagaagattttacagaccagatgacatttcatcagccaaagcctatgcatctgacatcagagaggtctactatagtgaggatgtaattgatgtgcctgtggatatgatagagggaaaatgtgaggttagaaagaagaacgatcttgcaagttcagaccttccagtgatgtttgaacatgtatttttctgtgaacttatatatgaccgtgccagtggagctctcaagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtgtatcttttacaaaatgggcgattgaatacgaagagcctgctggtgaagcatttaataaaaatcatccagaggctgtggtctttgtagataactgcaatgtgattctaaaggcaattatggataaatgtggggatactgatgattgtgtttcaacttctgaagctgctgaacaagcagcaaaacttccagaagtgaacattaataatcttccagtccctggcgaagttgaattcataaatggtggtcctccgtgtcagggattctctgggatgaatagattcaaccaaagcccatggagtaaagttcagtgtgagatgattctagcattcctctcattcgctgagtatttccgtcccagattctttctgttagaaaatgttcggaactttgtttccttcaacaaagggcagaccttccgtttggcagttgcatctcttctggagatgggataccaggtccggtttggaattctagaagcaggggcttttggtgttgcccagtccaggaaaagggcgtttatttgggctgctgcacctggagagatgcttcctgattggccagagccgatgcatgtgtttgctagccctgagctgaagataacactgcctgatggccaatactatgcagctgcaagaagcactgctggtggagcgcctttccgagcgattactgttagagatacaattggggatctgcctaaagtgggaaatggtgccagcaaactcacgcttgagtatggaggtgagcccgtgtcttggttccagaagaagataagagggaatatgatggtactgaatgatcacatatctaaggagatgaatgagctgaacctaataaggtgccaacacattccgaaacggccgggttgtgattggcatgacctaccggacgagaaggttaagctgtcaaatgggcagatggctgacctgataccttggtgcctgcccaacacagccaagaggcacaatcagtggaaaggactgtacgggaggctggactgggaaggcaacttccccacatccgtcactgatccccagccaatgggcaaggtcggcatgtgcttccaccctgatcaagacaggatcatcacagtccgggaatgtgctcggtcacagggctttcctgacagctatgaatttgcgggcaacatccagaacaagcaccggcagattggcaatgccgtgcccccgcctcttgcctatgcacttgggaggaagctgaaggaagccgttgacaagcgtcaggaagccagcgcaggcgtgcctgcaccatgagaagttttccttccatcaaaccatgacccatgaagctaagcgctgaggtcgtccttgaggaccagttaattttggttttatcagtcttaatgcactcctgaatgtatatgttagagaagtgtcgattgctgattgttaccctgattcagggtagcggttatatctaaaaacttgagaaaatctagtgtactctagttgtcatgtgttccattttgttggctctaaactttcaactagttttggtgattaatgacaacatgagattaaattaaattttgtagaggcatttaaattaggccactaatagtgactatttagtcgctcaatttttttgcccctaattatggaatttgtttttt

SEQ ID NO: 640 - DNA, 3442 bp, Zea mays
cttttcagtactgttattttaacttttgttcccctatataggcatatatctgattgatatgctgaccaatgatttttcaggaacaagaagatgcagagcaaagccacaaaagaaggaagaggaatccacagaaaacaacaagctggagaatggatctctggatgcaacagaagaggtgcatcatggagtcgaaaaaggtgatggacatgttacccgcaagagaccaaggagatcagcggcctgttctgatttcaaagagaaatccatacgcttatccgaaaaaaaatctgttgtcatggtcaagaagaatcggatggaggaggaagaagtagatgctgtcaatctgacaaaacttggaccagaagatccaccaccttgccggaagttgatcgattttatcttgcatgatgcagaagggaacccacaaccctttgaaatgtcagaaattgatgacttctttataacagctcttatcatgcccatggatgatgatctagaaaaagagcgtgaaagaggagtacgctgtgaaggatttgggcgaattgaggactggaatatttctggttatgatgaaggtactcctgtaatctgggtgtcaactgatgttgctgactatgaatgtgtgaaaccatcaaccaattacaaatcttattttgaccacttctatgagaaggctcaggtgtgtgttgaagttttcaaaaagcttgcaaaatcagttggtgggaatcctaaccagggcctggatgaattgcttgctagtgttgttcggtcaaccaatgccatgaaaggatatagtggaaccatgagcaaagatttggtgatatccattggagaatttgtatacaatcaacttgttggtttggatgagacatcaaacaatgatgatgaaaagtttgctaccctgccagttcttctttctctaagagaccagtgcagatctagggtggaactgaccaagttgccctctaacttctcgaacacaagtctgaaaattaaggactcagagtgtgatgagacagcagaagacgatgatgatgcaaaattagctagattacttcaacaagaagaagaatggaaaatgatgaagaaacagaggggtaggcgtggaacaccatcccagaaaaatgtctacataaaaatcagtgaagctgagattgccaatgactatccccttcctgcatactataagccatttagccaggaaatggatgaatacatatttgatagtgatgacagcatattttctgatgatgtgccagttaggatactcaataactggacactgtacaatgcagattccaggcttatatctttggaattgatccctatgaaatcaggggcagaaaatgatgtggttatctttggatctggtttcatgagagatgatgatggcagttgctgttctacagctgagtctgtgaaatcttcgtcttcctccagcaaagctgaccaactggatgcaggaatccctatttatttgagcccaatcaaagaatggattatagagtttggtggctcaatgatttgtataaccattcggactgatgtggcctggtacaagctacgccaaccaacaaaacaatatgctccatggtgtgagcctgtactgaaaacagcaaggcttgctgttagcatcattaccctgttgaaagagcagagtcgtgcctcaaagctttcttttgctgatgtcataagaaaagtagctgaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcgtgcaacaacaaccaggctcatcaacagaatctggagtgattactatgcacatcatttccctgaagattccaaggagggagatggaaatgaaacaaaagaaattgatgatgaacaagaagaaaatgaagatgaggatgctgaagatgaagggcagattgaagagaacatctcaaagactcctccatcaacacggtcccggaagttgctatcacaaacttgtaaggaaatcagatgggaaggtgaaacatctgggaaaacattgtctggagaaactctatataaatgtgcttatgttagggaactcagaatacctgttggtggaacagtggctctagaagatgattcaggagacacagtcatttgttttgttgagtacatgttccagaaagttgatggttcaaaaatggttcatgggaggattctgcaaaaaggttcacagacaattcttggcaatgcggcaaatgagagggaggttttcttaactaatgactgcttagaattcaaattagatgacatcaaggaattggtaatggttgatatccaatcaaggccttggggtcacaagtacagaaaagagaattctgaagctgataaagttgagcaggtcaaagcagaagagagaaagaaaaagggccagcccatggtatatttctgcaaaagcttgtactggcctgagaagggtgccttctttgccctctcccgagataaaatgggtcttggtagtggtttatgtagttcttgtgataatatagagccagattctgatgaattgaaaatattctcgaagaccagctttgtctacagaaaggttacatataatgtcaatgagtttttatacataagacctgatttttttgctgaagatgaggatcgtgcaaccttcaaggctggccgaaatgtgggtctaaagccctatgcagtttgtcaaatattgtccatccctgaaggggctggatctaaaaaactcaatccagcatcagcaaatatcagtgctagaagattttacagaccagatgacatttcatcagccaaagcctatgcatctgacatcagagaggtctactatagtgaggatgtaattgatgtgcctgtggatatgatagagggaaaatgtgaggttagaaagaagaacgatcttgcaagttcagaccttccagtgatgtttgaacatgtatttttctgtgaacttatatatgaccgtgccagtggagctctcaagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtatgtattgttaacactgatgctgtataccatgaacatgaccaacaaat

SEQ ID NO: 641 - DNA, 5028 bp, Zea mays
cttttcagtactgttattttaacttttgttcccctatataggcatatatctgattgatatgctgaccaatgatttttcaggaacaagaagatgcagagcaaagccacaaaagaaggaagaggaatccacagaaaacaacaagctggagaatggacctctggatgcaacagaagaggtgcatcatggagtcgaaaaaggtgatggacatgttacccgcaagagaccaaggagagcagcggcctgttctgatttcaaagagaaatccatacgcttatccgaaaaaaaatctgttgttatggtcaagaagaatcggatggaggaggaagaagtagatgctgtcaatcttacaaaacttggaccagaagatccaccaccttgccggaagttgatcgattttatcttgcatgatgcagaagggaacccacaaccctttgaaatgtcagaaattgatgacttctttataacagctcttatcatgcccatggatgatgatctagaaaaagagcgtgaaaaaggagtacgctgtgaaggatttgggcgaattgaggactggaatatttctggttatgatgaaggtactcctgtaatctgggtgtcaactgatgttgctgactatgaatgtgtgaaaccatcaaccaattacaaatcttattttgaccacttctatgagaaggctcaggtgtgtgttgaagttttcaaaaagcttgcaaaatcagttggtgggaatcctaaccagggcctggatgaattgcttgctagtgttgttcggtcaaccaatgccatgaaaggatatagtggaaccatgagcaaagatttggtgatatccattggagaatttgtatacaatcaacttgttggtttggatgagacatcaaacaatgatgatgaaaagtttgctaccctgccagttcttctttctctaagagaccagtgcagatctagggtggaactgaccaagttgccctctaacttctcgaacacaagtctgaaaattaaggactcagagtgtgatgagacagcagaagacgatgatgatgcaaaattagctagattacttcaacaagaagaagaatggaaaatgatgaagaaacagaggggtaggcgtggaacaccatcccagaaaaatgtctacataaaaatcagtgaagctgagattgccaatgactatccccttcctgcatactataagccatttagccaggaaatggatgaatacatatttgatagtgatgacagcatattttctgatgatgtgccagttaggatactcaataactggacactgtacaatgcagattccaggcttatatctttggaattgatccctatgaaatcaggggcagaaaatgatgtggttgtctttggatctggtttcatgagagatgatgatggcagttgctgttctacagctgagtctgtgaaatcttcgtcttcctccagcaaagctgaccaactggatgcgggaatccctatttatctgagcccaatcaaagaatggattatagagtttggtggctcaatgatttgtataaccattcggactgatgtggcctggtacaagctacgccaaccaacaaaacaatatgctccatggtgtgagcctgtactgaaaacagcaaggcttgctgttagcatcattaccctgttgaaagagcagagtcgtgcctcaaagctttcttttgcagatgtcataagaaaagtagctgaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcgtgcaacaacaaccaggctcatcaacagaatctggagtgattactatgcacatcatttccctgaagattccaaggagggagatggaaatgaaataaaagaaattgatgatgaacaagaagaaaatgaagatgaggatgctgaagatgaaggacagattgaagagaacatctcaaagactcctccatcaacacggtcccggaagttgctatcacaaacttgtaaggaaatcagatgggaaggtgaaacatctgggaaaacattgtctggagaaactctatataaatgtgcttatgttagggaactcagaatacctgttggtggaacagtagctctagaagatgattcaggagacacagtcatgtgttttgttgagtacatgttccagaaagttgatggttcaaaaatggttcatgggaggattctgcaaaaaggttcacagacaattcttgacaatgcggcaaatgagagggaggttttcttaactaatgactgcttagaattcaaattagatgacatcaaagaattggtaatggttgatatccaatcaaggccttggggtcacaagtacagaaaagagaattctgaagctgataaagttgagcaggtcaaagcagaagagagaaagaaaaagggccagcccatggtatatttctgcaaaagcttgtactggcctgagaagggtgccttctttgccctctcccgagataaaatgggtcttggtagtggtttatgtagttcttgtgataatatagagccagattctgatgaattaaaaatattctcgaagaccagctttgtctacagaaaggttacatataatgtcaatgagtttttatacataagccctgatttttttgctgaagatgaggatcgtgcaaccttcaaggctggccgaaatgtgggtctaaagccctatgcagtttgtcaaatattatccatccctgaaggggctggatctaaaaaactcaatccagcatcagcaaatatcagtgctagaagattttacagaccagatgacatttcatcagccaaagcctatgcttctgacatcagagaggtctactatagtgaggatgtaattgatgtgcctgtggatatgatagagggaaaatgtgaggttagaaagaagaacgatcttgcaagttcagaccttccagtgatgtttgaacatgtatttttctgtgaacttatatatgaccgtgccagtggagctctcaagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtgtatcttttacaaaatgggcgattgaatacgaagagcctgctggtgaagcatttaataaaaatcatccagaggctgtggtctttgtagataactgcaatgtgattctaaaggcgattatggataaatgtggggatactgatgattgtgtttcaacttctgaagctgctgaacaagcagcaaaacttccagaagtgaacattaataatcttccagtccctggcgaagttgaattcataaatggtggtcctccgtgtcagggattctctgggatgaatagattcaaccaaagcccatggagtaaagttcagtgtgagatgattctagcattcctctcattcgctgagtatttccgtcccagattctttctgttagaaaatgttcggaactttgtttccttcaacaaagggcagaccttccgtttggcagttgcatctcttctggagatgggataccaggtccggtttggaattctagaagcaggggcttttggtgttgcccagtccaggaaaagggcgtttatttgggctgctgcacctggagagatgcttcctgattggccagagccgatgcatgtgtttgctagccctgagctgaagataacactgcctgatggccaatactatgcagctgcaagaagcactgctggtggagcgcctttccgagcgattactgttagagatacagttggggatctgcctaaagtgggaaatggtgccagcaaactcacgcttgagtatggaggtgagcctgtgtcttggttccagaagaagataagagggaatatgatggtactgaatgatcacatatctaaggagatgaatgagctgaacctaataaggtgtcaacacattccgaaacggccgggttgtgattggcatgacctaccggacgagaaggttaagctgtcaaatgggcagatggctgacctgataccttggtgcctgcccaacacagccaagaggcacaatcagtggaaaggactgtacgggaggctggactgggaaggcaacttccccacatccgtcactgatccccagccaatgggcaaggtcggcatgtgcttccaccctgatcaagacaggatcatcacagtccgggaatgtgctcggtcacagggctttcctgacagctatgaatttgcgggcaacatccagaacaagcaccggcagattggcaatgccgtgcccccgcctcttgcctatgcacttgggaggaagctgaaggaagccgttgacaagcgtcaggaagccagcgcaggcgtgcctgcaccatgagaagttttccttccatcaaaccatgacccatgaagctaagcgctgaggtcgtccttgaggaccagttaattttggttttatcagtcttaatggactcctgaatgtatatgttagagaagtgtcgattgctgattgttaccctgattcagggtagcggttatatctaaaaacttgagaaaatctagtgtactctagttgccatgtgttccattttgttggctctaaactttcaactagtgttggtgattaatgacaacatgagattaacttaaattttgtagaggcatttaaattatgccactaatagtgactatttagtcgctcaatttttttgcccctaattatggaatttatttttt

SEQ ID NO: 642 - DNA, 3442 bp, Zea mays
cttttcagtactgttattttaacttttgttcccctatataggcatatatctgattgatatgctgaccaatgatttttcaggaacaagaagatgcagagcaaagccacaaaagaaggaagaggaatccacagaaaacaacaagctggagaatggacctctggatgcaacagaagaggtgcatcatggagtcgaaaaaggtgatggacatgttacccgcaagagaccaaggagagcagcggcctgttctgatttcaaagagaaatccatacgcttatccgaaaaaaaatctgttgttatggtcaagaagaatcggatggaggaggaagaagtagatgctgtcaatcttacaaaacttggaccagaagatccaccaccttgccggaagttgatcgattttatcttgcatgatgcagaagggaacccacaaccctttgaaatgtcagaaattgatgacttctttataacagctcttatcatgcccatggatgatgatctagaaaaagagcgtgaaaaaggagtacgctgtgaaggatttgggcgaattgaggactggaatatttctggttatgatgaaggtactcctgtaatctgggtgtcaactgatgttgctgactatgaatgtgtgaaaccatcaaccaattacaaatcttattttgaccacttctatgagaaggctcaggtgtgtgttgaagttttcaaaaagcttgcaaaatcagttggtgggaatcctaaccagggcctggatgaattgcttgctagtgttgttcggtcaaccaatgccatgaaaggatatagtggaaccatgagcaaagatttggtgatatccattggagaatttgtatacaatcaacttgttggtttggatgagacatcaaacaatgatgatgaaaagtttgctaccctgccagttcttctttctctaagagaccagtgcagatctagggtggaactgaccaagttgccctctaacttctcgaacacaagtctgaaaattaaggactcagagtgtgatgagacagcagaagacgatgatgatgcaaaattagctagattacttcaacaagaagaagaatggaaaatgatgaagaaacagaggggtaggcgtggaacaccatcccagaaaaatgtctacataaaaatcagtgaagctgagattgccaatgactatccccttcctgcatactataagccatttagccaggaaatggatgaatacatatttgatagtgatgacagcatattttctgatgatgtgccagttaggatactcaataactggacactgtacaatgcagattccaggcttatatctttggaattgatccctatgaaatcaggggcagaaaatgatgtggttgtctttggatctggtttcatgagagatgatgatggcagttgctgttctacagctgagtctgtgaaatcttcgtcttcctccagcaaagctgaccaactggatgcgggaatccctatttatctgagcccaatcaaagaatggattatagagtttggtggctcaatgatttgtataaccattcggactgatgtggcctggtacaagctacgccaaccaacaaaacaatatgctccatggtgtgagcctgtactgaaaacagcaaggcttgctgttagcatcattaccctgttgaaagagcagagtcgtgcctcaaagctttcttttgcagatgtcataagaaaagtagctgaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcgtgcaacaacaaccaggctcatcaacagaatctggagtgattactatgcacatcatttccctgaagattccaaggagggagatggaaatgaaataaaagaaattgatgatgaacaagaagaaaatgaagatgaggatgctgaagatgaaggacagattgaagagaacatctcaaagactcctccatcaacacggtcccggaagttgctatcacaaacttgtaaggaaatcagatgggaaggtgaaacatctgggaaaacattgtctggagaaactctatataaatgtgcttatgttagggaactcagaatacctgttggtggaacagtagctctagaagatgattcaggagacacagtcatgtgttttgttgagtacatgttccagaaagttgatggttcaaaaatggttcatgggaggattctgcaaaaaggttcacagacaattcttgacaatgcggcaaatgagagggaggttttcttaactaatgactgcttagaattcaaattagatgacatcaaagaattggtaatggttgatatccaatcaaggccttggggtcacaagtacagaaaagagaattctgaagctgataaagttgagcaggtcaaagcagaagagagaaagaaaaagggccagcccatggtatatttctgcaaaagcttgtactggcctgagaagggtgccttctttgccctctcccgagataaaatgggtcttggtagtggtttatgtagttcttgtgataatatagagccagattctgatgaattaaaaatattctcgaagaccagctttgtctacagaaaggttacatataatgtcaatgagtttttatacataagccctgatttttttgctgaagatgaggatcgtgcaaccttcaaggctggccgaaatgtgggtctaaagccctatgcagtttgtcaaatattatccatccctgaaggggctggatctaaaaaactcaatccagcatcagcaaatatcagtgctagaagattttacagaccagatgacatttcatcagccaaagcctatgcttctgacatcagagaggtctactatagtgaggatgtaattgatgtgcctgtggatatgatagagggaaaatgtgaggttagaaagaagaacgatcttgcaagttcagaccttccagtgatgtttgaacatgtatttttctgtgaacttatatatgaccgtgccagtggagctctcaagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtatgtattgttaacactgatgctgtataccatgaacatgaccaacaaat

SEQ ID NO: 643 - DNA, 2574 bp, Zea mays
ctgatgtggcctgtggcaatgcaggtgtccgtactctgcgcttaaatcctttccgggtggagttcttgcctttctcgccgcttccgactctgccatgccaccatagatccagctagggcgttcaatcctgtgcgagagtacgcgaaatcgccgccggattgatattgaccaggggtttctccgcccaactgaggtttcgctgccatttgcagggaccgtgctccagttcggcctttcgggggaaaaggaatcgtatctgctgaatccccgggctccggggatggatcttgacatggacggctacgtagacccctacgaggaggccgcggccgagggcgactccgacgaccctgacgaggacgactcggatgcggagagcgactacgaggagaagtcgttcggcctcctcaagtccggcaagcaccgggtgcgcaacccggacggcaccttccgctgccccttctgcctcggcaagaagaagcagggttacaagatcaaggacctcctccagcatgccgacggcatcggcgtctccagcaagcaccgacgtcacggccgcgaacgcgcgaaccaccgcgcctttgcacgctttgtccgcaccgatccgtcctttgcggaagacctcgtcggtataactggcattcaaggtgccattacaactacccctgctaatgagaactacagcgccaatggcaacgggaaggccaaggctaatgtagatactgctggttccagttctgtggcggcaaaagtgggtccgccacaggaggttgagaggtttgcttggccgtgggcttgtgttcttgcagctggggcaggctttaatgctgaggactttgttggtagagtagcattgttcagttcggttgaggttgtgcctttgtttgtcgatgagatggaagtcacagaaaccttcgcaattgtgaggtttaccaatgattggagtggattcaatgatgcacttacgatagagaactatttcagcgtcaataagcttggtaagaaggaatttcagatgagagatagtggtcttggttccgtggagggagatggcgaaggcgatgtcaaggtttatgggtgggttgcccgagctgaggactacgatgcaacgactgtggtaggaagattcttgagaaagcacactgtcctgcaaacaatagacgaggtttccaagactgaattagagaaatcaggggagatggtggcgatactggcatcccagatcgaggaaaagaaccgatacttgcaggatttggagacaaagaagaatgcgacagaactctccatctcaaggcttgaggaggacaacaggaaacttcatgaggcatacaatgaagaaatgcgcaatcttcatcgcagggctcgtgaaaatgcgctacggattttccaagagaatgaaaacttgaggattgacttagaaaataagaggagagaactgaacttacgagctaaggagcttgaaaaaatgtcagctgagaatgctaacgacaggaagacactcgatgatcagaagcagaagacaaagtatgataatagtgaacttgagctagctagcatagagcaacagagggctgatgcagatgttctgaagctattggctgaccaagagagggaaaaggaagatgtacttgctagaatgcttcagctggaaaaagagctgcatgagaagcaacagcttgagctcgaagtagaacggttgaatggtacactccaagtgatgaaacatctagagggagacgatgacgggggagatatccatgaaaagatggagaagctgagtgaaagatttgagcgggaaaagaagcgcctggaggatttgagtggtgatctggtgacaaaagagcgtgaaagtaatgatgagctacaacaagcccgaaaagaattgataaagggtttggaggaagagctaaatggacggacagctgttgggatcaaaagaatgggggaactcgatgaaaagcctttcctaaatgcatgtaagagaaaatatgggaacaatgaataccaggtcaaagcagcagagctggtcacaaattggcaggaggaactaaagaatccatcctggtatccttttaagatgattcatgttgacggagaggacaaggaaattctggttgacgatgatacgaaactgaagtttctgtggattgagtttggcgatgacgtgtgtaatgcggtgaagacggcattgatggagataaacgagtataacccaagtgggaggtatgttgtgcccgagctgtggaacttcaggaaaggcaggaaggcgacgatgaaggaggtgctcaagtacctgttcagtcagatggacacgacgaccaagcgcaggaggggctgagtaggtgcccttggccatgccgtgaagcccagtcgtgtgctgctcgatcccgtagtggcagtctgtcttgtactgtgtagtgacatctgacgtaataatgttcaggcttgggtatggtttgagctaacgagccatatagtgtgcttggctaggctcgtttacgagctctttagctcgcgagtcaggtgagaacagaaaaaacaatatgtatataataattaatttctagttaattt

SEQ ID NO: 644 - DNA, 2931 bp, Zea mays
atttaataatttgctaaatctgagttttttagtaaccagggtagatatgatagtaaagattgttcagctcgacgcaaacgacaaaaccatcttgaaaatggcagaaagaaaaaattcagaaggagccctcgaatcccggtcctaggaaccgtctgtcaacgcggtcggggtacttgagtgcctttttcttctctcacgtgcgcccctaaaccccagtgtgctgtgctaatggggatcgaacgccctgcgcttaaatcctcgggtagaactctcgcctcttccgactccgccataccaccaatagatccagctatggcggtgtagtcgaattcaatcctgtgcgagaaaacacgaaatcgccgctggctcgatattggccagggctttctccgcccaactgcatcttgcagcgactgtgctccagttcgggggaaaaaaaggaaccgtatctgcttgaatccctgcgctccggggcggggatggatcttgacctggacgactacgtggacccctacgaggaggccgaggccgaggctgccgcggcggaggacggctccgacgaccccgacgaggacgactcggatgcggagagcgactacgaggaggagtcgtttggcctcctcaagtccggcaagcaccgggtgcgcaacccggacggcaccttccgctgccccttctgccccggcaagaagaagcaggggtacaagataaaggacctcctccagcacgccgacggcatcggcgtctccagcaagcaccgccgtcacggccgcgagcgcgcgaaccaccgcgccttcgcgcgctttgtccgcaccgagccgtcatttgcggaagacctcgtcggtatcactggcattcaaggtgccattaaacccacccctgctaatagagatggcagtaccaatggcgacgggaaggccaaggctaatgtagatactgctggatccagttctgtggcggcgaaagtgggtctgccgcgggaggttgagaggttttcttggccgtgggcttgtgtccttgcggctggggcagggttcaatactgaggactttgctggtagagtagccatgtttagttcggttgaggttgtgcctttgtttgtcgatgaggtcgaagtcgcagaaacctttgcagttgtgaggtttaccaatgattggagcggattcagcgacgctcttacgctggagaaccatttcagcatcaataagctagggaagaaggaatttgagatgagagataatggtataggttccgtggagggagatggtggcgaaggtgaggtcaaggtttatgggtgggttgcccgagctgaggattatgattcgccgagtgtggtagggagattcttgagaaagcacaccgtcctgaaaacaatagacgaggtttccaagactgaattagagaaatcaggggagatggtggcaatactggcatccaagatcgaggaaaagaaccgacacttgcaggatttggaaacaaagaagaatgcgacagaactctccatctcaaggcttgaggaggacaacaggaaactacatgaggcatataatgaagaaatgcgcaatcttcatcgtagggctcgtgaaaatgctttgcggattttccaagagaatgaaaacttgaggattgacttagaaagtaagaagagagaactgaacttgcgagctaaggagcttgacaaaatatcaactgagaatgctaacgacaggaagacacttgataatgagaagcagaaggcaaaatacgataacagtgaacttgagctagcaagtatagagcagcagagggctgatgcagatgttctgaagctattggctgaccaggagagggaaaaggaagatgtacttgctagaatgcttcaactagaaaaagagctgcatgagaagcagcagcttgagctcgaagtagaacggttgaatggtacactccaagtgatgaaacatttagagggagatgatgacgggggagatatccatgagaagatggagaagctgagcgaaagatttgagcgtgaaaagaagcgtctggaggaattgagtggggatctcgtgaggaaggagcgtgaaagtaatgatgagctacaagaagcccgaaaagaactgataaagggtttggaggaagagctaaatggacggacagctatcggggtcaaaagaatgggggaactcgatgaaaagcctttccaaaatgcatgtaaaacaaaatacggaaaggatgagtacgagatcaaagcagcagagctagtcacaagttggcaggatgaactaaagaagccatcctggcatccttttaagatggttgaggttaacggagaaaataaggaaattctggatgacgatgacacaaaactgaagttcctgtggatcgagtacggcgatgatgtgtgcaatgcggtgaagaccgcactgatggagattaacgagtataaccctagcgggaggtatgttgtgccggagctctggaactttaggaaaggccggaaggcgacggtgaaggaggtgctcaagtacctgttcagtcagatggacacgacgacgaagcgcaggaggggctgaggaggtgcctgatgccgagtagtgccttctatgttgttgcatcagtcgtgtgctgctcgatccccaagtggcagtctggcataggagatgcccctcttgtgtagtgaaatctggcacgataaagtgcccgcgatccaggcttgggtatgccttatgcatcatgttcatatgcttgtgcatgtggtgctgttgccgcaggcgccctagcctaacctgtatgattgttgagatgagtagtctttcttgctgctgttactcccttcgcccctcaatgtctctgaataaatcaattcctaaagttatcataaaatcgagcttttttaatcagactttttaaagtttaactgaacttatagaaaagagtcaggatttatga

SEQ ID NO: 645 - DNA, 2440 bp, Zea mays
gtttggcgggcgccgcgcgtatgtttctcgttgcgacttggaggagaaggagattcgccgtctcaccccttccctgcctgctccctcgtctaagaaaagcgggcagagcagagacggcggcggcaggccatcgcggactcccgctcaccctcgtctgccaccgcctcccaggtcaggggccgacggcgacgggtggggaggggcggcagaggtagtccgaggggaggctgtggagcggagggcggagagaggccacgccgtccggagtctccagttccgtcgccacagcttcctgccgcgcctgggccgaggtaaacgagagggatcgaggaagaagtatcccccggagccccttcccccgaacccgaaggctccggaatggcgcactgggttagcgacagtgatggcagtgacaactttgaatgggatagtgatggcaatggggaggagccagcgaacttcaatgctgctggtgccggttcatcagctctgagatcaacgaacactgatgctccaggtccatcaacacgggttgctaatggcaatgggaaggctgggccatctgcctccttggttcaaaagtatatggacatgggtttcacggaagagattgttcggaaggccatgaaggacaatggggataatggagcagattcattagttgagcttcttcttacttaccaggaactaggcaatgacctcaaagtggataacggcttcgcttctggttgtgccccccaaactgttgatgatagtgatgatgacgacattctagaaaactgggatgatgaggatgctgatggtgggagaagcaccagggttgctaactctattgatgattctgaagacgaggatttcttaaatgagatgtcacagaaggacaagaaagttgattccttagttaaaatggggtttcctgaagacgaggctgcactggctattactagatgcgggcaggatgcatctatttctgttctggtggattccatatatgcttcacagaccgcaggagatggttactgtggcaatttgtctgactacgagggtaattccaatggagggagaaacaaaggaaggttcatggacgggaacaaaaaaaagagaaaaagatatggaggtcaagcacagggaaatagaggcccattagatggtagctgtgaagaacccatgcctctcccaaatccaatggttggatttaatttgccggaccattggacaagaccagtagacagatcgctgcctacacaagctattggaccaccatacttctactacgagaatgttgctcttgctccaaagggtgtctggactaccatatctagattcttgtacgatattcagccggagtttgtggactccaagtacttctgcgctgctgccaggaaaagaggctacatacacaatctaccacttgagagaaggtcgcctctcctccccttacctccgaagacaatatttgaagcatttcctcgtaccaagaggtggtggccttcatgggacccaaggcggcagttcaattgcctccagacttgtacgtctagcgcaaaactgttagagaggattcgtgtaacccttgcaaacagttcggatccaccacctccattagttcagaagtttgtgctggaggagtgtaggaaatggaatctggcttgggttggcctaaacaaggttgctcccctagagcctgatgagatggagttcctgcttggctttcccaaggatcacaccagaggtatcagcaggacagagaggtaccgatctcttggaaactcgtttcaggttgacactgttgcttaccatctctcagtcctcaaggataggtacccacaaggcatgaacgtgttgtctctattcactggcatcggaggagccgaggtggctctccataggctcggtatacgcatgaacacagtcgtttcagtagagaagtctgaggtgaacaggactattctgaagagctggtgggatcagacacagactggtaccttgattgagatcaatgatgtgcagacgctgacagctgataggatcgaggcatatattagacgaattggcggctttgatctcgtgataggtggaagcccatgcaacaatctcgctgggagcaaccgccaccacagagatggcttggagggcgaacattcttcattgttttaccattattttaggatcttggactccgtcaagtccatcatggagcgcctgtagtttttagaaacttttgatgttctggttcgtagaattgtagccgtctttccctgtgatcaaacttgtgaatgatttgaaggtcgactggtgtaatattcatgtcactctaatttaggctactttcgttaattacctcttgtgatcaatgcaaattgaaaggcaggtttcatttcttaagtttgtatttctcaatgcgagatctagtatctttgtcgaaaaaaaaaacctaaaa

SEQ ID NO: 646 - DNA, 2058 bp, Zea mays
gagattctgatatatcaagcttcgtgattttggaagctatgacaacacttagatgctgtgaggacttctctatggagcgattagagttattgggggactctgttcttaagtatgcagtgagtgcccatcttttcatgacatttcttaataagcatgagggacagttatcgtccagaaggcaagaaacaatatgtaatgccacactttataggcttggtattgaacgcaggatacagggttacatacgtgatgctgcatttgatcctcgtcgatggcttgctcctggacagctgtccagacgtccttgtccttgtgaatgcccagtaaattctgaggttgtaactgaggatattcataggattgatgacaagtctataattataggcaaggcgtgtgacaagggacacagatggatatgttcgaaaaccatctctgattgtgttgaggctctaattggggcctattatgtcgaagggggattaaaagcagcttttgctgttctcaaatggttccagattgagactgaaatcgaggaagagttaattatggaagctctgtcgagtgcttcagtgcgaaactatcttccaaaagttgatgtagttgaattgcttgaagcaaaactaggctacacttttcaaatgaaaggtttgttaatagaggctctcacccactcatcacagcaagaatctggagcaacatactgctaccaacgcttggagttccttggtgatgcagtcttggatattttaataactcgccatctgttccttagtcataaagacacagatgagggggagctgacagatttacggtctgcatcagtaaataatgagaattttgcacaagttgcggtaaagcacaatctccatcagtttctacaacattcttcggggttcttacaagaccaaattactgaatatgtgaatagtcttgaaagttcgtccatggacagagccagccttttatccagtggaccatgtagggggccaaaagttttaggtgatattgtagaaagtatagcaggtgctattcttattgacagcaaacttgatttggatttagtttggcgggtttttaaacctcttctttcaccaattgtcacacctgagaatttggagttgccccgattcagagaacttaatgagtggtctgacaagaatgggtactttattggaattaagtgtgaaaatcgaggagacagcacaatggctatccttaacttacaactcaaggatttgcttcttgtgaggcaaggttgtgggaagaataaagtagatgcgaaagcacatgcagcttccttattgcttagggatctagaggaaaaaggacttataattccaaggaatgcaagcagagtggaacaacttgaaaagaattctggtactgtaaaacattgcaacaacgtgcttgatgttatggacacacaaaacgtagcaccacctaggcaaaaggaagtagctgtgttaagtaccaccactcctggctctgttcttgataagccattggttgtgaaggttaagttgagcaaaggaggacctcgtatatcattgtacgagtcgtgtaaaaagcttcagtggccaatgccgacctttgaattcgtgaaggtcgaaccaagcgtgtgctcctcttcctgtggttcgtcacaaaaggttgcgccccaaggattcgcatttgcttcgacaataacgttgcatataccgaacggcgatgtcatcagcctcacaggagatgggcgtgcggataagaagagctcacaggattctgctgcgttgctcatgctctatgagctgcagcggcaacgtagattccaagttcaagaagtatgaggaatcacctcgtggttccatcaccaaagatgcaatgttaccgccaccggcgattattgcttgggcatcttggagtaatgtcaccgccaaatcagtctttagtcgtcagccgcacgggggtgtaagaaaataatgtacttcattctgattctaaattataagacaccccgaattatgtaatctaattatcataatgtcctataatttgaaatggagcggtgttggttactct

SEQ ID NO: 647 - DNA, 4715 bp, Zea mays
ggcgccacccacacccaccgcctcacgcacttcgccttctcgcccagttcagctcctctctcccccttccgccgtgtctcgctcctcctggctatgccgatttataaacccccaccgcgccatgcgctccccaccgccacagccactccacccgcaccgaaccaatggcggacgccgccacctccgaggatgccgacctgccgcccccacctccgccggcgcagctcccgcctcctcgccgcccgcacaagcggcttcagccgcgggggtaccaggtggaggtgttcgctgcggcgctgcgcgggaacaccatcgcggtgctagacactggctctgggaaaaccatggtcgctatcatgctcgcgcgggagcacgtcctccgcgcgcgcgctggggaggcgctgcgccggatcgtggtattcctcgcgcccaccgtgcacctcgtccaccagcaattcgaggtgattcgggagtatacagacctcgacgcggtggagtgccatggggcatcgggggttggccactggaacgccaagcgctggaaggaagcaattgggactaaggagattgttgttatgacaccacagatactattggatgctctcaggcatgcttttctaacaatgcgtgtgatgagcttgttaatatttgatgaatgccatcgtgcttgtggaaaccatccatactcactaataatgaaggaattttacattgattcggagtggaggccagctatatttggaatgacggcgtctccagtttctaaaaagggagcttctactatagaagattgtgaagcacagattgctcaacttgagctagtattggatgccaaggtatatattgttgaagataggaatgaacttgagagcttttcaactggtgcaaaagttgtgaataaatactatgacccttacttgtttgatttggataatctggaatcaaagttacagatgctgtttgaggaggtggtgaagatatataatgaaagcattaataccatagatgattctgaagattgcgtattttctaaagagagcctcaacttacaggtttcctatttcaaagaagctttatttttgattgaagattttttgccacagggttatggggagctgatgaaatcagaatctggttctgcggaactaactaagaagggatatatttcttctaaagtggagtcactgatcaacattttcaaatcgtttggctcgtcagaggaagtgctttgcatgatttttgtagaaagaattacgacagccaaagctgttgaaaggtttatgagaggaaatgtgaacttctctcgtttttcaatttcatacttgactggagggagtacatcaaaagatgctttgagcccagcagtacaaagatttactttggatttgttccgagctgggaaggtgaatttgctttttacaacagatgtcactgaagagggtattgatgtacctaactgttcctgtgtgatacgttttgacttacccagaactgtttgtagctatgtccagtctcgtgggcgtgccagaaaaagcagttcaagttatgttcttatgattgaaaggggtaacttggcgcagcaggaacacatatttcgtataatacgaactgaatactatgttaaaacctttgcactgcataaacaaccaaatactccatcacttgatttgcctctccaagagaagtacatataccatgttgaatcaacaggagcaactatcaccgcagaatgctgtgtcaacctaatttataaatattgtgagaagcttcctaaagataggtattacttgccaaagccttgctttgaggtgggtcttaaggatgggtcatatcaatgtaccttgacaatgcctcacaatgctgcatttcgaagtatagttggtcctccaagtagttcatgtaatttagccaagcagcttgtatgcctggaggcatgcaagaaactgcacgagctgggagaactcgatgatcatctagtacccttgactgaagagcctatggatattgatacagacacaacagataaaaaatgtgtttctggaccaggaacaactaaacgaaaggagcttcatggaacgataaatgttcatggtctatctggaaactggatccatgaaagtgaaactgtgattctgaatgcttacacatttgattttcgttgtgatcaagaaggtgaactttatgctgggttcgttctcttaatggaatcagtacttgatgatgatgtggcacgttcagagatagatctcttccttatacctaataaaatggtgtacaccaccatgactccttgtggaaaaattcaactgaacaaagagcagctgtgtaaaggaaaattattccaagaattcttcttcaatggtatatttggtagattatttcatggttcccgaacggatgaactgcaaagggaatttattttcacaaaaggtcatgaaatacaatggggctcagacaacatgtacttacttttgcctttgaggaactcttcacagatacaacatgatccaaacatatactgggaagccgttgagtcttgctctggtacagtagagcagttgagaaatttgtatctagaagatggaaatctcaaccatgaaaacttatgttcacataaaagaagcaacaagggagaagacatcattcatctggccaataaatctcttcatttttccacagtcaaagattcagttgtactatctcttcatactgggaggatctattctgttcttgacttgattttagataaaactgcagatgactcatttgatgagatgtataatgggaaagcttcaccatttgcttcatttgtggactactaccatcaaaagtatggtattgttattcaacatccagggcaacctttgttgctgttaaagcaaagtcacaatgcacacaacttacttttttcaaaaatgaagtaccaagatggttcaactggcaatcctctgctcgtagaaaaagagcaaattcatgcccgagttccacctgaactactcatccatattgatgtcgcaactgatattctcaaatcattttacttgctcccttctgtaatgcatcgggttcagtctttaatgttagccagccagcttcgcagcaacattagttacattcaacgcataccaagttctctgattttggaagctataacaactttaaggtgctgcgagtccttttctctggagcggttagagttattaggagactcagtactgaaatatgtaataggatgtgatctgttcctaagatacccaatgaaacatgaaggccatctctctgatatgagatccaaggcggtatgcaatgcgacactgcataaacatggaatatggcaatccctgcagggttatatacgtgatgctgcatttgaccctcgtcgttgggttgctcctggacagatatcattgcgcccttttccttgtaattgtggaatcgaaactgcatttgttccttttaatggaggttatatcagtgacgatccatcttttgttgtgggaaaaccatgtgacagaggccacagatggatgtgctcaaaaacagtatctgattgtgttgaagcactagttggagcatattatgttggtggtggcatcgctgctgcaatttgggttatgaggtggtttggtattgatgtcaggtgtgatatggaactagtgcagaaagcaaaatataattctaatgcatctcgaatgtgctatttatcaaaaataaaagatattgaggaactggaagcaaaactgaagtacaacttctcggtcaaaggccttctgcttgaagccatatcacatccatctgtacaggaattaggagttgactattgttaccagcgtctggaatttcttggtgattctgtgctggatctattaatcacacagcatctctatgctacccacactgatgttgatcctggagaattgacagacctgcgttccgcttcggttagtaatgagaattttgcacaagcagttgtaagaaacaatattcataatcatctacagcatggatctggaatacttttggaacaagtaacagaatatgtcaggtccaacttggagtaccatggtaaagagaatcaattccttcaacaagctacatgcaaagcacctaaggttcttggagacatcatggaaagtattactggtgcaatatttatagatgtaaattttgatgttgatctggtttggaagattgttgaaccgttactttctccaatgattacccctgataagcttgcgttgccaccttatcgggagttgctggagttatgtagtcaccttggttgcttcatagagtcaaaatgtactagtgaaggagaagagttaattattgagatgaaggtgcagttgcgagatgaacaactgatagcacaaggacatgacagaaatggtaaaaccgcaaaggcaaatgcagcagcccgaattttggtcgacatgaagaaacggggtctctctcttaaacaatgcatctcgaaggctaatcaattggatattgtctcttcaaaactgcaatcagaattgacaaatttggaatcgcgacatgattgtcctcacatgaatggcactcttagcctaggtctttcctcagcgagagcagcagttgttcttcctctcaaaatggacaaaggtggacctcggactgcactttttaggctatgcaagagtttacagtggccaattccagaatttgaatttgtggaacaaaggtttaggtat

SEQ ID NO: 648 - DNA, 4513 bp, Zea mays
ggcgccacccacacccaccgcctcacgcacttcgccttctcgcccagttcagctcctctctcccccttccgccgtgtctcgctcctcctggctatgccgatttataaacccccaccgcgccatgcgctccccaccgccacagccactccacccgcaccgaaccaatggcggacgccgccacctccgaggatgccgacctgccgcccccacctccgccggcgcagctcccgcctcctcgccgcccgcacaagcggcttcagccgcgggggtaccaggtggaggtgttcgctgcggcgctgcgcgggaacaccatcgcggtgctagacactggctctgggaaaaccatggtcgctatcatgctcgcgcgggagcacgtcctccgcgcgcgcgctggggaggcgctgcgccggatcgtggtattcctcgcgcccaccgtgcacctcgtccaccagcaattcgaggtgattcgggagtatacagacctcgacgcggtggagtgccatggggcatcgggggttggccactggaacgccaagcgctggaaggaagcaattgggactaaggagattgttgttatgacaccacagatactattggatgctctcaggcatgcttttctaacaatgcgtgtgatgagcttgttaatatttgatgaatgccatcgtgcttgtggaaaccatccatactcactaataatgaaggaattttacattgattcggagtggaggccagctatatttggaatgacggcgtctccagtttctaaaaagggagcttctactatagaagattgtgaagcacagattgctcaacttgagctagtattggatgccaaggtatatattgttgaagataggaatgaacttgagagcttttcaactggtgcaaaagttgtgaataaatactatgacccttacttgtttgatttggataatctggaatcaaagttacagatgctgtttgaggaggtggtgaagatatataatgaaagcattaataccatagatgattctgaagattgcgtattttctaaagagagcctcaacttacaggtttcctatttcaaagaagctttatttttgattgaagattttttgccacagggttatggggagctgatgaaatcagaatctggttctgcggaactaactaagaagggatatatttcttctaaagtggagtcactgatcaacattttcaaatcgtttggctcgtcagaggaagtgctttgcatgatttttgtagaaagaattacgacagccaaagctgttgaaaggtttatgagaggaaatgtgaacttctctcgtttttcaatttcatacttgactggagggagtacatcaaaagatgctttgagcccagcagtacaaagatttactttggatttgttccgagctgggaaggtgaatttgctttttacaacagatgtcactgaagagggtattgatgtacctaactgttcctgtgtgatacgttttgacttacccagaactgtttgtagctatgtccagtctcgtgggcgtgccagaaaaagcagttcaagttatgttcttatgattgaaaggggtaacttggcgcagcaggaacacatatttcgtataatacgaactgaatactatgttaaaacctttgcactgcataaacaaccaaatactccatcacttgatttgcctctccaagagaagtacatataccatgttgaatcaacaggagcaactatcaccgcagaatgctgtgtcaacctaatttataaatattgtgagaagcttcctaaagataggtattacttgccaaagccttgctttgaggtgggtcttaaggatgggtcatatcaatgtaccttgacaatgcctcacaatgctgcatttcgaagtatagttggtcctccaagtagttcatgtaatttagccaagcagcttgtatgcctggaggcatgcaagaaactgcacgagctgggagaactcgatgatcatctagtacccttgactgaagagcctatggatattgatacagacacaacagataaaaaatgtgtttctggaccaggaacaactaaacgaaaggagcttcatggaacgataaatgttcatggtctatctggaaactggatccatgaaagtgaaactgtgattctgaatgcttacacatttgattttcgttgtgatcaagaaggtgaactttatgctgggttcgttctcttaatggaatcagtacttgatgatgatgtggcacgttcagagatagatctcttccttatacctaataaaatggtgtacaccaccatgactccttgtggaaaaattcaactgaacaaagagcagctgtgtaaaggaaaattattccaagaattcttcttcaatggtatatttggtagattatttcatggttcccgaacggatgaactgcaaagggaatttattttcacaaaaggtcatgaaatacaatggggctcagacaacatgtacttacttttgcctttgaggaactcttcacagatacaacatgatccaaacatatactgggaagccgttgagtcttgctctggtacagtagagcagttgagaaatttgtatctagaagatggaaatctcaaccatgaaaacttatgttcacataaaagaagcaacaagggagaagacatcattcatctggccaataaatctcttcatttttccacagtcaaagattcagttgtactatctcttcatactgggaggatctattctgttcttgacttgattttagataaaactgcagatgactcatttgatgagatgtataatgggaaagcttcaccatttgcttcatttgtggactactaccatcaaaagtatggtattgttattcaacatccagggcaacctttgttgctgttaaagcaaagtcacaatgcacacaacttacttttttcaaaaatgaagtaccaagatggttcaactggcaatcctctgctcgtagaaaaagagcaaattcatgcccgagttccacctgaactactcatccatattgatgtcgcaactgatattctcaaatcattttacttgctcccttctgtaatgcatcgggttcagtctttaatgttagccagccagcttcgcagcaacattagttacattcaacgcataccaagttctctgattttggaagctataacaactttaaggtgctgcgagtccttttctctggagcggttagagttattaggagactcagtactgaaatatgtaataggatgtgatctgttcctaagatacccaatgaaacatgaaggccatctctctgatatgagatccaaggcggtatgcaatgcgacactgcataaacatggaatatggcaatccctgcagggttatatacgtgatgctgcatttgaccctcgtcgttgggttgctcctggacagatatcattgcgcccttttccttgtaattgtggaatcgaaactgcatttgttccttttaatggaggttatatcagtgacgatccatcttttgttgtgggaaaaccatgtgacagaggccacagatggatgtgctcaaaaacagtatctgattgtgttgaagcactagttggagcatattatgttggtggtggcatcgctgctgcaatttgggttatgaggtggtttggtattgatgtcaggtgtgatatggaactagtgcagaaagcaaaatataattctaatgcatctcgaatgtgctatttatcaaaaataaaagatattgaggaactggaagcaaaactgaagtacaacttctcggtcaaaggccttctgcttgaagccatatcacatccatctgtacaggaattaggagttgactattgttaccagcgtctggaatttcttggtgattctgtgctggatctattaatcacacagcatctctatgctacccacactgatgttgatcctggagaattgacagacctgcgttccgcttcggttagtaatgagaattttgcacaagcagttgtaagaaacaatattcataatcatctacagcatggatctggaatacttttggaacaagtaacagaatatgtcaggtccaacttggagtaccatggtaaagagaatcaattccttcaacaagctacatgcaaagcacctaaggttcttggagacatcatggaaagtattactggtgcaatatttatagatgtaaattttgatgttgatctggtttggaagattgttgaaccgttactttctccaatgattacccctgataagcttgcgttgccaccttatcgggagttgctggagttatgtagtcaccttggttgcttcatagagtcaaaatgtactagtgaaggagaagagttaattattgagatgaaggtgcagttgcgagatgaacaactgatagcacaaggacatgacagaaatggtaaaaccgcaaaggcaaatgcagcagcccgaattttggtcgacatgaaggtatatcttttcaaacagaaacaaaatatcaagaaatgtctagtttaaggggttgggcaggtccattgtgaaag

SEQ ID NO: 649 - DNA, 3888 bp, Zea mays
tttttttttcagttttgaaggactatgttgttcgttctagaaaatcatacatgcatttatctagcaatcttattaaccagagtaactattggtacaatttgaatgtttatatgctaactctttattacatttctctgataggtggtgaagatatataatgaaagcattaataccatagatgattctgaagattgcgtattttctaaagagagcctcaacttacaggtttcctatttcaaagaagctttatttttgattgaagattttttgccacagggttatggggagctgatgaaatcagaatctggttctgcggaactaactaagaagggatatatttcttctaaagtggagtcactgatcaacattttcaaatcgtttggctcgtcagaggaagtgctttgcatgatttttgtagaaagaattacgacagccaaagctgttgaaaggtttatgagaggaaatgtgaacttctctcgtttttcaatttcatacttgactggagggagtacatcaaaagatgctttgagcccagcagtacaaagatttactttggatttgttccgagctgggaaggtgaatttgctttttacaacagatgtcactgaagagggtattgatgtacctaactgttcctgtgtgatacgttttgacttacccagaactgtttgtagctatgtccagtctcgtgggcgtgccagaaaaagcagttcaagttatgttcttatgattgaaaggggtaacttggcgcagcaggaacacatatttcgtataatacgaactgaatactatgttaaaacctttgcactgcataaacaaccaaatactccatcacttgatttgcctctccaagagaagtacatataccatgttgaatcaacaggagcaactatcaccgcagaatgctgtgtcaacctaatttataaatattgtgagaagcttcctaaagataggtattacttgccaaagccttgctttgaggtgggtcttaaggatgggtcatatcaatgtaccttgacaatgcctcacaatgctgcatttcgaagtatagttggtcctccaagtagttcatgtaatttagccaagcagcttgtatgcctggaggcatgcaagaaactgcacgagctgggagaactcgatgatcatctagtacccttgactgaagagcctatggatattgatacagacacaacagataaaaaatgtgtttctggaccaggaacaactaaacgaaaggagcttcatggaacgataaatgttcatggtctatctggaaactggatccatgaaagtgaaactgtgattctgaatgcttacacatttgattttcgttgtgatcaagaaggtgaactttatgctgggttcgttctcttaatggaatcagtacttgatgatgatgtggcacgttcagagatagatctcttccttatacctaataaaatggtgtacaccaccatgactccttgtggaaaaattcaactgaacaaagagcagctgtgtaaaggaaaattattccaagaattcttcttcaatggtatatttggtagattatttcatggttcccgaacggatgaactgcaaagggaatttattttcacaaaaggtcatgaaatacaatggggctcagacaacatgtacttacttttgcctttgaggaactcttcacagatacaacatgatccaaacatatactgggaagccgttgagtcttgctctggtacagtagagcagttgagaaatttgtatctagaagatggaaatctcaaccatgaaaacttatgttcacataaaagaagcaacaagggagaagacatcattcatctggccaataaatctcttcatttttccacagtcaaagattcagttgtactatctcttcatactgggaggatctattctgttcttgacttgattttagataaaactgcagatgactcatttgatgagatgtataatgggaaagcttcaccatttgcttcatttgtggactactaccatcaaaagtatggtattgttattcaacatccagggcaacctttgttgctgttaaagcaaagtcacaatgcacacaacttacttttttcaaaaatgaagtaccaagatggttcaactggcaatcctctgctcgtagaaaaagagcaaattcatgcccgagttccacctgaactactcatccatattgatgtcgcaactgatattctcaaatcattttacttgctcccttctgtaatgcatcgggttcagtctttaatgttagccagccagcttcgcagcaacattagttacattcaacgcataccaagttctctgattttggaagctataacaactttaaggtgctgcgagtccttttctctggagcggttagagttattaggagactcagtactgaaatatgtaataggatgtgatctgttcctaagatacccaatgaaacatgaaggccatctctctgatatgagatccaaggcggtatgcaatgcgacactgcataaacatggaatatggcaatccctgcagggttatatacgtgatgctgcatttgaccctcgtcgttgggttgctcctggacagatatcattgcgcccttttccttgtaattgtggaatcgaaactgcatttgttccttttaatggaggttatatcagtgacgatccatcttttgttgtgggaaaaccatgtgacagaggccacagatggatgtgctcaaaaacagtatctgattgtgttgaagcactagttggagcatattatgttggtggtggcatcgctgctgcaatttgggttatgaggtggtttggtattgatgtcaggtgtgatatggaactagtgcagaaagcaaaatataattctaatgcatctcgaatgtgctatttatcaaaaataaaagatattgaggaactggaagcaaaactgaagtacaacttctcggtcaaaggccttctgcttgaagccatatcacatccatctgtacaggaattaggagttgactattgttaccagcgtctggaatttcttggtgattctgtgctggatctattaatcacacagcatctctatgctacccacactgatgttgatcctggagaattgacagacctgcgttccgcttcggttagtaatgagaattttgcacaagcagttgtaagaaacaatattcataatcatctacagcatggatctggaatacttttggaacaagtaacagaatatgtcaggtccaacttggagtaccatggtaaagagaatcaattccttcaacaagctacatgcaaagcacctaaggttcttggagacatcatggaaagtattactggtgcaatatttatagatgtaaattttgatgttgatctggtttggaagattgttgaaccgttactttctccaatgattacccctgataagcttgcgttgccaccttatcgggagttgctggagttatgtagtcaccttggttgcttcatagagtcaaaatgtactagtgaaggagaagagttaattattgagatgaaggtgcagttgcgagatgaacaactgatagcacaaggacatgacagaaatggtaaaaccgcaaaggcaaatgcagcagcccgaattttggtcgacatgaagaaacggggtctctctcttaaacaatgcatctcgaaggctaatcaattggatattgtctcttcaaaactgcaatcagaattgacaaatttggaatcgcgacatgattgtcctcacatgaatggcactcttagcctaggtctttcctcagcgagagcagcagttgttcttcctctcaaaatggacaaaggtggacctcggactgcactttttaggctatgcaagagtttacagtggccaattccagaatttgaatttgtggaacaaaggtttaggtat

SEQ ID NO: 650 - DNA, 3152 bp, Zea mays
agcagcagcagctaccgcatcccttgccatggcgccaagctccccgtcatccgctaggcccacgcgcgcctccggccggaagcgctccgccatggccgaggagatccaccagaaccaggaggaggaggaggaggttgtggctgcgtccaccgccaagcgcagacgcaaggcggcgtcttccgggaagaagcccaagccgacgcccaagcaggccaaaccggccgtggcggggatgaagaagaagggggagaccgagaagacggagcccgttgtggacgacgtgtgcgccgaggagcccgacgaggaggagttggccatgggcgaggaggaggcggaggccgaggagcaggccatgcaggaggtggtggccgcggtcgcggccgggtcgcccggtaagaagagggtggggagaaggagcgccgccgcctcgggcgaccacgtgcccgagttcatcggcagccccgttgctgcggccgaggcgcacagcaactggcccaagcgctacgagcgcagcactgccgcaaataaaccggaggaggacgatgagctcaaggccaggtgccactaccggagcgctaaggtggacaacattgtctactgcctcggggatgacgtttatgtcaaggctggagaaaatgaggctgattacattggtcgcattactgaattttttgagggcactgatcgatgccactattttacttgccgttggtttttccgtgcagaggacacggtcatcaattcgttggtgtcgattaatgttgatggccacaagcatgaccctagacgtgtttttctttccgaggaaaagaatgacaatgtgcttgattgcatcatctccaaggtcaagatagtccatgttgatccaaatatggatccaaaagctaaggcccaactgatagaacattgtgacctatactatgacatgtcttactctgttgcatattctacatttgctaatatctcatcagaaaatgggcagtcaggcagtgaaaccgcttcgggtatttcttctgatgatgcgggtttggagacgtcatctaatatgccagagaggacagcaacccttcttgacttgtattcgggctgtgggggcatgtccactggtctttgcttgggtgctgctctttctggcctgaaacttgaaactcgatgggctgttgatcttaacagttttgcgtgccaaagtttaaaatacaatcatccacagactgaggtgcgaaatgagaaagctgatgagtttcttgctctccttaaggaatgggcagtcttatgtgaaaaatatgttcatcaagacgtggattcgaatttagcaggttcagaggatcaagaggatgctgacactcttgacaaggatgaatttgttgtacagaagcttattggaatacgctatgatggcactggaaggaaaaaaggcgtatattttaaggtccaatgggaaggatatggtcctgaagaggatacatgggaacctattgataacctgagtgactgtccgctgaaaattagagaatttgtacaagaagggcgcaaaagaaaaattctcccgcttcctggtgatgttgatgtcatttgtggaggcccaccatgtcaaggtataagtgggtttaatcggttcaggaaccgtgatgagccacttaaagatgagaaaaacaagcaaatggtgactttcatggatattgtggcatacttgaagcccaagtatgttctcatggaaaatgtcgtggacatactgaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtgctccctaagtatcctctgcctacatatgacgttgtagtacgtggaggagcacctaatgccttttcgcaatgtatggttgcatatgatgagacacaaaggccatccctgaagaaagctttgcttcttggtgatgcattttcagatttaccaaaggtcgaaaaccatcaacctaacgatgtaatggagtatggtggttcccccaagacagagttccagcgctacattcgacttggtcgtaaagacatgttggattggtcgtttggtgaggaggctggtccagatgaaggcaagctcttggatcaccagcccttacggcttaacaatgatgattatgagcgggttaagcaaattcctgtcaagaagggagccaacttccgtgacctaaagggtgtcaaggttggagcaaataatgttgttgagtgggatccagaagtcgaacgtgtgtacctttcgtctgggaaaccactggttcctgactatgcgatgtcattcatcaagggcaaatcactcaagccattcgggcgcctgtggtgggacgagacggttcctacagttgtgaccagagcagagcctcataaccaggttatattgcatccgactcaagcaagagtcttgactatccgggagaacgcaaggttacagggcttccccgattactaccgattgtttggaccgatcaaggagaagtatattcaagtcgggaacgcagtggcagtccctgttgcacgggcactgggctactgtctgggtcaagcctacctgggtgaatctgacgggagtcagcctctgtaccagctgcctgcaagttttacctctgtggggcgaaccgcggttcaggcgaatgccgtttctgttggcactcctgcgggggaggtagtcgagcagtaaaaggatagcggagcaaccctggttggtattttgattcgagcccatccagtagcatgtttaccaataaataatcattggtcgtgctgattcttatggttggagatgaatgtatgtagggtgtactcgagctcgagtgcttgttgtactgtaggttgaggtttctcatccattggcctgcctatttgtggatgacgtttcatttcagattagcaatgtgcttatttaaggtttcgtcatgtacctgtattctacaatccactattgtttccaaagacagcatttgatccttgttcaacgcgagcagattttcgtccaccaaagctgtgtagggatcgaaatgtcaacaatgaattgagtcattcaatcatttgtctaa

SEQ ID NO: 651 - DNA, 4033 bp, Zea mays; identical to SEQ ID NO: 618

SEQ ID NO: 652 - DNA, 1658 bp, Zea mays; identical to SEQ ID NO: 619

SEQ ID NO: 653 - DNA, 1777 bp, Zea mays; identical to SEQ ID NO: 620

SEQ ID NO: 654 - DNA, 1308 bp, Zea mays
atggagaaacgcactagagttggtgtaggatctgagactggaactgttgtctactcttttggcggcaacaaggatgggcatcccttgcaaggggaatatgcctccttctccgatgacaacagtggtgggtggtgcctgagagacaaggttgttggatctagatgctggccattgatatcacggtacagagcatctgtgcgcacccagtctccaaaggtagagatgattgattctctatttaagccactggatgatgggaaggatgatggcataatgagggaacttctactagacttctaccaaaccagtcaacaaagaaagcctaagcagataatcatcttcagggatggtgttagcgagtctcagtttagccaagtactgaacgtagaacttaatcaaattataaaggcatatcagagtatgggacagggggaccttccgaagttcacagtgatcattgctcaaaagaatcaccacacaaaactcttccaagctgattcaccagagaacgttccacctgggactgttgtggactccggcatagttcatccaagacagtatgatttctacatgtgtgctcatgccggaccaattggtacttcaaggccaacccattaccatgtgttgcttgatgagattggcttctctgcagataatctccagaagctagttctttcactttcatatgtgtaccagaggagcaccactgcgatttctgtggtggcacctatctgttatgcccacctcgcagcagctcagatgggccagttcatgaaatttgaagagtttgcagatacgtcgtcagggagtgtcaattcatcatcgccaccatcaataccagaattgccacggctgcatgctgatgtctgcagttccatgttcttctgttgacgtgattttagtttgaccgttgtggggtagggccaattctttgtgaaaggaaccttaccttatatgttggcacacagcaggctaaccgtttttgtgaagaaaccatgtaggtcgttagttgtcgtatatcgcacgcgtgcatctttttggagcggttttcggctccccccacccacaggtggcggttccgttaggtacagtttccagattttaacgatgctaatacagtaaaagcagtttgtacattctacgcagattttgcagggatacgtggttagatgatctttttgttatgcccagaaatacgtgtgcattggggggttatgaaagtgagctaaatttctgtgcctcgcatggcatccaattgtactcggagattgtgtttgtgctcgatacgcttcctgccactgaaatgcg

SEQ ID NO: 655 - DNA, 3326 bp, Zea mays
ttttttttcatttttttttaccttgcgtgacgcttcgttttcacagtgcggcggcggcggctgcttggctcgttgctcctcccattctgctcagctcagcttctgatgagttcgcctttgccgctgctagttaccagcatactagaccactgactgatcacgttataaggcttccgcgcaggcgagcttctgccgccttgtcgggtaaccaaacggacctcgccggccctctccagtggtcacatcacatcacatcacatgctcgaggtcgtcctggacatgacgccgccgccgccgccgccgcaggcgcggctccaccaggggtcatcagccaagggcgggcacgcggagcggaggaagcaaccgctgcagagcagcgtgacacagcccaaggcagagcccgcggcggcggcggccgtgctgccggtgccggagggaggcaagaggtgcagagggggcgggaggcgccgcggcagggccaaggcgcccggtgagcctcgcgccgcgctactagcgccagcgcaggcgcagacgcaggcgcctccgccgcgcacggtcattgggccgcccgtgccgagcaaggggctgtcattctgccgccggccagggttcgggacggtgggcgcgcgctgcgtcgtcaaggccaaccacttcctcgccgagctcccggacaaggacctcacccagtacgatgtgaagatcacgccggaggtgagctcgcggaccgtgaaccgggccataatggcggagctggtccgcctctaccgcgcgtccgacctggggatgcgactcccggcctacgacggccgcaagaacctctacaccgccgggacactaccgttcgacgctcgcgagttcgtcgtgcgcctcgccgatgaggacgacggctccggcgtcccgcctcgggagagggagtacagggtcgccatcaagttcgccgcgcgcgccgacctccaccacctcaggcagttcatcgccgggcggcaggcggacgcgccgcaggaggccctacaggtactcgacatcgtgctccgcgagctcgccaaccagaggtacgtgtccatagggcggtccttctactcgccggacatcaggaagccgcagcggctcggcgacggcctgcagtcgtggcgtgggttctaccagagcatccggccgacccagatgggattgtcgcttaacatcgacatgtcgtccacggcatttattgaacccctgccggtgatcgagttcgtggcccagatattaggaaaggatgtcatatcaaggccattgtccgatgctaaccgaatcaagatcaagaaggcattgcggggtgtaaaagttgaggtcactcaccgggggaatgtacggcgcaagtatcgcatttcaggcctcacaacacagccaactcatgaattgattttcccgattgatgaacaaatgaatatgaaatctgtcgtggaatacttcaaggaaatgtatggtttcaccattcagcatcctcatcttccctgccttcaggttggaaaccaaaagaaggcaaactatctacccatggaggcctgcaagatcattgaaggccagagatacacaaagaggctgaatgaaaaacagatcacatcgctgctaaaggttacatgccaaaggcctagagagcaagagatggatattctacagacagttcatcaaaatgattatgagcaagatccatatgcgaaggaatttgggatcaacattagtgagaagctaacctctgttgaagcccgagtccttcctgcaccttggttgaagtatcatgacactggaaaagagaaagagtgcttaccacaggttggtcagtggaacatggtaaacaagaaagtgataaatggatgcaaggtgagccattgggcatgtataaacttctcaaggagtgttccagaaaccacagctcggggattttgccaggaattggcacaaatgtgtcaaatttcgggcatggaatttaacagtgagcctgtgatgccaatatattcagctagaccagatcaagttgtgaaggcacttaaaaacgtgtataatattgcattgaacaaacttaagggtaaagatcttgaacttcttttggctatcctccctgacaacaatgggcagttatatggtgacatcaaacgtatttgtgaaactgatttggggttgatatcacaatgttgcttaaccaagcatgtttttaagatcagcaagcagtacttggcaaatgtctcactgaaaattaatgttaagatgggaggaagaaacactgtgctcctggacgcaataagttggaggattccgttggtcagtgacatcccaactattatatttggtgcagatgtaacacatcctgaaaccggggaggactcaagtccatcgattgctgccgttgttgcttctcaagattggccagaagttacaaagtatgctggattggtttgtgctcaggcacaccggcaagagctcattcaagacctttacaaaacatggcacgatcctcagagaggcactgtaacaggcggcatgatcagggagctcttaatatccttcaggaaggccactggacagaagccattgagaataatattctacagggacggtgttagtgaaggtcagttctatcaagttctcctttacgagttagatgccatccggaaggcatgtgcatccctagaaccaaattaccagcctcctgtaacatttgtggtggttcaaaaacgtcatcatacaagactatttgcaaataatcacaaagacagaagtagcatggacaagagtggaaatattttgccaggaaccgttgttgattctaagatatgccacccaacggagtttgatttctacctctgtagtcatgctggaatccagggaacgagtaggcctgctcactaccatgtcctctgggatgagaacaatttcacagcagacgaaatgcagacattgacaaacaacctttgctacacttatgcccggtgcacacgctcggtttctgttgtccctcctgcatactacgcacacttggcagcattccgggctcggttctacatggaaccagagatgttggacaaccagacgtccaagacctccaatggcacgagcggagtctcggtgaagcccctgcctgctgtgaaggagaaggtgaaaaggatgatgttctactgctgacaaggagaccacttaaccactcacatgctgtagctaacttgctagagtttagtaaggattagatagctttctcaaggagtgatggatcaatctgatctgttaacgacctctgtaaagtactcggaaatggctgtataatagttgttgtttcaaatgtgaaagcatct

SEQ ID NO: 656 - DNA, 2955 bp, Zea mays
atggcgccgccgccaccaccgccgccgccgccgccgcatgcgcggcaccatcagggggcagccaagggcggccacgcggagcggaggaagcaaccgctgcagagcagcgtgacgcagcccaaggcggaaccggcggcggcggcggcggcggccgtgctgccggagggaggcaagaggtgcggaggaggcggcgggaggcgccgcggcgggcgcggccgggccaaggcaccacctggtgagcctcgcgtcgcgctagcgctggcgcctccgccgcgcacggtcattggcccgcccgtgccgagcaaggggctgtcgttctgccgccgccccggattcgggaccgtgggcgcgcgctgcgtcgtcaaggccaaccacttcctcgccgagctcccggacaaggacctcatccagtatgatgtgaagatcacgccggaggtgagctcgcggaccgtgaaccgggccataatggctgagctggtccgcctctaccgctcgtccgacctggggatgcggctcccggcctacgacggccgcaagaatctctacaccgccgggaccctcccgttcgacgctcgcgagttcgtcgtgcggctcaccgatgaggacgacggcaccggcgtcccgcctcgggagagggagtacagggtcgccatcaagttcgccgcgcgcgccgacctccaccacctcaggcagttcatcgccggacggcaggcggacgcgccgcaggaagccctacaggtactcgacatcgtgctccgcgagctcgccaaccagaggtacgtgtccatagggcggtccttctactcgccggacatcaggaagccgcagcggctcggcgacggcctgcagtcatggtgtgggttctaccagagcatccggccgacccagatgggattgtcactcaacatcggtgagctgtgcgggctggggaatatttcttgccctcatgcatgtgattcctttcttttttgtcctgtggctgccgcttacatggccatgttgacggcagacatgtcgtccacggcgtttattgaacccctgccggtgatcgagttcgtggcccagatattaggaaaggatgtcatatcaaggccattggccgatgctaaccgaatcaagatcaagaaggcattacggggcgtaaaagttgaggtcacgcaccgggggaatgtaaggcgcaagtatcgcatatctgggctcacaacacagccaactcatgaactgattttcccaattgatgaacaaatgaatatgaaatctgtcgtggagtacttcaaggaaatgtatggtttcaccattcagcatcctcatcttccttgccttcaggttggaaaccaaaagaaggcgaactatttaccaatggaggcctgcaagatcgttgaaggccagagatacacgaagaggttgaatgaaaaacagatcacatcgttgctaaagattattctttattttcagacagttcatcaaaatggatatgagcaagatccatatgcgaaggaatttgggatcaacattagtgagaagctaacctatgttgaagcccgagtccttcctgcaccttggctgaagtatcatgacactggaaaagagaaagagtgcttaccacaggttggtcagtggaacatggtaaacaagaaagtgataaacggatgcaaggtgagccactgggcatgtataaacttctcaaggagtgttccagaagccacagctcggggattttgccaggaattggcacaaatgtgtcaaatttcgggcatggaatttaacagtgagcccgtgatgccaatatattcagctagaccagatcaagtagtgaaggcacttaaaagtgtgtataatattgcactgaacaaactcaagggtaaagaacttgaacttcttctggctatactccccgacaacaatggtccgttatatggtgacatcaaacgtatttgtgaaactgatttgggattgatatcacaatgttgcttaaccaagcatgtttttaagatcagcaaacagtacttggcaaatgtctcactgaaaattaatgttaagatgggaggaagaaacactgtgctcctggacgcaataagttggagcattcctttggtcagtgacatcccaactattatatttggtgcagatgtaacacaccctgaaaccggggaggactcaagtccatcaatcgctgccgttgttgcttctcaagattggccagaagttacaaagtatgctggattggtttgtgctcaggcacaccggcaagagctcattcaggacctttacaaaacatggcacgatcctcagagaggcactgtaacaggcggcatgatcagggagctgttaatatccttcaggaaggccactgggcagaagccattgagaataatattctacagggacggtgttagtgaaggccagttctatcaagttctcctttacgagttagatgccatccgtaaggcatgcgcatccctagaaccaaattaccagcctcctgtaacatttgtggtggttcaaaaacgtcatcatacgagactatttacaaacaatcacaaagacagaagtagcatggacaagagtggaaatattttgccaggaactgttgttgattctaagatatgccacccaacagagtttgatttctacctctgtagtcatgctggaatccagggaacaagtaggcccgctcactaccatgtcctctgggatgagaacaatttcacagcagacgaaatgcaaacactgacaaacaacctttgctacacttatgcccggtgcacacgctcggtttctgttgtccctcctgcatactacgcacacctggcagcattccgggcgcggttctacatggaaccagagatgtcggagaaccagacgtcgaagagctccaatggcacgaacggaggcttggtgaagcccctgcctgctgtgaaggagaaggtgaaaagggtgatgttctactgctga

SEQ ID NO: 657 - DNA, 3162 bp, Zea mays
gcaaaaccccaagcctccttcctacgatggcctctcgtgggcgcggtggtggcggagggaaaggccctagcggtgggcggggcggtgaaggcagggggcgggggatccgtggcgggggaggttaccatcacggcgacgatggaggcggcgaacgcggaggcagaggcgacccgggccgagggcgcggggtcggcggtcgtggccgcggtcccggaggccgaggtgtcgacgaccaccagcagcagccgccgccgctcgggaacacagagggcggaggccagggccgcggcggcatggcggtagcggtaccgccagcccgccccgccgcgccctgtcctctagcgccggacgccgctgccccggcatttcccgcagcagcggcctcgtcttctgcgcaagcgcctcgagcccccaccgaggcggctggagctgccttggcggatggcatggggaagttggccgtggcggacgaccggcccgctgctcctcccgtgcccgcaggtaaacccgtcgcgcaaggtcccgcgcaccagccccaggaggctccgccactctcgaggaagaggatcgtgccgccgccccgccccggtttaggcacgtctgggagaaagctggcggttcgcgcgaaccacttctttgtcgaggtgtccgtgaacgacatcttccattacgacgttttaatcaatcctgaaccaaaagcaagaaaaaccaacaggatgctgctctcagagcttgtcaagatacatggcgcgacatctctcgcccacaagacacctgcatatgatggaagcaagagcctgtacactgcaggcgagctgccgttcaaatcaatggagtttgttgtcaagttggggaaggcgggccgagaagttgactacaaggtgacaatccgatacgcggcacggcctaacgtgtaccaacttaagcaattgatcaattctcagctaaggaacacgccatttgacgcaatccaagcactggatgttgtcttgagagagtcgccttctctcaactatgtaactctttctcgatccttcttctccaagaagttcggtgatgacgacattggcggtgggctagagtgctggagaggatattaccagagcttgcgtccaactcaaatgggcctctcattgaacattgatacatgctcgacttcattttaccaacctatcgatgtggtaaaatttgttgccgattgtctccagctgacaaaccctggccaaccttttttggacagggatcgtttaaagcttaagagagccctgcgcggagttcttgttgagactgaacaccagcagggaaagagaagcatctacaggataactgggattacttctgttccattggctcaactgagcttttcttgtaacgaaggccctcagctgactgttgttgagtactttgcacaacggtacaatgtccagctgcgctacactgcttggccctgcctgcagtcgggcaatgattctaagccgatatatttaccaatggaggtgtgcaaaatcattgaagggcagaagtaccctaggaagctcagcgacacacaggtggccaacatactgaaggcaacctgtaaacgtcctcaggatagggaggagaacattattaagatggttcgccacaacaactattctgctgataagatggcacaggtgtttgggatcactgtggccaaccagatggctaatgtgcaagcccgtgttctgcctccacctatgctgaaataccacgaatctggaaaggagaaaaccgttgcaccaagcttggggcaatggaatatgattaacaagaaaatggtcaatggtggaaccattcacagctggacttgtctgagcttttcgcggatcccgcttcgtttggtagacgaaatatgccatgaattggttcaaaagtgcaattccattggcatgagtttcaatccaaggccggtgacagaagttcagaaagactcacacaacaacatagaagctgctttaagggatgttcacaggagggctccgaatctgcagctgcttattgtgattcttccagatgttactggttattatggggaaattaagaggatgtgcgagactgaccttggtatagtatctcagtgcatcaatccgaagaagaatagaaacaagcagtattttgaaaatcttgcccttaaaatcaatgtgaaggctggagggcgcaatacagtgcttgagagagcctctgtgcctaatgggataccttttgtctcagatgtgccaacaatcatttttggtgctgatgttacccatcctacagcaggagaagaatcctcggcttctgttggagctgtggttgcatccatggactggccacaggtcacaacatataaagctctggtctcggcacaagcacacagggaagagattatacaaaatctcggcggaatgataagggagttgctgatttcgttctataagaggactggcaaaaagcccaaaaggattatattttacagggatggaataagtgaaggacaattcaaccatgttttgctccttgaaatggacgcgataaggaaggcttgtgcctctctggaagatgggtatctacccccagtgacatttgtcgtaatacagaaaaggcaccacacaaggctcttccctggagttcatggaaggagagatgttactgacagaagtgggaacattcttcctggaactgtggttgataccgagatttgtcatccgcgggagtttgatttctacctttgtagccatgctggaattcagggaaccagcaggccaatacactatcatgtcctctacgatgaaaaccgtttctcggctgatgggctgcagatactcacaaacagcctgtgctacacatacgcacgatgcacgcgcgctgtctcagttgttccaccagcctactacgctcacctggcagcattccgcgggaggtactacgacgaacaaggtagcagccccgcccccgatggaacctcagttgtcggtggcgatgccgctgcagccggtgatgatccacctgcgtgccgcaggctcccccagatcaaggagaatgtgaaggaagtgatgttcttctgctagttgctcagcgcgagctgcatgtcttgattcaggctgcctcaatatacaagaggccttttttttgtgataaactggtatcgatggttgtcctgac

SEQ ID NO: 658 - DNA, 2826 bp, Zea mays
atggcttaccgcggcggcggcggccggggaggaggaggccgcgacggggaccagcagcgcccgccgcacgtccacggacgaggagccggggggcccggaggcggccgcaccttcgtctggcctccaccgccttcttccacgccgcggccggtgccgccgtaccaccaccaccaccaccaccaggtgcccatgggctaccgcgcgcccatagtgctgccgcaccaggccgcgtacggggtgccgatggccgtgtaccggggggcgccggcgcccgcgtacagggtgcccgcgccagcgtcccctcggcctcgcgtctccttctcgcctgcgcctccggcgtctccggtcactatcagggcgccgccgccatcaccgacgacgccgccagctgctcccaccactccggcgcctccacgccagcccgcgcccgcgcccgcgcccgagccggccccggccccgccccccgcgccgtcgctcgcggccctggcgaaggaggtcgagaagaagctcttcgtctccgagaccgcgctggcgccggccgcggcggcggcagcggcagcggcagcgcagggcacagctggtgccggcgctgacgacgcggcgtcggacgtcgacctggcgccggtctccaagaaggggctcgcgcacccggctcggccggccctcgccaccgtggggaggaatgtgtttgtccgcgcgaaccacttcctcgtccacgtcgccgacaacaacttgttccactatgatgtcgctattaatcccgagtcaaagtcaagagcaacgaacagggaagttctcaatgaactcatcaagttgcacgggaagacatctctgggcggcaaattgcctgcctatgatggcaggaagagtctctatactgctggttcacttccttttgaatcagaggagtttgtggttactcttgttgatcctgaaaagaaggagaaagaaagttatgtcacagtgtccagatcctttttctctacaacttttggtcacagaggtgatatcggtgaggggcttgagtgttggaggggttactaccaaagcctgcgcccaacacaaatgggcctttcgctgaatatagatatttcagcaacatccttttttaagcctgtgacaattatcaaatttgtggaggagttcctgaacctgcgtgatacatctcggccgttgtttgacagagatcgtgtgaagataaagaaagcattgcgcggtgtccgaattgaaacaactcaccaacaggaccaaatcagaagatacaagataacagggattactcccatccctatgagccagctgatattccctgttgatgataaaggaacaagaaagactgtagtgcagtacttcttggacaaatatgactacagattgaagtatgtctcttggccttgccttcaggctggcagtgattcacgacctgtatatttgcctatggaggtttgcaagattgtagaagggcagagatactctaagaagcttaatgacagacaagtgacgaacatacttagagcaacttgtaaacgtccccaggagagagagaagagcatacgtgatatggttctgcataacaagtatgcagatgataagtttgctcaggagtttggcatcgaagttagcagtgatctagtgactgttccagcccgtgtgctgcctccacccctgttgaaatatcatgactctggtagggagaaaacttgtgcaccaagtgttggacaatggaacatgatcaataagaaaatgatcaatggtggaactattgataactggacttgtttgaacttttcacgcatgcgccctgatgaggtacaaaggttctgtatggatctgactcatatgtgcaatgccactggaatggttgtcaatccacgcccatttattgaagtccggtctgctgctcctaaccatatagagaatgctttgagagatgtacacaagagagccacccaaatacttgcccaacaagcagtgggaaatcagctccagcttttgattgtaattcttcctgaagttagtggttcttatggtaaaattaaaagagtctgtgagactgacattggaattgtatctcaatgttgcttgccaaagcatgctagcaggccaaacaagcaatatttggaaaatgttgcactcaaaatcaatgtcaaggtggtggcatcaatggactggcctgaaatcaccaagtacagaggtctggtttctgctcaaccacaccgacaagagataatagaagatttatttactgtcagtaaagatccacagatggggcacaacgttaatggtggcatgatcagggacggtgtaagtgaaggtcaattcagccatgttctccttcatgaaatggatgctatcagaaagaaaaggcatcacacaaggcttttccctgaggttcacggaaggcgtgatatgactgataaaagtggaaacattcttcctggaactgtggttgaccaaatgatttgccaccctactgagtttgatttctacttgtgtagtcatgctggcattcagggaacaagtcgcccgacccattaccatgtgctctatgatgagaacgaatttactgctgatgcactgcagtcactgaccaacaatctttgctacacctatgctcgttgcacccgtgctgtatcagtggtcccaccagcgtactacgcccaccttgccgcattccgcgcacgctactatgtggaaggagaaagctcagacggtggctcgacacctggcagcagcgggcagacagtagcccgtgaggggcctgtcgaggtgcgtcaacttcccaagatcaaggacaacgtgaaggacgttatgttctactgctga

SEQ ID NO: 659 - DNA, 4671 bp, Zea mays
gtctagagatgagctacgtcttgtctatggtgtttctgagcgtacagaaagcgatggtgcagctaatttaattcagaagttgagagctataaactatgctctgggtgaactaggacagtggtgtgcttacaaggttgcactgtcattcttgacagcactacagaatgatgaaagggccaactatcaggttgatgttaagtttcaagagtcatacttgagaaaggtagttgatttgttacactgccagttgactgaaggggctgcaatgaaaagtgacagtaatgatgttgaaatgcataattctgaaaaccccaagccaaatgaacttgaggagggagagctacctgacagtcatggtgaacatgtagatgaagtcattggtgccgcagtggccgatggaaaagttaccccaagggtgcaagctttgataaaaatacttctcaagtatcagcacactgaggattttcgtgctatcatatttgtagagcgagtggttacagcattagtcctccctaaggtctttgcagaacttccatcgttgggctttatacggtgtgcaagcttgataggtcataacaataaccaggagatgcggtcgtgccaaatgcaggatacaatcacaaaatttcgtgatggccgtgttacactgttagttgcaactagtgttgcagaggaaggacttgatattaggcagtgcaatgttgtcattcgctttgaccttgcaaagactgttttggcctacattcagtctcggggtcgtgctagaaagcctggatctgactacatattgatgcttgaaagaggaaatatgtctcatgaagctttcttgagaaatgctcggaatagtgaagagacattgagaaaagaagctattgagagaactgatctcagtcatctcgatggcacttctatgctaagccctgttgatatatcacctgattctatgtatcaggttgaatcaacaggtgccgttgtcagtctgaactctgcagttggactcgtacatttttactgctcacagctgccgagtgacagatactctattcttcgaccggaatttattatgcaaaagcatgagaaaccagggggttcaacagaatattcttgcaaacttcaactcccttgtaatgccccattcgagaaacttgaaggtcctatatgcagttcaatacgcctggcccaacaagctgtttgtttagctgcttgtaagaagctacatgagatgggtgccttcacagatatgcttttacctgacagaggaagtggggaaggagaaaagactgaacaaaatgatgaaggtgatccactgcctggaacagcacgccatagagagttctttcctgaaggggttgctgaaattctacatggagaatggattttatctggaagagatggttaccaaagttcacagtttattaagttatatttgtattctgtgaactgtgtaaacattgggacttcaaaggaccctttcgttacacaactttcaaattttgctcttatttttggcaatgagctggatgcagaggttttatcgacgacgatggatctctttgttgctaggacaataataacaaaggcatctctcgtattccgtggaccaattgaaattacagaaagtcagctgatcctgcttaagagctttcatgttaggctcatgagcattgtacttgatgttgatgttgatccctcaacaactccttgggatccagcaaaagcatacctctttgttcctgtgggagctgagaaatgtatggatcttttaagagagatagattggactctagttaatagcattgtgaattctgatgcctggaacaaccctcttcagagggcacgcccagatgtctatctaggcacgaacgaaaggacacttggaggggataggagggaatatgggttcgggaagttgcgccatggaactgcatttggacagaaagcccaccctacgtatggtatcagaggagccatcgctgaattcgatgttgtcaaagcgtctggattagttcctggtcgtggatggggacattttaatgattatcaaaataaaggcaagttgttcatggcagattcatgttgggatgccaaagatcttgctggaatggttgtaactgccgcccactcaggaaaaaggttctatgtggacagtatttgctataatatgaatgcagaaaattctttccctaggaaagagggctatctgggtcccttggaatacagctcgtttgctgattactacaagcagaagtatggtgtggagttagtttataagaaacaacctcttatacgggcacgcggtgtttcatactgcaaaaatctactttctcctagatttgagcattctgaagctagcaatggagagttctcagagaatcttgacaagacatactatgtatatttaccacccgaattgtgccttgtgcatcctctccccggatcacttgttcgtggagctcagaggttaccctcaataatgagaagggtggagagcatgcttcttgcaattcaactgaaggacataattgggtatccagttcctgcaaataagatattagaagccttgactgctgcgtcatgccaggagacattctgctatgaaagagcagagctgctgggtgatgcatacttgaaatgggttgtgagtagattccttttcctaaaatatcctcaaaagcatgagggacagctcacaaggatgcggcagcagatggttagcaacatgatcctgtatcaatacgccctgaataaaaacctccaatcttatatccaagcagatcgatttgctccatcaagatgggcagctccaggagtgttacctgtatttgatgaagaaacgagagattctgaaccatccatctttgatgaggaatttactcctagcagtgagttacaaaagaacttgtatgatgactatgatggcgatagcatgcaagaagacggtgaaattgagggagattctagctgctatcgtgttctatcaagcaaaacattagcagatgttgtggaagcacttattggtgtctattatgtagctggagggaaaattgctacaaaccatctgatgaaatggatcggtattaatgcagagttggatcctcaagagatcccatcttcgaagccatataacatacctgagagcataattaaaagcatcaattttgacacattagagggtgcattgggtatcaagtttcagaataaaggcttacttgttgaagctataacacatgcatcaagaccatcatcaggtgtttcctgttaccagcgcctggaatttgttggtgatgctgtattggaccatctcattacgaagcacttattttttacttatacggacctacctccaggccgcttgactgacttgagagctgcagctgttaataatgagaactttgcaagggttgcagttaaacataagctacatgtacatcttcgccatggatcatctgcattggagacacagattcgagagtttgtgaaggatgtccaggaggagctttcgaaaccaggtttcaattcttttggccttggggattgtaaggctccaaaggttctcggagacatttttgagtctattgctggcgcaatattccttgatagtgggtgtgctacctccgtagtctggaaggtttttcagcctctgcttgatccaatggtgacgccggacacccttccgatgcaccctgtaagggagctccaagagcgctgccagcagcaagccgaaggattagaatacaaagcatcccgtacaggcaatgtagctacagttgaagtcttggttgatggcatacagattggtgtagctcagaacccacagaagaagatggcacaaaagttggcggctagaaatgcacttgttgtcttgaaagagaaggaaaccgcagcaaagaaagacactgaaaaggatggcgagaagaaaaacggttctcagttcactaggcagactctgaacgacatctgcttgagaaggcaatggccgatgccacagtacaggtgtataaacgagggtggccctgcccatgccaaaagatttgtttatgcggtaagggtaaatacatctgacagtggatggactgacgagtgcattggagagccaatgccgagtgtgaaaaaggccaaggactctgcagctgttcttctgctcgagctgctgaatcgaaattaccgtggcaagcctgatggaaaataatctttggtgatgttctgtggtggtaggtagacgtggaagcatccatcattctgattatacccccatgcagtgcttttcagcaaagcaaattaatggcctttgttgatgttcttggtggcggtattggtgatatggaggcattcaatgcaagcataagcagagctatggggagtgggattagaggattattattagttttgtctgaggtgactactaggtattttactggcgaggtactgaggtcacaactcacaaatagcagttgcaaattgcaatagaggaaatgatgataggttgatataggatattggaggcctcttattcatcgattgtataagatgtttacagaacagtgcattgatccattaaatttatattgattgatatttttatagtggatgcgcctgcagctgggaactcggggttctctatcttggcctcgccgaccaaatatcacgtacgtcgacgtccgcgaacagtat

SEQ ID NO: 660 - DNA, 1727 bp, Zea mays
accttttcttcttaatataatgatatgcagctctcctgtgttttcgaaaaaaaatattcaaaacccaactacaaaccaagaaatttcaatgttttagctgtaacaattttaaaataagtttctgccttcaattctattgtcatcattctggttgttttctctttggtttcttgagcaggttggaggaaaacatgaagtgcattgtttttgtgaaaagaatcattgtcgcaagagtagtagttcaaattctccaaaatctgaagtgccttgatttttggagatgtgagtttcttgtgggatgccactcggggttaaggaatatgtcaagggataagatgagttctatcattgaaaagttctcttcgggtgaggtaaaccttttggttgctactagtgtaggtgaggagggacttgatattcagacttgctgccttgttgtgcggtttgatctccctgaaactgttaatagctttatccaatcaagggggcgtgcccggatgagtaaatcgaaatatgtttttctcttggagaggggaaatcattctcaggagaagttacttgatgattatattactggtgaaatcattatggataaagagattaacttgagaacatcaaatgatatgttcaattgccttgaggagaacatctatcgagtcaatgatactggtgcttccattagcactgcttgcagtgtatctctattacatcgctactgtgataaccttcctagagatattttttttgttccttccccatcattcttctttgttgatgacgtcgatggaatagtatgcaaattaattcttccaccaaatgctgctttccgtcaagtgaatggtcaaccctgtccatcgaaagatgaagctaagagagatgcatgcttgaaagcatgcatcaaacttcatgaactcggtgctttgacagattttcttctacctggccaaggctctagaaagattaaggtatcaacaacaaataattcagaaagcaacaaagacgatgatgaaagttttagggaagagctttatgagatgttaatccctgcagttctgagaccttcaagatgcaaactagactcctcgtttaagttgcatttctattacatagaatttattcccataccagcagatagacgatatcagatgtttggtctttttgtgatcaatcgccttccagaggaatctgaaaagttggatgttgaattgcatcttgctcgtgcgaggattgtgaaagcaggaattaaatatttgggaaagattgagtttaacaaagaagagatgatactcgcacacaattttcaagaaatgtttttgaaagttctcctggatagatctgagttcacaccatcttatattttgttggggaatgatggtgcattggacatggattcaacattttaccttttacttcccatcaagcagaaattctatggtgataatatgattgattggccagcagtaaagcggtgtttatcatcacctgcatttcaagatccaatgggtttgtctctgcatgattcatatttaccaaatgagtctttgaagcttcttggtggaacatacaacaaagctgatgtgattggcagtttggtctatactccccacaccgacctgtttttcttcgttgatgccattctggatggaacaaatgctaaaagtgagttgaacggtgcaacgtatgcagaacattttaaacaaaggcacggtgtacggacatttttctga

SEQ ID NO: 661 - DNA, 3402 bp, Zea mays
aagcctgcacagttgggaacgcctgatttccctgtgcccgcgtatgcaggcaagaggccgctttttcactatttggggccagcatatgagagctattcgagcatccaaacaaccttgtttgcactaccagagactgttcacggagttgtgcagcgtaccaaacgcacccataaactcggtttttccatgttccaggttcaggcagctcctaaaatttataaactgctcccaggccgtccaggtcttatgtttgaggatcctttcttcaactggtttagggatgacacagatgaacaatggaccaggacaattgattttactccatcagctagcatcgggcaatcatctattttatgtctggaggtgccacaacagtgtgagcttccaagaattggcgactactttgtttactataaagagcagaatcttgactttgaatgtcggaatgggtattcatattcctgtggtagcaaccttgtaccaattgtgaaatctcctgattacatagaggtcccttatgagatactcttcaaaatcaaccatttggttcagaatgggacactcagtgggccaacagttgatcatagtttcttccgtcatgttagcccaaaatttgaacctattgatcatataaaacgagcacttttaaagatgacatatttgaaaagcacctgcttgaacccaacagattggttatctgtgcaatactccagaatacggaaatcacgccatgcatcacaaaagttatctaatatatctctggatgatggcttggtctatgtccacagggtgcaagttacccctgctaaagtgtatttttatggacctgagataaatgtctccaatcgcgttgtgcggcatttctctgcagacatagataacttccttcggatttcatttgttgatgaagactgtgagaagctccgttcagctgatttgtcacctcgatctacttctggaaatgatgcaaggagaactgctctgtataatagagttttgtcagtcctttcaaatggcatcaatattggtgacaagcactttgagtttcttgccttttcttcaagtcagcttcgagataactctgcatggatgtttgcttctcggcagggattgactgcgagcgacataaggaagtggatgggggactttcgagatatcagaaatgtggcaaagtatgctgcaagacttgggcaatctttcagttcctcaacagaaactttaaaagtacacaaatctgaggtggaacgaattcctgatattacaaatggcacaaagtacatattctctgatggagttggaaagatctcagctaattttgcagtggaggtggctatgaagtgcaaattgaaacgctttgctccttctgtttttcagataaggtatggcggttacaaaggtgttgtcgctgtagatacaagatcaaatcataagctttctttgagaaaaagcatgtcaaagttccagtcagaaaatatcactcttgatgtccttgcatacagcaagtaccaaccatgcttcctgaatcggcagttgattactcttctctcaacacttggggttagcgataatgtctttgagctaaagcagaaggaagccttaaggcagttgaacagaatggtaactgaaccacaggctgctcgtgaagcagttgaacttatgcccatgggagaagtaaccaatgtagttaaagaattgttgtcatgtggctaccagcctgatcatgagccatatctttccatgctgctacaaacttttagagcatccaagcttctagagttgaaaacaaagtcaaggatattcatcacacaggggcgagcaatgatgggttgcctggatgaaacctgcacacttaagtacggccaggtattcgtccaagcttcttacagtgcagatgaccatcgcaaggtcgttgtaactggaaaagtagttgtcgccaaaaatccttgtctccaccctggtgacatacgggttctccaggctgttgatgttcctgctctgcaccacttgtttgactgtgttgtctttccacagcagggaccaaggccgcaccctaacgagtgttcagggagtgatcttgatggggacatatattttgtttcttgggatccacatcttattccgagtcgtttggtggatcctatggactatactccagcttcagcagaaacattagaccatgatgtcactattgaggagatacaggagtacttcacaaactacatagttaatgagagtcttgggattatcgccaatgcgcatgtggtctttgcagatcaggaacgtatgaaggctgagagtccaccgtgcgttcaactggccaagctcttctctatagctgtcgatttcccaaagactggagtgccggctctgattccacatgagctacatgtcaaggagtatcctgacttcatggagaaactcgacaaagtcacctatgaatcaaagggtgtgatcgggaagctctatagggaaataaagaagcacacaccacacataaagcacttcacgagggaagtggcaaggcggtcttatgacaccgatttgattgttgatggctatgaagattacattactgaggctatagagttcaaggaagagtacgatttcaggctgggtaatcttatggaccactatggcataaaaagtgaagctgagataataagtggatgtattctaaagatggcaaagaatttcaccaagagtagtgatgctgatgcaattagaatggcggtgagatctttgaggaaagaagctaggtcgtggttcaatgagatgagcacaggagaggatggccaagatgccatggaggccaaggcctctgcttggtaccatgttacttatcatcagcagtactggggcagctacaatgaagggtatgatcggccgcatcttattagcttcccatggtgcgtatatgacaagcttgtggccatcaagcaggggaggaatctcctcacgcggatggatcgaaacttgaggttccgttgagcattgccagcaggtttgctcctgtacatatccctgatcgtttgcactcagcactgccagcaagtgtgcatgaacgatctgatgaattaagacgggcaaactgccgcaagctgacgctctggcctacgtgcgtcttgaaactttcggatgctgccgtctaactaaatgcatgttccttgatttccactgggaccttgagtttgaagtgtgtaaatatgctgcttatgatgtttttagtattggacctctatcaactgccgttctagttagtaacaatggttgccagtcatggattaccaggtttcgccgagctcctgtatggacgaccacgaaggtctatttcttccattaccaagtgcgaagtgtcacatctaacttgcgtagttgcattcaccttttttctcaaaaaaaaaa

SEQ ID NO: 662 - DNA, 9490 bp, Zea mays
caatttgccctttcttaatagtggattttccaaaaacaatatgactcggccttcatggctgatcttcagcgttatcgttgtcactttcaacatcaaaacttttgctctcacttgagtctccaaacaacacaactagcatctcattagtaatattctcaacattggtcctttccatggcttcgtagaaaccagcatgtgtggggtccacgctcttcttcttttcgaccatttcagcgttgattacagcaagaatccaaagctcaaaaacaatcgcggttgcagagttagaaagctaaaacaataactcagcacaaagcttgatagcgcgaaaaatatctttcaacccgaagcctcatatatatatatatatatataatatacacacacacacgcaaaacaccactgagcggtggggcccacagtgcagaatgtttcgctattctagcgaaaggaaggtgtttttttggaccttcggctaaaggccttcgtttatttcaagtttggatttgttacaaagaaacaaactaatacgacaggggctactgttgggggtcttcttctcccgaaggtcctaaaaaataagactaaccatttgctttcagcatactattgaatattacaggagtttcgtcgccagagcttcgacataacacaagaggagcgaagcaagcttcatccaacaggcttcatcacggtgaaacgggtatacaacgtggcttcggtataactcaaaggaagtataacgaagcacacttcatcaagcaggcttcgtcataacgaaacaatgagatgcaaggagaaggtgttactcaagttattaaatacaactgacgacattgcccttatgacatattgtaaactctgtatgtaattattgagggtataaatgtaatagcgtacgaacccttgcgattgtctataaatagatgaacattaccccgtactattcacgttggattgtaatcgctctcgcgtcaacaccttcaaacaagccgaagatatcactgcaatataaattttgataatgtttatatatttatcatggaataaatatatgactggatatcacactcatgtatttaaatccttattgatataaatgatgaggatgtgttattcacgacctttgtctgaagattattatatccgaaaggagatattttttcgaaggacgaatgttcttaacatttaataactgtgttaccttgttcttgaacatgtgacaaacattaggttttgagtatttcaattaatagtgaaattaaattaaattttagttgtccaaaatgacagacttcgatatttgttataattgttgagttaaattttaacagcatccataaacaagtaaacaacgactatgtgtgcaccagtgtctcctgtatcaacggggtggtccgtctggaggaggtaccgaggtcccgccgttcgagagacgagctacgcatttaagccggggaggtcggagcagtgagtgggagtagttcagggactgggagaggagaggaagcaggacctgggagacctcgcctcgtccgtcctcctgcctacttccttgcttttggtaagtgaaagtgattgaagtggagatgcctccaatctgcagtgctgtttcacgcgtaaaccctggccccctcgccgctggaagcccccattgttcctctttcatttcttaccgctgatgcagcttatggtttcctagggttttcgagatatttggtttcttgcatccagaggacgaagagctttcatagggttttcgagacattgtcctcacaatcgcatccattttgcagtgctgtttcacgcgtaaaccctagcccctcgccgctggaagcctccattgttcctctttcatttcttaccgctgatgcagcttatggtttcttagggttttcgagacatttggcttcttgcatccagaggacgaagagctttcctagggttttcgagacattgtcctcacattcgcagatttggttcgagacatttgttttttaggggttcacatgtttctgggtgcttttgcagcgatgcgattcatctcacaggggatggggattcctacattaccgtgcctttttttggggaaaaatgcccactttttgtgtaacaaaaacataaaaacgagccttgcagctgcgatgtctgctgctcaggtggtttctcaagaacaaatttttttaacaaaaaaagcctttcttttttcttactctcttggaaagaaggtacatggagccaatccgttaggtcgctaacttcaccaaaggatttcattttccgtacctaaaccttgtttcaacaaaatgctgcctttggccgggggcatctgattgtcattttagtctgttgattcttcaagtcaatattacgctcattttattcaatgtttcccgacagccaactacacttgtatttctttgttagtaacgtcccgcgcttgagtccttgtgatctgcacagtatgatgctgccaccaaatgcatgcagttagacaagcttaatgttgcatctgataagactgtacaacagattcgtgtgccaaatgtgtccttgctactcaaggaggtcatatggaacaagtaaaacgaaatttctgcatcagcaatcaggcacaagactgaatgacgtggttagtgccaatgaggtggggacttgggaatggaattagagttatagctattcctataattcatctcactacagaggctctccatcctactaggactgtacaacagattcgtgtgccaaatgtgtccttgctactcaaggaggtcatatggaacaagtaaaacaaaatttctgcatcagcaatcaggcacaagactgaatgacgtggttagtgccaatgaggtgggaacttgggaatggaattagagttatagctattctatagctattcctataattcatctcactacagaggctctccatcctactagaatttaatctgataaagtaggcagaaacatggaacttataatgtcgaagattgcatgtatagaatctaagtaacggaaagattcaactttgtgattatatgctgctgttacatggtattggtaaaacattctttcaagtgctcattgtcttcccttgcaaccaattcattgttgtccttgtttccttgcaggtaggtgctgcttgttttatcttgaaatgggctctcatgatggcgaggatgaagagttgccacccccccctccggtgccaccagatgtgattcccattaaagctgaagatgctgtgggtgaatcaccagcaaaccatatattaaagccaaagagattactgatggacaggcctggtataggaagaaaagggcagccgacccagctctattcaaatcactttaaagtcgctgtgaagagtacagaagacgtcttctttcactactatgtatgtctgctgactgagttcatgatcctttgttcaaaatatgtcattgtctgtcccttgtttataactaatctttggctgatgtgatattgttattttatttgactaggtaaacctgaagtatgaggatgatcgacccgttgatggtaaagggatcggcagaaaggtgattgataaactgcagcagacatatcgtgcagagctttctaacaaggactttgcatatgatggagaaaagagcctgtttacagttggtggtcttccacaaaaaaagaatgagttcaccgttgtcttggaggacgtatctactggaaagttagttttagtctttgatctgctttcttgttgtttatgcttacccagaatcagtaattgccatgttttttgtttgtggttgtaggactgctgccaatgggagccctggaggtaatgacagtcctggaggtggtgataggaagagagtgaggaggccataccagacgaaaactttcaaagtggagataaattttgcagcagaggttcctatgagtgctattggtcaagtcattagaggcgaagaatctgagaactccctggaggcgcttcgtgttcttgatatcatactgaggcagcattccgcagaacagtatgtagctatgcatcttgatggatgattataggtagatttgaggatcttctgcagttacgacatgacaatttttctcaatacttgcagaggctgccttttggttaagcaatcatttttctacaacaacccttcatgctttgttgacttgggtggtggtgtgatgggttgtcgtggatttcattcaagcttccgtggcacacagagtggactttccctcaatgttggtgcgtgttcgtcctgtatggctgtattggtgccatgtaactgcattgtctattctataatcttacatctttcatgatcatgatagcctttttttttgaaatccacagatgtctcaacaacaatgatcgtgaaacctggccctgttattgattttcttctttctaaccagaatgttaatgatcctagcagaattgattggcaaaaggtaaatgccatctttggatgaaacttctcgaataaccatgctagtgcattgaaatatctattttgatagaatgataacacaattttggggtgtgcatattcaatacaggccaagcgtgctctcaagggcttgaggattagaaccactcctgcaaattcagaattcaagatttttggtctcagcgagaggatctgcaaagaacaaacgtgtggacatgttttcttaccgctctgtttattgtcatgcaagctttactttacatttttaaaaaattgtaccctagtgtgttaagcttgtttcagaagaattttatttaacaaatattgcctttattgattttgttctgattccaatgccaagcttgcttgatggtgatatctgtgtgcttaattgctttctcattgacatatgcaattaggtttccgctgaggcagagaaatggtagcaacggagattgtgataccattgaaataactgtctatgactactatgcaaagaaaggaatcgatctaaagtattctggtgatttcccctgtataaatacagggaaggcaaagcgcccaacatattttccaatcgaggtttgtttcagttttgttagttacatcctgtcaaatctctgtttattaaatatatcttgcatctcatattcgatgggcaggcttggtggggctgtctcactgagtcactaggtcgtgggttcaaagcagcctctccacatttgtgggggggggaaggcttgcttcggtttatcccttccttagaccctaggtctgcccctttttttgcatctcatttttttgtattgtgtttctagctatgctcgcttgttccgcttcaaagatacaccaaagctttgtctacgctacaaaggtcatcccttgtggagaagtctagacagaagcctgaagaaaggatgaccgttctaaatgatgtgagctgttaccttgattttagcatgctgcgaccattcataactgcatgggatttatttctacgactgaattaatcaacagcttatgattaccctaaatgctaggcactgcaacgcagtaactacgattctgaccccatgttgagggcatgtggtgtttcagttgctccaaaatttacccaagttgaaggaaggatccttcaagccccaaaggttggtgacacttctctaagctttacgacaagtttgcatggaaatctaaaatttggatcatggataaaaataatctctggtgtttattggattctgtgcttgttagagaatcctagggtgtttggatggaattctaggatttaaagatttttttcctatcctgattgttaatatctctatggatccaaacgctcccttagttgttttctctctaaatgttgtaccaagtcattatctcagtaaaatgcatctgactaaatctaatatcttgtagctgaaagccggcaatggtgatgatatcttttcacgaaatggacggtggaatttcactaatagggtcagcagctcaacatgtttcttttttaaccttctttagttctttattaggaaggatttttctgatgtttatttgccaatactttgcccctttcagaagttttatgaaacctgctctgtgaataagtgggcggtcgttaatttctctgcacgttgtgatgttcggaatcttatccgtgacctgatgaggaatgcatctgcaaagggaattgtatggtttagcttttcacatatcttctattgtagcagttttctgctgctgacgttttcttctggcagcaaatggaggaaccttttgatgtgtttgaagagagtccctctatgaggcgtgcacctgtgtcaagaagggtggatgatatgtttgggcagataaaatcaaaacttcctggagctcctaggttcctcttgtgccttctccctgagaggaaaaattgtgaaatctatggttggtttattttttgttaccactccacataaatatctcacatcttgcaataattatacctttttggtttcaaccaggtccttggaagagaaagtgcctggccgagtttggtattgtcacacagtgtctagctccattaagagtcaatgatccgtacctgcttaatttgctgatgaagatcaatgcaaaggtttgggacatgattttgtctttcttttgcactgtattgttccctggttcatgattatattatcctctttcctctgtttttaactagcttggtggtctgaactcgttgctgcaagttgaagcatcttcgtcaataccacatgtgtcgcaagtacccaccatcatcttaggtatggatgtttcacatggtcatccaggacaagatagaccttcggttgcagcggtaagatgggtgtacctttacttgtacaattcttctgcccacatggaatctgagtggttttgtaaaatatgtgaaatggatgtctgttaatctgatgtaaaccatacctttcttctttgtttaggtggttagttctcgtcaatggcctcttatctctagatatagagcatcagtgcacacccaatctgccagactagaaatgatgtcctcgttgtttaagccgcggggtactgatgatgatggcctcatccggtaagagatatcttcttagtatgttgatgtatggtaagcgtgatgacttttggatgctaagtttatcttcgtatttgggacttccagggaatcactgatcgacttctacactagctctggaaagcgaaaaccagaacacataattattttcaggtctgaagctttggggttattgttagcttgtatcactaaatctttttgtagaaacaaattcttttttttgtttttgttttgagaagtatgtatggtacattctttgctgggatggattattgatactttcttagccgccgtggcgtaaatgtaaccatttgctgggttttagggatggagtcagtgaaagtcagtttacccaggtcatcaacattgagctggatcagatcatcgaggtaatacatttgtttgattcgtcctttgcacatttgcttgcttagttcaggaacgaattgcaaggtaacacatccttgtaattaatgcaggcatgtaagtttctggatgagaagtggtcacccaagttcactgtgattgttgctcaaaagaaccaccacaccaagttctttcagacggcatcaccagacaatgttcttcctggtaatatgtttatttttgtcatactaaagggagtgtggtgagatgcggtgacaataataaatgtgtttgtttgttacgcaggaactgtggtggatagtaaagtttgccatcctaagaacttcgacttctacatgtgtgcacatgctgggatgattgtgagttgatctcagaattgagcaaaaagatgctgctgtcttgttcttgtctctgaatcctagatggttcttcgtctcagggaacaacaaggccgacccactatcatgttctgcacgacgagataggtttcagtgccgacgagatgcaggagtttgttcattcgctctcttacgtgtaagtagtagtagtaaaatgctgttttggctgtgtgtgtgtgtgtgtgttttgtgcttacgctgcgtgtcctgctgtgcaggtaccagaggagcacgacagccatctcagtgggtaggccgcttgaatctaaagccatcttgtgcagcacagggacagcaggttgatttttttctagtgtctgtttttgtgtttgcagttgctccagtgtgctacgcccacctcgctgcagcccaggtgagcacgttcctgagattggaggagatgtcagacgcgtcctccagccagggaggagggcatacctcggctggcagtgctcctgtgccggagctgcctcgcctgcatgacaaagtcaggagctccatgttcttctgctagctgatgtgcgtgcgcatcaggatcgagctccatgttttgtgttagtaaggcctagttagtaaggctgtagaaagaatgtttaatgtttgcatgctaaagtccaaacaatcaaaaccactactatatctaccagagcactgatcgatcaaacaacaagagtcagcatcaatcaatcaaaaccaccactattctatctaccgatcaatctactctatacctgaagcactcactcgctcgcaaacaaccaagggatcatggatccttgagtagctccattgtccagtccctgaccttgacgaagcatttcatggacagcctctcgtacgccatctcgtacatccggaggttcatgtaggcgaagctcaagtaggtggcgatgcactcttggtgcctgtggtacagcgccgggatggtcagagcggccaccacacttgcgtagcaggcggtcgggaaatctgtaacgctgccgacgatggacacgctccacaggcagaggaaggctctgtagaagagcagcgagtccctgcccagagcgatgtcccggaaagcgtccgaggcggcgtccagagcagagcgcagcagcgccgccgcctcgtccacggcctgctgcggaacgcgcagctccgggacgggaggctgcggcctgttcaggaggcgcgccgctttggcccacaggaagagcacggtgaggagcaggagcagcacgttggaggcgagggacaccaaggtgtagccgccgtacaagagcagccaggaggagacggtgcccgccagcaggcaggcgctcacgtcggcgcggccccggcgccacagcagcacgtcccagactgctgcagcaatccgatccgattccgatccagatatattagttagtagatccaatctcgggcggccaatccgtaataataattggctgagagaaaaggtgggagagagtaccgaatcctccgacggcacatgtcccggcgccgccgccgccgccgccaacaccaacaccagcatccaccaccatcgtcgtagttaatactaagggaagggaactagagaaggaagggaggggccgatgcaacggaagaaatggatggaattcgaccaacagctagctagagcgaagcagaacccaatcccaatcaaaacccgag

SEQ ID NO: 663 - DNA, 9490 bp, Zea mays; identical to SEQ ID NO: 662

SEQ ID NO: 664 - DNA, 9490 bp, Zea mays; identical to SEQ ID NO: 662

SEQ ID NO: 665 - DNA, 12819 bp, Zea mays
  misc_feature (721)..(820): n is a, c, g, or t
  misc_feature (7091)..(7190): n is a, c, g, or t
gcattttagccattccatgtctttaactctgttccctttttgcttgcaggggttgcctattagtaaggcaatcattcttccacaacaatccttccaattttgttgacctgggtggtggtgtagtgggctgtagaggttttcattctagttttcgagcaacccagagtggacttttcactcaatatcggtctgttttcatatatatgccctgttttaatctatacaatacaatgttcatctctctaggctgttggtaatgtctgcgtgtattaaaataacctcgtctgtgcagatgtgtcgactacaatgatagtgaaacctggtcctgtcattgattttctgcttgacaatcagaaagttggtgatccaagcatgattgattgggctaaggtaatgctttatgccaatgcatcaaatggtatagagataaaggttgggttccatttcatgaaactttagatgtacagttttgcaatttgctttacttctgcaggccaagcgtgcaatgaagaacttgaggataaaaataagtccagcgtacctagaacagaagattattctttcaatctaatttgttgtggaataggattgaaagagctgaccaaatatgggcacccaaacgaagattcgaccaggaatcaagaagtgcgaccccggcatataatacgatggcgtctctccgctctcacaaacacatctcctgtgactataacggaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgtgtatgtatttgcactttgttttgttctctaagttccttttgagttatgcatcttagttttatatatacagcttctaagtacttggtgattttcttgcttatgtagattcacactgaaacataaaaatggtaacaatggtgactctgaagagatcactgtttatgattacttcgtaaagcagcgtggcatagtgctgcaatactctggtgatcttccttgcatcaatgtgggaaaactaaagcggccaacatattttccaattgaggtaactattatttgaatcctaatgttgttccttcgatgtaaatctctttccccctgctaatgttgtgaagattgtttccatgtttaccagttatgcagtcttgtgcctttacaaagatacactaaagctttgaacacacttcagaggtcatcactcgtggagaaatctaggcagaaaccgcaggaaaggatgtctgttttatctgatgtgagtgtattttttggtttaaatcttagcatttttttctcgaacatgcaggaaagctgcgtatcattatattaagaagagaaagaaagagagctgcgtagcatttttcttgttagtaatgtaaccttagcaagcggggttattggtaggtatggtttccttaacttgttcttttttccatgtcaaattgagtaggtgctgcaaagaagcaactatgatgcagagcccatgttgaaggcatgcgggattacaattgctagaaatttcacagaagttgatggtagggtattgcagccacctaaggttggtcattactatttgtcctatattattttagatatcctgaggatagttgtgataggcttggcgagtcaacgttaaacctagccattctaatagagatgaaatccaaaaaaatatgtttggcgatgtgtcatcataacacgggtatggtgttaaatcgacaaccccttggtggcatgccatgtcataatttggcatggtgtaaagtgagcaaggattaggttattacttaggggcatgctacatcggcgctcgcttgtaatgaaaaatgtgcaagagtcttcacaccatcgatgggtgcgaagggtatggaagctagtcgaaccaactaggattcgtttaggtagctaggaatgtagggtcgcttacaggtaagttaaaggagttagtgcagagatcgactaggagacatgtaatgtaaatatcttatgtgtccaagagattaaatggaagagtcagaaggcaaaggatgtggacaatactagcttcaagctttgatgcaatggtaactgtaaatagaaatgaagtaggagttttgattgataagaactccaagaatggtgtggtggatgtgaggaggcaaggagattggattatcttagtcaagtttgtcgtgggtgatttgatcttgagtgtaattgtctgtatgcccccaaagtaggccatgatgagtgtaattggcttttctagaagacttatatggcatggttatacatactactgagaagctttttagagctttgaatgagcatgtagctataagtgcaggtttcgaggcagtccatggtggtattggagtatggtaataggaattagtagggagaggaagtcttggacttcatgatagcttttgatatgttgataaccaacactttcttttggaagagagactcccatttagtgacctaaagtagtggcaaacactctagtcagattgactttcttcttacaagaagagagaataaacgagcatgcttggattgtgtgcccttgtggtggcattcttttgtttataggtgtgtcgtgtaggggtagggatgaaagcggtcggaaatggttggtaaatgttaaaataatttccattttcatattttttatcggaaacgaaacaaaaaaggtaactcccgctccctctccatgggccatgaccacggcgtgaaacaggagccgaactaatggggcttgcacattttcactagaccaccacgagctgtggagctgatacagtttacagtgtgcggcatgagtttaatcccatatcgcttgttttggacgagtgaagtcaggcaaactctataaaagaagactataggcgccaagtgaactcacttatttagtgccttttggctgagagcctaagactgcgactagtacatggtcttatcagtttaatataactaatttaatatttaatatttgggttatgtgttcttcaataaatttatttttatagggctgtttggcttcatggccttgatttattttcggtaacattctgaatttttttctggtaaattccgattaaaatcggtaatcgaaggaaacaattgctagaatgatgtaccaattttgataccgtttccaattttttttccgatatcgattctgttttagaaaaatacctttactggtgaattcaatcgggaaaaatcgaaaacggtaaccagaatttcgataaattccgaaaccgttttcatccctatgtaggggtaaacagtactagattgtgagaacgaagtggcggaaactaaagggaggtaagacagtattcaaggaaagggccattaaatggtgcgtttagaagaaagatgacacaaaaatattggagaagatgtcaacatgcattcggaaggtggctttagaggtgtatggagcaattaaagggagtggagtttgaagttaaaggttggtggtggaatgagagtccaaagggctattaaggagaagaaagaatgctacaaacgcctgtaccatgtcgggattgtggacaacatagagaagtacaaggtagcaaagaaggttgcgaatagagctacaagtgtggcaaagagttgggcgtttgagaatttttaataacgtttgagtatgaaggaaggcgagggtggcatatttaggatggctagggttcgtgagaggaagacatgagacttcaactaagttaagtgcattaaggatgaaacagaacacctcttggtgaaggaggatgagatcaaacatagataattatagtattttgataaattgttcaatggggagaaaaaggacaactcttttgatgacaccaatatgcactttttgcgtagcatccaagaatctaaggttcgagagacattgaaaacgatgaaagggggtaaggcgatgtgccattatggtatcctaattgaggaatggagatgccttggttacataactacattatgcctaatcaagttgttcaaccatgtctttcggtcgaacaagatgcctgacaagtgaagtatattggtattgatatacaagaataagggagatatttgaagttgtacagattaccagggaattaagctgatgagcccgactatgaagctattggagagagttattgagcattgtttaagaggaataataagaatctatttgaaccaatttggtttcatgcttagaaagtcaatcgtggaagtcattttcttaataagacaagtgatggagcagtatatagagcagcagaagtacctacacgtggttttcattgacttggagaaggcttatgacaaaataccagataatgttatgtggtgggctttggacaaacaaaagtttcaatgaagtacattggactcattaaatacatatacaacaatgttgtgactagtgtttgaacaagtgacgaggacacaaatgactttacgattagaataggactacatcaaggattaggatttgagccctcacctttttgccttggtgatggataagttcacaagggacaaaggggatgccccttggtgtatgctttctgcagagtgcagacgatgtagtgctagttgatgaaagacatgcatgggtaaatagaaaactagagttgggacgttagacttgttactaaccttgattaggcgagataatcacccccacgggtactgtagcatatatataggcatataggcagacaatatgggccttatgggccttaacaccccctgtcaaactcaaggcggaagtggaggatttgaagcattgagtttgattagatgaaactgatgttgtgccctagtttgtgcttttgtgaagaaatccgcaagctgtaattctgagggcacatattgaagatcaatggtcttctgatgacaatgagatctagtgaatgagacatcaacaccaatgtgttttgtgagttcacgcttcactggatcatgacaaatttgtatagctccagtgttgtcacagcgaagaagtgtaggcgagtcacaagaaacgcctagatcagccaagagccaacgaatccagataatctcagcagtagtagtagccagggttcgaagttctgcttcagtactagatctagatacaacagcttgcttcttggatttccaagcaataggggatgatccaagaagaatacagtaaccagtgatggagcgacgatctgtaggatcactgacccaggtagcatcagagtaagcgtgaagctgagtggggaatttgagtcataaaataaacattgtgtttttgtcccccgtaaatatctaagcacacgaagtaagtgcccataatgaactgatgtaggagcagagacaaactgactcaagatctgaaccgcatgagcaatatctggcctggtgacagtaagataaactaagctgccaacaagatgtctatatcgagatggatcctccaaaggtgtcccatcagtcggacgaagagataaatgtagatccataggcgtggcaacagtgcgagtatcactaagaccagaacgatcaagaagatcttgtatgtacttggcctgagaaagataaataccattttgagtctgcaaaacctcaatgcccaagaaataactgagtgcccccaaagtcagacatttgaaattccttactcagagacgccttcacatgagcaatatggtctggatcatcgcctgtaatcaacatgtcatcaacatatagtaataacaacgtgcgtcctcgtgaagaaacatgaatggacaatgcaggatcatgatcactagaatagaaaccacaagccttgatgacagaaacaaatctctcaaaccaagcacgaggagcttgtttgagaccatacaaggctcgacggagacgacatacatgccctgatggaacctctatcccaggaggtggatgcatatagacttcctcatgtaaatcaccatgaagaaaagcatttttgacatccatctgagagatagtccaagaagatgaggctgcaacagcaagtaaagctaggacagtagtcagatgggccacaggtgcaaaagtctcatcatagtcaataccctgtgtctgttgaaaacctctggccacaagacgagctttatatcgctcaatagacccatcagatttggttttaaccttgaatacccatttgcacgtgataggtacaacaccagcaggtaacggaacatcccatgtacatgtgcgatgaagggcatttaattcatcagtcatagcaagctgccactcaggtataccagacgcctctttataagatgatggttcagcaatgactgcaccagcacgggaaaacccataacgttctggagctgcaatagtgccacggtcacgaagatgatacccctgattaaaaacaacatgagagtcatcattgttagtacaagtatcagcaacaggatcgtcatcaggactggccgtgggagtagagcgaggacgacgaatgtaagtctgagtgacaggtggtttggaagagtaagacggagatgttgtggaagtggaaggtggtgtgatgggaataaggacatctggggtagaaacagtaggtggtgatacttatgaagtttcagaaatgggaggaaggctcatgaaggaggtagactctgtggaataaaaagaagaatgagtggaagagttgtaaaagaagggacaattttcattgaagctcacatctcgagaaatacgcatgcgacgagaagatgaatcataacatcgatagcctttatgttcagggctatatccaagaaaaacacactcaacagattgagcagtcaatttagtacgttcacgaggtgataatagtacataacacgtacatccaaaaactcgaaaggtggtcatatcgtggaggagttccgaaaagaacttcaccaggtgttttgccagagagtttggatgacggttgtctattgatgaggtaaaccgcagtagaaactgcttcaccccaaaaatgtgacgggacaaaagaagatatcaacaaagtgcgagcagtttctataatgtgacgatgtttgcgttcatccacatcgttctgtgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaagtgagcaagggtaccttttgaagtcaaaaactggcggaaattatcagataaatattcaccaccagaatcagaacgaaaggttttaatgtgagtggaaaattgagtgtgaatcatacgagcaaaggttttataaatagaaatcagctcagagcggcgtttcatgaaataaatccaagtgtagcgagaatgatcatcaataaaaataacatagtatttatatccaccttttgacacaaaaggtgcaggaccccaaatatcagagtgaaccaaatcaaagggttgaacagaatgagaatgactagtaaaatatggaagttgtatttgttttccaagatgacaacccttacaatgaaaatcagactcaaccgaagtatgacctaagcaacctgactttattagagtagacaatctagatccacacaaatgacctagacgatgatgccactgggcaaaagacgcaacagaagcaagggtagctgaaagcacatgcgctggagatgtagtcaaggaaggaagccgcaaagagtccaagatgtagaggcgaggagcagctctacggcgacggccagtcccaatcacttcccctgtacgaaggtcctgtacaaaacaagatgagtcatcaaatccgacaaagcaattatgatccgtaatttggcctactaaaagaaggtccatagatagctcaggaacaaagaaaatattaggtactgtaaagtgtggatctgaaagataacccttatgagtaatgtggcatacaataccatcagctgtctgcactgaagcaccatctgtgacaggtgtagtagaagccaactttgactgatcagatgtgacatgaaaggaagctcctaaatcaagtacccaggccgactctgaagtacaagcggatgaagtggcagcaacagcaactgagcctctattagatggtcctggaccacgaccacgagcagcacatcgtgcacggaaatcagtcaacttatcagggaacttgacaaagcaaaagctcagatcgatgattggtcttgccacaatgatcacaaggcttaaaaaatattcttagggtttctgggcaacaacccaacacactgtgaggattaccaccagtagaggacagagaattaagacgagtctcttcagccaagtaaagcagacaactgcagaggtgcggcagaaatcgacgacgcagatccggttccgcagcccttgcggcgtgcagcagacagcaactacagaggtgcggcagggcgcagaagccagcaggcgggttgaggtagtgcgacgcagcagacaaataggcaacatgtgggcggcggctgaggcagggcgcagtgcggcgcagcaggcaacagcaggtggacggcggctgaggcagggcgcagtgcggcgcagcaggcagcaggcgggcgcgcagcaggcagcaggcggacgacacaagagctcagatccgcggcccgcgggactgaaggaaaaccgcgacggcgcggcagaggaagcggggaaaccgcgacggcggctgcggatggcgaatggaggccgcccagatccgccgcgacggcggcagaggaagcagaaccgcgacggcggctgaggatggaaccgcgacggcggtaggtcggaccgtagaaggctggccgcgatgggcggacggcgcagcagcgacgcgacggcgccaaagaaaattgatgagggacggattagatgtaaaccctaaccctaacctcctctgataccatgttactaaccttgattaggcgagataatcacccccacgggtactgtagcatatatataggcatataggcagacaatatgggccttatgggccttaacaagactcagagtccaaatattttaggctcactaaaactaagaccgaatgtatgagatgtgattttggcactactacacatgaaggagatgctagtttgtcactactacacatgaaggagatgctagtttgtaaggtcaagtagttctcaggaaggacacctataggtatttaaggttaacactacaaagagatgaatatgttagccatagaatcaaaatagggtggatgaagtggtgtcaagcatatgccgttttctatgacaagaggatactagaaaagtttttttttatgggatgacgattaggcttgctatgttgcatggtgcagaagttggcctacaaaaagatgacatgttcaacagataagtgttgcagaaatgagtatttcgtgttggatttgtggccatacaagaagggatcttgtccggaacgatgatatatgtgataggtttagggggtagcataacaccgattgaagaaaaacttgttcaacaatggttgatatgttttggacgaagacctctagatactagtactagtgagatcctaaggcacagtagtaaaccctaaacccttggaatagaggaagaccgaagttgacatggacagagagtaaaaggagacttgaaaggatgaaatataccagaaggtttagcctaggagtgtaggcaaaatagctaaaaaggagatttgaaaggatgaaatataaccgaaggtttagcctaggagtgttgggaaatagctatccatgtgcccgaaccttgacttgtggattatgttggggtttaactgtagtctacccaacttgcttgggactaaaattttttgctgttatcctttgtggtgatggaatttcgaaaggcacaaatcttgaatctgtcttctcgttcatcttacagctgggaatggtgaagacatttttacacgcaatggtagatggaacttcaacaataaggtcagcatgtataacatattcttgtttatgtgtaaatggattttcatgatttcacctgtaatatttggaattctgttattcagaggctcattagagcttgtagtgtcgagaaatgggcggtggtaaacttttctgcacgatgcaatgtcagggatcttgtccgggatctcatcaagtgtggaggcatgaagggcattgtaagttgttttctcattatgttgcattttccccacatgttctaattcatgtgtttggtattgcatttctacatgttcttattcacttgtttggtattgcagatggttgatgctccttttgctgtatttgatgagaatccttcaatgagacggtcacctgctataagaagggttgaagacatgtttgaacaagtgaaaactaagcttcctggagcaccaaagtttcttttgtgtgttctagctgaaaggaagaattctgatatttatggttggttaatactactaaatctatgttaaactctggtgcattttactttcggctgtagcattttgccattgacctctacagggccttggaagaagaaatgccttgctgaatttgggatcgttacacaatgtgtggcaccaactagagtgaacgaccagtatcttacaaatgtcctacttaagataaatgcaaaggtctgtttctctgtcttgagatttgagagcatggctagatttgtatatggcaattaaatattttgatatttttttctttttcaaacagctgggtggcatgaattcgttgctccaaattgaaacatccccagcaattcctcttgtatccaaggtcccaactataatcttgggaatggatgtgtcacacggttctcctggacattctgatgtaccatctattgctgctgtaagtatatttttcgtaattttctgtgatatttaataaacagtagctactgtgacagttttattttgttttacttaggttgttagttctcgtgaatggcctcttatctcgaaatacagagcttctgtccgcacccaatcacctaaaatggaaatgattgactcattgtttaagccacgggaagctgaagatgatggtctgatccggtaagagatcttaacctgcattacatttgttaagttatgtacttagacatgatttctcccattacctgttggattttgatgtttctttagggagtgtctgattgacttctacaccagttctgggaagagaaagcctgaccaagttatcatattcaggtttgttattttttatgcatctgagttagttaacttctttgcgtccaagtaactgtttggtcgataaaattggttgtctatctctcgtttcctctgttttgttataagcacaaagctgatttgtgtctaattatagggacggtgttagcgaaagtcagtttaatcaggtgctgaacattgagttgcaacaaatcatcgaggtatttttttctttttgttagcaactgtatgtgcacgctctattggttgtgttgtcatggttccttttatccaagtatcctgtactgtgtggttgtccacattaacatggtcctattacctcttcaggcttgcaaatttcttgatgagaaatggaatcccaagttcacgttgattattgcccagaagaatcatcacactaaatttttcattcctggaaagccagataatgtcccaccaggtaatcttcatcacctgccagcctgcagtggcaaccgtgtaggctcaatttttggcgaccttgttatattctctaatattctcgatggctttacctgcaggaactgtggtggacaacaaagtctgccatccaaagaacttcgatttctacatgtgtgcgcatgctggaatgatcgtaagcatcatctgcctttggatttggtctgtggtcatgtgtcattttgggactgtcagtttgccctgaaatgagaaatgtcctgcatttataaccccccgcacaaaagcaactgtgttcagatttaaattgctccagtggatggcaaaatgctggaatgattgcatgttttttttttgccaggggactacgaggccaactcactaccacatcctgcatgatgagataggcttcagtcctgatgatctgcaggagctggtgcattcgctctcttatgtgtaagtaccaagcagaagctcttgtcttgttaagaaagttgcttgctcacaagcgattttctgggactttatttcaggtaccaaaggagcacaacagccatatcagtcggtaagttaccttcatttctgtgtcaaaccgttaacaccacccccagcagcgggaagtgatttcccttgtttgcctttctgcagttgctcccatctgctacgcacatctggcagctgctcaggttggccagttcataaagttcgatgagatgtcggagacgtcctccagtcatggcgggcatacttcggcgggcagcgttccggtccaggagctgccgcgcctgcatgagaaagtgaggagctcgatgttcttttgctgagccgtggttttacttttttggtggatggtgaacccctctagttatgtcggtagacgctcttggatgacgctctagttgtggtccaggaaggctcgagctggtacgatgttaaatgttagttttttaagcgtcgctgcggctatgttggtgcctcaggaagacttggaacctggttaggatgtcgttaaatctaccccttatcgttcctggttcgttgggctgttgttcttattgtccgtcctggtgtctgatttctgctttgttgcatgcaagtgtgaggcccagcttgatattgaaaagtttggcgtacatgtcgttcatttggcactc

SEQ ID NO: 666 - DNA, 12825 bp, Zea mays
  misc_feature (721)..(820): n is a, c, g, or t
  misc_feature (7091)..(7190): n is a, c, g, or t
gcattttagccattccatgtctttaactctgttccctttttgcttgcaggggttgcctattagtaaggcaatcattcttccacaacaatccttccaattttgttgacctgggtggtggtgtagtgggctgtagaggttttcattctagttttcgagcaacccagagtggacttttcactcaatatcggtctgttttcatatatatgccctgttttaatctatacaatacaatgttcatctctctaggctgttggtaatgtctgcgtgtattaaaataacctcgtctgtgcagatgtgtcgactacaatgatagtgaaacctggtcctgtcattgattttctgcttgacaatcagaaagttggtgatccaagcatgattgattgggctaaggtaatgctttatgccaatgcatcaaatggtatagagataaaggttgggttccatttcatgaaactttagatgtacagttttgcaatttgctttacttctgcaggccaagcgtgcaatgaagaacttgaggataaaaataagtccagcgtacctagaacagaagattattctttcaatctaatttgttgtggaataggattgaaagagctgaccaaatatgggcacccaaacgaagattcgaccaggaatcaagaagtgcgaccccggcatataatacgatggcgtctctccgctctcacaaacacatctcctgtgactataacggaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgtgtatgtatttgcactttgttttgttctctaagttccttttgagttatgcatcttagttttatatatacagcttctaagtacttggtgattttcttgcttatgtagattcacactgaaacataaaaatggtaacaatggtgactctgaagagatcactgtttatgattacttcgtaaagcagcgtggcatagtgctgcaatactctggtgatcttccttgcatcaatgtgggaaaactaaagcggccaacatattttccaattgaggtaactattatttgaatcctaatgttgttccttcgatgtaaatctctttccccctgctaatgttgtgaagattgtttccatgtttaccagttatgcagtcttgtgcctttacaaagatacactaaagctttgaacacacttcagaggtcatcactcgtggagaaatctaggcagaaaccgcaggaaaggatgtctgttttatctgatgtgagtgtattttttggtttaaatcttagcatttttttctcgaacatgcaggaaagctgcgtatcattatattaagaagagaaagaaagagagctgcgtagcatttttcttgttagtaatgtaaccttagcaagcggggttattggtaggtatggtttccttaacttgttcttttttccatgtcaaattgagtaggtgctgcaaagaagcaactatgatgcagagcccatgttgaaggcatgcgggattacaattgctagaaatttcacagaagttgatggtagggtattgcagccacctaaggttggtcattactatttgtcctatattattttagatatcctgaggatagttgtgataggcttggcgagtcaacgttaaacctagccattctaatagagatgaaatccaaaaaaatatgtttggcgatgtgtcatcataacacgggtatggtgttaaatcgacaaccccttggtggcatgccatgtcataatttggcatggtgtaaagtgagcaaggattaggttattacttaggggcatgctacatcggcgctcgcttgtaatgaaaaatgtgcaagagtcttcacaccatcgatgggtgcgaagggtatggaagctagtcgaaccaactaggattcgtttaggtagctaggaatgtagggtcgcttacaggtaagttaaaggagttagtgcagagatcgactaggagacatgtaatgtaaatatcttatgtgtccaagagattaaatggaagagtcagaaggcaaaggatgtggacaatactagcttcaagctttgatgcaatggtaactgtaaatagaaatgaagtaggagttttgattgataagaactccaagaatggtgtggtggatgtgaggaggcaaggagattggattatcttagtcaagtttgtcgtgggtgatttgatcttgagtgtaattgtctgtatgcccccaaagtaggccatgatgagtgtaattggcttttctagaagacttatatggcatggttatacatactactgagaagctttttagagctttgaatgagcatgtagctataagtgcaggtttcgaggcagtccatggtggtattggagtatggtaataggaattagtagggagaggaagtcttggacttcatgatagcttttgatatgttgataaccaacactttcttttggaagagagactcccatttagtgacctaaagtagtggcaaacactctagtcagattgactttcttcttacaagaagagagaataaacgagcatgcttggattgtgtgcccttgtggtggcattcttttgtttataggtgtgtcgtgtaggggtagggatgaaagcggtcggaaatggttggtaaatgttaaaataatttccattttcatattttttatcggaaacgaaacaaaaaaggtaactcccgctccctctccatgggccatgaccacggcgtgaaacaggagccgaactaatggggcttgcacattttcactagaccaccacgagctgtggagctgatacagtttacagtgtgcggcatgagtttaatcccatatcgcttgttttggacgagtgaagtcaggcaaactctataaaagaagactataggcgccaagtgaactcacttatttagtgccttttggctgagagcctaagactgcgactagtacatggtcttatcagtttaatataactaatttaatatttaatatttgggttatgtgttcttcaataaatttatttttatagggctgtttggcttcatggccttgatttattttcggtaacattctgaatttttttctggtaaattccgattaaaatcggtaatcgaaggaaacaattgctagaatgatgtaccaattttgataccgtttccaattttttttccgatatcgattctgttttagaaaaatacctttactggtgaattcaatcgggaaaaatcgaaaacggtaaccagaatttcgataaattccgaaaccgttttcatccctatgtaggggtaaacagtactagattgtgagaacgaagtggcggaaactaaagggaggtaagacagtattcaaggaaagggccattaaatggtgcgtttagaagaaagatgacacaaaaatattggagaagatgtcaacatgcattcggaaggtggctttagaggtgtatggagcaattaaagggagtggagtttgaagttaaaggttggtggtggaatgagagtccaaagggctattaaggagaagaaagaatgctacaaacgcctgtaccatgtcgggattgtggacaacatagagaagtacaaggtagcaaagaaggttgcgaatagagctacaagtgtggcaaagagttgggcgtttgagaatttttaataacgtttgagtatgaaggaaggcgagggtggcatatttaggatggctagggttcgtgagaggaagacatgagacttcaactaagttaagtgcattaaggatgaaacagaacacctcttggtgaaggaggatgagatcaaacatagataattatagtattttgataaattgttcaatggggagaaaaaggacaactcttttgatgacaccaatatgcactttttgcgtagcatccaagaatctaaggttcgagagacattgaaaacgatgaaagggggtaaggcgatgtgccattatggtatcctaattgaggaatggagatgccttggttacataactacattatgcctaatcaagttgttcaaccatgtctttcggtcgaacaagatgcctgacaagtgaagtatattggtattgatatacaagaataagggagatatttgaagttgtacagattaccagggaattaagctgatgagcccgactatgaagctattggagagagttattgagcattgtttaagaggaataataagaatctatttgaaccaatttggtttcatgcttagaaagtcaatcgtggaagtcattttcttaataagacaagtgatggagcagtatatagagcagcagaagtacctacacgtggttttcattgacttggagaaggcttatgacaaaataccagataatgttatgtggtgggctttggacaaacaaaagtttcaatgaagtacattggactcattaaatacatatacaacaatgttgtgactagtgtttgaacaagtgacgaggacacaaatgactttacgattagaataggactacatcaaggattaggatttgagccctcacctttttgccttggtgatggataagttcacaagggacaaaggggatgccccttggtgtatgctttctgcagagtgcagacgatgtagtgctagttgatgaaagacatgcatgggtaaatagaaaactagagttgggacgttagacttgttactaaccttgattaggcgagataatcacccccacgggtactgtagcatatatataggcatataggcagacaatatgggccttatgggccttaacaccccctgtcaaactcaaggcggaagtggaggatttgaagcattgagtttgattagatgaaactgatgttgtgccctagtttgtgcttttgtgaagaaatccgcaagctgtaattctgagggcacatattgaagatcaatggtcttctgatgacaatgagatctagtgaatgagacatcaacaccaatgtgttttgtgagttcacgcttcactggatcatgacaaatttgtatagctccagtgttgtcacagcgaagaagtgtaggcgagtcacaagaaacgcctagatcagccaagagccaacgaatccagataatctcagcagtagtagtagccagggttcgaagttctgcttcagtactagatctagatacaacagcttgcttcttggatttccaagcaataggggatgatccaagaagaatacagtaaccagtgatggagcgacgatctgtaggatcactgacccaggtagcatcagagtaagcgtgaagctgagtggggaatttgagtcataaaataaacattgtgtttttgtcccccgtaaatatctaagcacacgaagtaagtgcccataatgaactgatgtaggagcagagacaaactgactcaagatctgaaccgcatgagcaatatctggcctggtgacagtaagataaactaagctgccaacaagatgtctatatcgagatggatcctccaaaggtgtcccatcagtcggacgaagagataaatgtagatccataggcgtggcaacagtgcgagtatcactaagaccagaacgatcaagaagatcttgtatgtacttggcctgagaaagataaataccattttgagtctgcaaaacctcaatgcccaagaaataactgagtgcccccaaagtcagacatttgaaattccttactcagagacgccttcacatgagcaatatggtctggatcatcgcctgtaatcaacatgtcatcaacatatagtaataacaacgtgcgtcctcgtgaagaaacatgaatggacaatgcaggatcatgatcactagaatagaaaccacaagccttgatgacagaaacaaatctctcaaaccaagcacgaggagcttgtttgagaccatacaaggctcgacggagacgacatacatgccctgatggaacctctatcccaggaggtggatgcatatagacttcctcatgtaaatcaccatgaagaaaagcatttttgacatccatctgagagatagtccaagaagatgaggctgcaacagcaagtaaagctaggacagtagtcagatgggccacaggtgcaaaagtctcatcatagtcaataccctgtgtctgttgaaaacctctggccacaagacgagctttatatcgctcaatagacccatcagatttggttttaaccttgaatacccatttgcacgtgataggtacaacaccagcaggtaacggaacatcccatgtacatgtgcgatgaagggcatttaattcatcagtcatagcaagctgccactcaggtataccagacgcctctttataagatgatggttcagcaatgactgcaccagcacgggaaaacccataacgttctggagctgcaatagtgccacggtcacgaagatgatacccctgattaaaaacaacatgagagtcatcattgttagtacaagtatcagcaacaggatcgtcatcaggactggccgtgggagtagagcgaggacgacgaatgtaagtctgagtgacaggtggtttggaagagtaagacggagatgttgtggaagtggaaggtggtgtgatgggaataaggacatctggggtagaaacagtaggtggtgatacttatgaagtttcagaaatgggaggaaggctcatgaaggaggtagactctgtggaataaaaagaagaatgagtggaagagttgtaaaagaagggacaattttcattgaagctcacatctcgagaaatacgcatgcgacgagaagatgaatcataacatcgatagcctttatgttcagggctatatccaagaaaaacacactcaacagattgagcagtcaatttagtacgttcacgaggtgataatagtacataacacgtacatccaaaaactcgaaaggtggtcatatcgtggaggagttccgaaaagaacttcaccaggtgttttgccagagagtttggatgacggttgtctattgatgaggtaaaccgcagtagaaactgcttcaccccaaaaatgtgacgggacaaaagaagatatcaacaaagtgcgagcagtttctataatgtgacgatgtttgcgttcatccacatcgttctgtgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaagtgagcaagggtaccttttgaagtcaaaaactggcggaaattatcagataaatattcaccaccagaatcagaacgaaaggttttaatgtgagtggaaaattgagtgtgaatcatacgagcaaaggttttataaatagaaatcagctcagagcggcgtttcatgaaataaatccaagtgtagcgagaatgatcatcaataaaaataacatagtatttatatccaccttttgacacaaaaggtgcaggaccccaaatatcagagtgaaccaaatcaaagggttgaacagaatgagaatgactagtaaaatatggaagttgtatttgttttccaagatgacaacccttacaatgaaaatcagactcaaccgaagtatgacctaagcaacctgactttattagagtagacaatctagatccacacaaatgacctagacgatgatgccactgggcaaaagacgcaacagaagcaagggtagctgaaagcacatgcgctggagatgtagtcaaggaaggaagccgcaaagagtccaagatgtagaggcgaggagcagctctacggcgacggccagtcccaatcacttcccctgtacgaaggtcctgtacaaaacaagatgagtcatcaaatccgacaaagcaattatgatccgtaatttggcctactaaaagaaggtccatagatagctcaggaacaaagaaaatattaggtactgtaaagtgtggatctgaaagataacccttatgagtaatgtggcatacaataccatcagctgtctgcactgaagcaccatctgtgacaggtgtagtagaagccaactttgactgatcagatgtgacatgaaaggaagctcctaaatcaagtacccaggccgactctgaagtacaagcggatgaagtggcagcaacagcaactgagcctctattagatggtcctggaccacgaccacgagcagcacatcgtgcacggaaatcagtcaacttatcagggaacttgacaaagcaaaagctcagatcgatgattggtcttgccacaatgatcacaaggcttaaaaaatattcttagggtttctgggcaacaacccaacacactgtgaggattaccaccagtagaggacagagaattaagacgagtctcttcagccaagtaaagcagacaactgcagaggtgcggcagaaatcgacgacgcagatccggttccgcagcccttgcggcgtgcagcagacagcaactacagaggtgcggcagggcgcagaagccagcaggcgggttgaggtagtgcgacgcagcagacaaataggcaacatgtgggcggcggctgaggcagggcgcagtgcggcgcagcaggcaacagcaggtggacggcggctgaggcagggcgcagtgcggcgcagcaggcagcaggcgggcgcgcagcaggcagcaggcggacgacacaagagctcagatccgcggcccgcgggactgaaggaaaaccgcgacggcgcggcagaggaagcggggaaaccgcgacggcggctgcggatggcgaatggaggccgcccagatccgccgcgacggcggcagaggaagcagaaccgcgacggcggctgaggatggaaccgcgacggcggtaggtcggaccgtagaaggctggccgcgatgggcggacggcgcagcagcgacgcgacggcgccaaagaaaattgatgagggacggattagatgtaaaccctaaccctaacctcctctgataccatgttactaaccttgattaggcgagataatcacccccacgggtactgtagcatatatataggcatataggcagacaatatgggccttatgggccttaacaagactcagagtccaaatattttaggctcactaaaactaagaccgaatgtatgagatgtgattttggcactactacacatgaaggagatgctagtttgtcactactacacatgaaggagatgctagtttgtaaggtcaagtagttctcaggaaggacacctataggtatttaaggttaacactacaaagagatgaatatgttagccatagaatcaaaatagggtggatgaagtggtgtcaagcatatgccgttttctatgacaagaggatactagaaaagtttttttttatgggatgacgattaggcttgctatgttgcatggtgcagaagttggcctacaaaaagatgacatgttcaacagataagtgttgcagaaatgagtatttcgtgttggatttgtggccatacaagaagggatcttgtccggaacgatgatatatgtgataggtttagggggtagcataacaccgattgaagaaaaacttgttcaacaatggttgatatgttttggacgaagacctctagatactagtactagtgagatcctaaggcacagtagtaaaccctaaacccttggaatagaggaagaccgaagttgacatggacagagagtaaaaggagacttgaaaggatgaaatataccagaaggtttagcctaggagtgtaggcaaaatagctaaaaaggagatttgaaaggatgaaatataaccgaaggtttagcctaggagtgttgggaaatagctatccatgtgcccgaaccttgacttgtggattatgttggggtttaactgtagtctacccaacttgcttgggactaaaattttttgctgttatcctttgtggtgatggaatttcgaaaggcacaaatcttgaatctgtcttctcgttcatcttacagctgggaatggtgaagacatttttacacgcaatggtagatggaacttcaacaataaggtcagcatgtataacatattcttgtttatgtgtaaatggattttcatgatttcacctgtaatatttggaattctgttattcagaggctcattagagcttgtagtgtcgagaaatgggcggtggtaaacttttctgcacgatgcaatgtcagggatcttgtccgggatctcatcaagtgtggaggcatgaagggcattgtaagttgttttctcattatgttgcattttccccacatgttctaattcatgtgtttggtattgcatttctacatgttcttattcacttgtttggtattgcagatggttgatgctccttttgctgtatttgatgagaatccttcaatgagacggtcacctgctataagaagggttgaagacatgtttgaacaagtgaaaactaagcttcctggagcaccaaagtttcttttgtgtgttctagctgaaaggaagaattctgatatttatggttggttaatactactaaatctatgttaaactctggtgcattttactttcggctgtagcattttgccattgacctctacagggccttggaagaagaaatgccttgctgaatttgggatcgttacacaatgtgtggcaccaactagagtgaacgaccagtatcttacaaatgtcctacttaagataaatgcaaaggtctgtttctctgtcttgagatttgagagcatggctagatttgtatatggcaattaaatattttgatatttttttctttttcaaacagctgggtggcatgaattcgttgctccaaattgaaacatccccagcaattcctcttgtatccaaggtcccaactataatcttgggaatggatgtgtcacacggttctcctggacattctgatgtaccatctattgctgctgtaagtatatttttcgtaattttctgtgatatttaataaacagtagctactgtgacagttttattttgttttacttaggttgttagttctcgtgaatggcctcttatctcgaaatacagagcttctgtccgcacccaatcacctaaaatggaaatgattgactcattgtttaagccacgggaagctgaagatgatggtctgatccggtaagagatcttaacctgcattacatttgttaagttatgtacttagacatgatttctcccattacctgttggattttgatgtttctttagggagtgtctgattgacttctacaccagttctgggaagagaaagcctgaccaagttatcatattcaggtttgttattttttatgcatctgagttagttaacttctttgcgtccaagtaactgtttggtcgataaaattggttgtctatctctcgtttcctctgttttgttataagcacaaagctgatttgtgtctaattatagggacggtgttagcgaaagtcagtttaatcaggtgctgaacattgagttgcaacaaatcatcgaggtatttttttctttttgttagcaactgtatgtgcacgctctattggttgtgttgtcatggttccttttatccaagtatcctgtactgtgtggttgtccacattaacatggtcctattacctcttcaggcttgcaaatttcttgatgagaaatggaatcccaagttcacgttgattattgcccagaagaatcatcacactaaatttttcattcctggaaagccagataatgtcccaccaggtaatcttcatcacctgccagcctgcagtggcaaccgtgtaggctcaatttttggcgaccttgttatattctctaatattctcgatggctttacctgcaggaactgtggtggacaacaaagtctgccatccaaagaacttcgatttctacatgtgtgcgcatgctggaatgatcgtaagcatcatctgcctttggatttggtctgtggtcatgtgtcattttgggactgtcagtttgccctgaaatgagaaatgtcctgcatttataaccccccgcacaaaagcaactgtgttcagatttaaattgctccagtggatggcaaaatgctggaatgattgcatgttttttttttgccaggggactacgaggccaactcactaccacatcctgcatgatgagataggcttcagtcctgatgatctgcaggagctggtgcattcgctctcttatgtgtaagtaccaagcagaagctcttgtcttgttaagaaagttgcttgctcacaagcgattttctgggactttatttcaggtaccaaaggagcacaacagccatatcagtcggtaagttaccttcatttctgtgtcaaaccgttaacaccacccccagcagcgggaagtgatttcccttgtttgcctttctgcagttgctcccatctgctacgcacatctggcagctgctcaggttggccagttcataaagttcgatgagatgtcggagacgtcctccagtcatggcgggcatacttcggcgggcagcgttccggtccaggagctgccgcgcctgcatgagaaagtgaggagctcgatgttcttttgctgagccgtggttttacttttttggtggatggtgaacccctctagttatgtcggtagacgctcttggatgacgctctagttgtggtccaggaaggctcgagctggtacgatgttaaatgttagttttttaagcgtcgctgcggctatgttggtgcctcaggaagacttggaacctggttaggatgtcgttaaatctaccccttatcgttcctggttcgttgggctgttgttcttattgtccgtcctggtgtctgatttctgctttgttgcatgcaagtgtgaggcccagcttgatattgaaaagtttggcgtacatgtcgttcatttggcactctggact

SEQ ID NO: 667 - DNA, 8846 bp, Zea mays
tatccatcctatattttttaaacttttatctacaaacaatatcatctacagtttcgcgtcctctatttttctgcactctactagagacaatattgtccaactatctacaatctttacatgtctgactcatatgaataagatataagtgattaattggctatatttgcagagctggatgccgatcggatctacgcataacactgtaccataagacaccccacatgttaatgttactatgttttattatctcctattaaagctttctcattattattttcttacggtggcgtatatagtgagtggtctgaagtaggacgcagcgtatcctaagccagtccaccagaccactaattcacttaggtctaaaaaaaataaaacaatatatattatatttgtattttctactgtatgcattggacttaaatattaaatttatagtttcatatactattcttatctttatattctgaattatatactaaattattatggattgtacgaaattatttatgaatttttatggcatacctcatataaaaattgtagctatgtcactgctttcttgtccatgagcttgtaccaaatcccccgcattcattcctcaaatcgttgcaattcccatctgcaacaccccccctctcatccattcatcaaatctttccaattccctccccaaatccgccgcattcaattttcaaatccttacgacttgcttccccaatcgacgcaaagcaaaaaaaaaaggaaacggaaggctggcagccgcacagccgtggcccggccccacttccgttctcgcgccggaggagcccaacaccggcaggtggcaaaagcgcggctactccctgactgactcactgcgaaagcgacagtgctagtactgcagcactgtgcccgcagttaacggagaaggaaatgccgcagctatcctttcgaacgctgcccaagctttttatgcaaaaacgggagcgacaccgtcccggtaccggccgcagccacacagccagccccacgcttgcgttgccgctaataaaaccgtagaatgctccgggtccacaggcatcgggttgcctctacccggccggcggaacccttcagtgacgatgactggtgggatacactttcactgggcccacaaatcagtcgagtagttgttgcggccgatgccgctttggcggtcagcgcgcagccgtgcgccgaggaagttgagagagcacggtgggcggcgcgagtgcgtgaggtgcctcccgcgtccaaccctcccctccacgtgtcgccttgtctggcccactgatgagtgactagtgatttggtgctatggatgaaaaaaaaatgcgccccccccccccccccccccccccccccccctcgcgcgcgcgtgggcgggtgcgggatgacctcgctgcccttccttccctgtccccggtgtacacgagggccgctggtacaagagcgtgggtgggcgcgggcgcacgagccacttcacttgtgctctctgttcggaaagaagcccggccgggtcggaaggggagcagttctcgccttctcggggaggtcgccagcggtaacggaaaaaccctcgtcccctccccccctcctctcacccggtccctgctggtcgaaatctagggttttggcggggtttggatcgcctgttctttgaccggaggttgttcgtgccggtgccgcgcggacttaaggagggtttctgcggtcagtcctgctgcgccctcgtgtggtctgttctacgtacgtttctttgtttttttttcttcttcttgttttaagatcgctgcattctggtctccgtttacagggtggtgtctttgtggatggattctgtttgcgttgggtttttttttcctgtatttgtttcggttgttttccatcaaacaggtcgagtcttttcctttggttaattgatggtatgcctccgtggcgcgcatgtgacaacttttgggggtttttcttctgttgattctatttgtgacttctccgattttcatctcttttttttgggtacgtggagggttttgttgctttcctgcttgcaatggcaaaggtcggacttgtcctctttcttcgtcgtgcatttgttcttgtcacgcgcaaaactgttcatttctctgcataaagggcagtttttgaataatactcattcggtgtttgataaatgtgcatctctggaaggttcattgttgaggatattagtgcagtgccttgttctggaatctggaaggttcgtccaataaggatttcagtgcggcgttgttaatttggggtacgcgctgcaattttctttttttttttcttttggtttctttggagtcatggaaatcccgctatcgctttccaaaggaaaaaatgttctttctttttcttgcctttcttcctggatttgttcccctttccaaatcttttgcgtctttgtggtatatatatagatgtataatgacatgactattattgtaatttatttgcattctcctatgtttatagtcgttttattgtcatatgatgatatggtatagttcgttttcatttgttgacgtgcagggttgggcagaggctttgcagcttttgggtcagacgcagtgttctcgtgagtatattatgccatatagtttactattttgtgtgaacatgtagaacattccttataaaggaccagtatgatatttctgtatgagttcaatcttctatcgactaaggtagtctgttgtgtaattgtgttcgaggtcctttatttattactgtttccatagtttgttgtttaacactgtttccgtagtttgtgagatgatcacgatttcattttttttgtttttaaatttgtacagtcacatcaattgtccttttgcttacctgtatcattcttacatctatattatgcagtaacttctcttacttcttcattgtatgaaatattaagaaacaaaataaatgacagatatttaaatgttccagtttctaattgatataagtggaatgtattccattgctgttagcatgggctacaaaataataaagtatcctgatgttacatttgtgtcgcatatttggtggggatgggatttgagagtaaacattgtggtttactgaaatgtataccgtttgcataatgtaattagttgccagttgatattacttgtgagaatgtgtattgttgggggtgtggcataagttagggacccccattagtggttttaagtttggatttcagttttttgaatagtttttatcacttcagcttgttatactactgaaatcagatgtttttatctctgttggaagggtgatttacctgtgtatttgtccttctgcttcagttgcgttgctgcttgcttgaatcatgcatctagtgcctacatatatatgtctgattggggttgctttggatactcatgcagcaaggctcactaaatggagtctcacaatggcgaggctgatgatttgcctccaccaccccctttggctgctggtgttgaaccacttaaagccgatgaaacaaagatgccattgaaacctaggagtctggtccagaggaatggctttggcagaaaggggcagcagataaagctgataacaaaccacttcaaagtttctctcatgaaggctgaagattttttctatcattactatgttcgtctctaatccttgccaagtatcacttctttatttttaacctcataccttcattatcaatgctgtcatcttttactggttgcaggtcaatttgaagtatgaagatgatacaccggttgatcggaaagggtcgggaagaaaagtgatcgaaaaactgcagcaaacttatgctgctgaacttgcaaataaagattttgcatatgatggtgagaagagcctgtttacaattggtgcccttcctcaagttaaaatggaattcactgttgtggatgaagacgtttcaactggaaagtaatgccttagttattttgttttatttatcattatctactctgatgataattatccctaaaatgttaacttgactttctggctttcaggactcctgcaaatggcagtccaggcaatgatagtcctcctggaagtgacaggaaaagggtccgaaggccttacaatacaaagacatataaggttgaactatcttttgcggcaaaaatccctatgagtgcaatctcacaggctttgaggggtcaggagtcagagcacactcaggaagcaattcgagtgattgacattattctgaggcagcactcagctaagcagtacgtaaatgtttcatgcaattcagaggacatattttcaaatattgctgttattattgacggttcttgtagtgtagccattccctgtctgtaactgtgcccctttttgcttgcaggggttgcctattagtaaggcaatcgttcttccacaataatccttccaattttgttgacctgggtggtggtgtagtgggatgtagagggttccattctagttttcgtgcaacccagagtggactttcactcaatatcggtatgttatcatctacacgccctgttttaatctacacaatactatgatcgtttctctctatgcagttggtaatatctgcatgtattaatatgctgtacagatgtgtccaccacaatgatagtgaaacctggtcctgtcattgactttctgattgccaatcagaaagttaatgatccaagcatgattgattgggcaaaggtaactccatgctaaatgcaacaaataatatagggataaaggttgagttccatttcaccatacttcagatgtatatttttgcaatttgtttacttctgcacaggccaagcgctcactgaagaacttaaggataaaaacaagtccggcgaaccaagaacagaagattgttggtctcagcgacaggccttgccgtgagcaattgtaagtagcatgttattgtttgaacggtttttatgttgcttgcactttttattttttctcccaagttccttgtgagttctgcatcttagttttatgtgcgttttctaagttcttgatgattttcttgcttatgtagattcacactgaaacataaaaatggtgaatctgaagagatcactgtttttgattactttgtaaagaaccgtggcataaagctggaatattctggtgatcttccttgtatcaatgtgggaaaaccaaagcgtccaacttattttccagttgaggtaactattttttgaatcctaatgttgttccttcagtgtaaaactcttttcccctgctaatgctgtgaaggctcttttcatgtttttaccagttatgcagtcttcttcctttgcaacggtacactaaagcattgagcacacttcaaagatcatcactcgttgagaaatctaggcagaaaccacaagaaaggatgtctgttttgtctgatgtgagtgttttttttggattaaaccttagcaaagttttctagttagtattatatataacaaaaaaataacaattgggcctagcaagttggattattagtgttggttttcttaaagtgttctttttcatgtcaaattggataggtgctgcaaagaagcaactatgatgcagaacccatgctgaaggcttgtgggattacaattgctagaaatttcatagaagttgatggtagggtactgcagccccctaaggttggttattgctgtttatcctatattatttcagatatcgttcgtggttatggaattttgaaggcgtaaatcttaactgtctttttgttcagcttaaagctgggaacggagaagacatttttacgcgcaatggcagatggaatttcaataataaggtcagcgtgcatagcacattcttgtttgtgtatatggattgtcatgatgtcatatgtaatatttggaaatttgtgtttcagaagctcattagagctagcagtgtcgagaaatgggcagtagtaaacttttctgcacgatgcaatgtccgggatcttgtccgtgatctcatcaagtgtggaggcatgaagggcattgtaagtttgttttctcattttgttgcacgtttctgtatatgttcttattcacttgtttggtactgtatttccacatgttcttatgcaattgtttggtattgcagatggttgatgcaccatttgctgtatttgatgagaatccttcaatgagacggtcacctgctgtaagaagggttgaagacatgtttgaacaagtgaaaactaagcttcctggagcacccaagtttcttttgtgtgttctagcggaaagaaagaattccgatatttatggttggttaatgctacttactcactgttaacttgtggtgcattttattttctgctgtagcattatgccattgacctttacagggccttggaagaagaaatgccttgctgaatttgggatcgttacacagtgtgtggcaccaactagagtcaatgatcagtatcttacaaatgtcttgttaaagattaacgcaaaggtctgtttctctttgccttggatttgagaacatggctaccgtcatatatgccaatttttttgattttttcccttttcaaacagttgggtggcttgaattcgttgctccaaattgaaacatccccagcaattcctctcgtatccaaggtcccaactataatcttgggtatggacgtatcacacggatctcctggacattctgatataccgtctgttgctgctgtaagtatatttttgtctttttctgtgataaataataaatagtggctatgtgacagttttattttgttttcctcaggttgttagttctcgtgaatggcctcttatctcaaaatacagagcatctgtccgcacccaatcaccaaaaatggaaatgattgactcgttgtttaagccacgggaaactgatgacgatggtctgattcggtaagagatcttacctgcattacctttgttaagagcatggtatactactatactttgctgaatgtcctatgccctctgttttaatgacatgttggaattcgatgttgcttcagggagtgtctgattgacttctacaccagttcagggaagagaaagcccgaccaagtcatcatcttcaggtctgttattattttaaattttctgtttgcaaatctgagtaattttttgtatggaaggtaactgtttggttgggaaaattggttgcatagcttttatttctgttttgttatagcaccaacctgatttgtgtctctgattatagggacggtgttagtgaaagtcagtttaatcaggtgctgaacattgagttgcaacaaatcattgaggtattttttttttgctggcaactctattggcagtttggtacgctctgtaggtgttgtggttcctcttatccaagtatccagtactgcgtgcttgtccacattaacatggtccattacctttcaggcttgcaaatttcttgatgagaaatggaatcccaagttcacattgatcattgcccagaagaatcaccacactaaatttttcattcctggaaagccagataatgttccagctggtaatcttcaccttccaagtctgctgttggtgctgtgtgtaggctcatgtatcggtggccttagtatattctctaaccatctgaatggctttatctgtaggcactgttgttgacaacaaagtctgtcatccaaggaacttcgatttctacatgtgttcacatgctggaatgattgtaagcgttatctgcctttgtgtttggtctgtgcagtgcagtcaattggtgtcgttttgggtctgttatagtttgccctgaaatgaggaatttcctgtgtttataaccccacaaaagctactgtgtcccgaattaaactgtcaatgggccttcgcagcatcggtggtaaacttagttgtattgctccagtaggtggccaaatttgatgtcgttttatttgtgtactcgtgctgtcatcatctcgtctcattgtgtatccttgggtttcactggtactttggttctgtactgctgctgccgtaagtttgcctaggaagacatggtttcttcctgtgaatcgatagagctaagtgccgtgttttcttttgccagggaactaccaggccaactcactatcacatcctgcatgacgagataggcttcaatcctgatgacctgcaggagctggtgcactcgctctcttatgtgtaagtaccaaacagagtctcagggaaaaaaaaaacttttgctgacttgtcctgttacgaaactttcctgctcacaaggggttttctggcacttcaatttcaggtaccaaaggagcacaacagccatatcagttggtaagtttatcttggcaccgtttttcgtttatgtcaaactcttatcacctgcatctgtgggaatttgattccttgtctgcctgcctgcagttgctcccatctgctacgcccaccttgcagccgcccaggttgggcagttcataaagttcgacgagatgtcggagacttcatctagccatggggggcatacctcggcgggcagcgtccctgtacaggagctgccccgtctgcatgagaaagtgaggagctccatgttcttctgctgagcagcagggaatgtgtcccttggttttacctttttgggtgtatggtcgggggttctgaacccatgaacttgttgcctcacttggttccagcctcaggaagaactttgtaggatgctgaatggtaggatttttaagcatcgttgcagttgtgctgggtggcacgctgcaaccattttggctagcttgttgcagcacttggtgccttcctgagaggaagtagacttggaacctggtagcacgtccttaaaccatccttttaagcgttgctggttcggcctctgagctgtgtttgtcgtgc

SEQ ID NO: 668 - DNA, 9490 bp, Zea mays; identical to SEQ ID NO: 662

SEQ ID NO: 669 - DNA, 12819 bp, Zea mays; identical to SEQ ID NO: 665
  misc_feature (721)..(820): n is a, c, g, or t
  misc_feature (7091)..(7190): n is a, c, g, or t

SEQ ID NO: 670 - DNA, 12825 bp, Zea mays; identical to SEQ ID NO: 666
  misc_feature (721)..(820): n is a, c, g, or t
  misc_feature (7091)..(7190): n is a, c, g, or t

SEQ ID NO: 671 - DNA, 9511 bp, Zea mays
tacatcacttccttggaatgcatgttcaacacaccagttccggtctctacctgtaacaacggcaatacatgattgagatccttgagcaagttggcatgagtgaatgcaaaccatgcactactcctgttgatataaatcccaagctttcagccgatggtgatctagtttcagacgctacagattttcacagtctttgcaggtgctcttcagtatctgacattcacacgtcctgatattttatatgtagttcagcagatttgccttcacatgcacgatccaagagaggctcaccttactgccctcaagcgtattctgcgctacattcgtggcacattggacttggttcttcttgtgcgcccttctcagtttgaactggtggtctactcagatgcagattgggctggctgtccagttactcatagatctacgtctggatatgcagtcttccttggggacaatctagtctcctggtcctctaagcggcaaaacattatttcccgctcgagtgcagaagctgaatatcgcgatttcgccaatgcagtcgctgaggctgcctgcattcgttagctcttgactgagttgcactcccccctgcccaagaccaccctggtgtattgcgacaacattagcgcagtctacatgtcttctaatccaatccagcaccagcgtaccaagcacattgagattgaccttcactttgtccgcgagcatgttgctcttggtgatgtccgagttctccatgttccaacgacataccagtttgctgacatcttcaccaaaggacttccgtcatcggtgttctgtgaatttcggtccagtgtcaacgtccgctgccactgcggggggtgttagagaatctgttatatatgggagggcctgagcctggcaatcttgtgctggccggctatagtatacatggatagagggaattagggagaggatttccttttgcctctcttcctcctctcctatatatgtacacaccaatcattcctcctcaattccgttcacttacagggggagaggagtactggtcaggatcaatcacgatccttaccatttagggcctattcggtttgttatggattataggaggggatttaatcccctccaatccataacaaaccgaacatggccttaggagatttcttttgtctcacctcctcctcccttacatatatgtacatgtatttcctctcaatcaatcaatccattattcctaccaccatctaacactctcgtttcttgttcggcgtcgcctccacccgctcaagcactgcctcgtctctacctatgctcgctcgaggcccgccaccatttttcctggcttgggtaccagactcggaggtttgtgaggtgcctattccatgggcctatttgaactgcttttgttctgattctagtggaaaaatgccgataaacggcaccaaatgcctcgcttccgacgccgcgtaacttgccatgtttccgacgccgcgtaacttgccatgcttcccccccatggagaaacgtgagcgtggaatgagttatcctcaagcatcgatgaaaatctccttgattctcttgtttcttgtttggtgccgcctccacctactcgagcttgatcactcaagcgtcgccccgcctctgcctctactcgattgaggcctacctccatctctccttgctagccgaagctagaccctgacttgagctcaacatttttgccaccagacatgcctccctccttgcttaggcactagagttggtgtaggatctgagactggaactgttgtctactcttttggcggcaacaaggatgggcatcccttgcaaggggaatatgcctccttctccgatgacaacagtggtgggtggtgcctgagagacaaggtagggggcctccctactccatgagcagggcccgtcgctaataggtggcctacctcctattctaccttgcctcgccccacctcacccttgtcgtccttaccagagcccaaggacgtccatgagttcttgtctggaagtgaacactaagctttcttttccccgtgattctcataaaaacattattcttgtgtcccgtttctcaatgaatctactacaaaaatgagtttataaaaataactcgacctgcgggtgtaagaccgccctacgacattatgttaagaagtcctcacgcaggtcgagaaaaccctcgaattcgtgtcccacccatacaaagcggcaacgtagcccatgtgataattaccgcgaccggagctaggccttagacctgtgctttggcgtgggacagacgaggggatttatttaaccaggcctgaaattcgctcgcacggggagttgaactaaggacataaggagtgctactcagaccacctaacgaagtcaattcaggccctttcgctacaataatgagtttatgacactttattcgtaaaatttagagcacaattactgttagactatgtgtgtgtgtgtgggacgacaccactattggctgccggcccattagggttatggtctcctgtgagtgtatatgttgtaatcccttctctatgcaatacaatcaagcatcacattccaatatgctatggagctagggtttcccaccttccctcccatagtcgccggttcatcccaactcccagccgccggccttgctgcttccgctccgtcgtccccggggggttcgtctgccctcccgggcggctctccttctgatgctccttccgctcctctttcccttcctcaactctaggccgccatcgttcttctcggccatgtcaaagcccaaggccgttgtcctcaactccagtagcatcagggcaagctcctccacacctaggcgtcggactccctagcggcttggcctgatgcgctcggccaccgttccccagcgtcgaccactgcaaccaagtcttcaccagcgcctcctctagctctgttctcggcatcgctcgtccttcttcccagacagggtgctccactcaccctcctgtagccccatggtcgaggcccccttgtctcagatcccgccgtcgccgtccggatccccattgccgtcgccaagatctcgacgacgtcgccctccttgccaagttgtgcctctgccatagctcgagcctagcttcctggcgagtcgcccttcgtctcagcctcaacggtgcagctcgacaaccctctccactgctccctagctcgcggcgcgggcacggctgtgactgttcgcccctgcgccgccggcggctgaccgcatggccagtcgaggcagagccatggctgatggctgctgctatgctacttactggtagtggaggctggctggcgtgacacccagccacctccctctcttgggccgcagaccctcgcgccctgcgccctagtcggatccatgtggccgtcgtgtcatgctgctcctctccttccccacctcttgtgagccgtgtgcgccatgcgacctctaacgcgggttccatgatgcgcccctggcggcgcgacctccagcgtgggctcggccagccaagcgcagcctcagctccggcacaggcgtggccctggtagggcacggtcggacaggggccgccatgacgcctggatcccccccggccgccggcaaccaaagccaccggcctcctctctctggcagcgtcgacccgccacatctggtcgccgcggccggccctggtcctcctcggcgctggcgcgcttccccggccacgacatgacatcccctccccactggcactcttccctgccccgccggctacctcgctccccctcctttctcgcggctcagatccgccgtggatcgaccctgccatggcaagtccctgcattgtcgcgcgaccttccccgccgccggctctactacgccgttggccgcctgatccgccgccgccgcgtctccacgcgccgttggctgcctgatccgccgtgcctccactcgtcgccgaccgaccagcaggtcgctccctttctcttcccctgccttgtgcgctgtgtagcccccgttgtcgtgtcgtccacctcttccctgactgcgccgacgcccagcagcgcctccaattgtcacgcttctcccgttgccggcgtcaagctccccttccaggtccggccccttcctggttggacccgccctgccgtgcgccttccttcttcgtcgcctttgttggatccgtcgctgtcgtgaccttcctggctagatccgtcctccctttggctggattgccgtcttcatggctggatccatcgttgttgtggctttcccgaccggatccgtcgggcgtggccaccctgaccgacgcagacgtgtgtgttgtcgctagccgcccctggtgaggctcctcgacgaccggtcgcggaatgaagcaagaaggctctgaggttgatgctgtccttttgtgtcacctcgccgatcgttgaccctcgagcgtcgacccctcccgaagaacaggcttgtgctgcgtgtctcctgaccacggccacttcaacttcggctaactcggcatccagaggctatcgtcttctcggagtccacaccggtctctactccaacagcaatattcgcaccctcacgacgctgcgactggagggatttcaacctgtcggctcttaccttcggcttctactccagtctcatcgtgtgtggtgccccctttgcgattgtgaggcgatgttagactatgtgtgtgtgtgggccggcaccactattgggctgccggccattagggttagggtctcctgtgagtatattgtaaccccttctatatgcaatacaatcaagcatcacattccaataattacaacttgctttcctactttatgattgctggtttcaactctctttttattgcctccccatgccaatttaggttgacaaagaccgaaatttacatggggagatgcgataaaaagagacttaaatgtttggggatatacctaaaggcttgtgcttgagtaacagtgcttgaaaagcaacaattgatgtgcctcaaccatgattaggggctcttgtttgggactgaaagactcggtggtgttgttgtaatactatgctctgcaggttgttggatctagatgctggccattgatatcacggtacagagcatctgtgcgcacccagtctccaaaggtagagatgattgattctctatttaagccactggatgatgggaaggatgatggcataatgaggtgatttagattaacatcttttcagttctttgttatgttctagttgacctcacagtaccttcatgttgtatgaagttatttggctcagcaagtggggccttagtctgttattatctaaaagataagaggaatgacctattacccttttcactttatcaatgcattgcagggaacttctactagacttctaccaaaccagtcaacaaagaaagcctaagcagataatcatcttcaggtgtgtactgagttatttttacccagttatatatgcctatggtggtgtcattcttttatgtaaaaggtgtgtttgtttccgatgctagtttgtaagtgtgttggtgtgagtgtggtgggtgtgttgtaatttatttgttatctcctaaatacaatgatacacaactctcttacataatctacaaaaaaattgtgtcatacattgttaagctgcgttgaatgtgttacttcattttttctctccaactcgaaggatcattattttggtgcagacaggaattttttgttttcttgaatgaccattattttggtgactcaaaggaacatttggtctttctttccatgttaatttgatgttttttaatttagaataatgaatgggggtctggtaagaagtgtttgactctacagtattttactaatcttaagccaggaaaagtcaaatatctgtagtgctgattttgtatctatatagttattggtttttttgtcaataaaaaactatcatttcctaccagcttttcttaaaattgtctatgcagtttctattcaaatgtgagctcttctgtgttaaatgatgaagatcagtttatagtacagaattgacttttctttgtgtgaaatgcaccataaacatccatgttgttcttgccagtaagaactatatctgaatattcagttggtgtcctttgattttccttttgaggattaaagttgatacatttcattaaatgaatgttatatttacagtgatggtaattaaatcatgtatgttcctttctatttattttgtggatgtaagagtatatttgtggtttattttttctgtattgatttgcttttttggttgcttcacgatgaactgtgggcgttcactggtgctgtgacttttttggtgtttctgtcaagagttctcggtattcagtgttgttgaattcttatccttattgtctgcatatgcagggatggtgttagcgagtctcagtttagccaagtactgaacgtagaacttaatcaaattataaaggttcttctatgcactgttttgcttgagaattccttcgttttcttgcattttttaacaagagttagacgacgcaggcatatcagagtatgggacagggggaccttccgaagttcacagtgatcattgctcaaaagaatcaccacacaaaactcttccaagctgattcaccagagaacgttccacctggtaagtacccttgtcccacttaatactgttaaagattcttcccctttaaacggcttgagcaacttacactttttctttgcatcagggactgttgtggactccggcatagttcatccaagacagtatgatttctacatgtgtgctcatgccggaccaattgtaagttctcctgagtaattttggattttgtttgaccgggtgaaatggacgaacattccacagattgacgacccccgcgtcctggttgcccccgcgtcgggcgactcggacgctccccataatccctagcagccgccgccgcccccttcgtggtcctctccctgccgcgccgctgcctgagctggccgccggaaggtccgtctgcttgcggggagggcggcggcagggcatctccgtctccctccggcggatctgggcgggcgcggccgccaaggtcgccgtgagttgctcgtcggcgtggtcggccccggcttcgccccctcacgactcgggcggctgccaactcccctccctccccatctctttgccttgctgccgccagagctagctggcgggttgctcgcacagctagcggtgaaggcgtcgggcgggtgcttgctgccttgtcgcgcgtccaaccctcggtggcggcgtccgcccactcaggcaacgggcctgcggctaggtgcgcgtccgcgaggctggcccggtggtggcgcctacgcgccgcgacggcaatcgctgctgctcggggttggaggtgtgcctgggctgtgtgctcgcgtaccggatgcgcggagggctggatctggcgcccccatggggagcggcgtcgacgcgcggtgggctagatctggcgcgcgaggttggcggcctccgcatgccgttcgtcggaggcgccggcaggctggtcccgggctagcgcatgagccggggtggaggtcggcgttggtgcgccggcaggcctgcgcagtcggccggaattgcggtggcgggacctcctctcgtctggggcagcatcagctagtggatcgggctagcgcagggtggtggtggtggcgacaggcccaaaatcttcatcatttgtgtggtacgtcggggtaccggcgacggcggaggcagcttgctgtgtctcgaggtttcggccagacgttgtgctgggggctcttgggcgaaagtctcggcgacggtgacgcccatgggcgtcgcttcccctgttgagggtgtcgcatccccagcgctatcttccttgggtgaaagcccggtccatcgcggacaggtgacggtggcgtcacagtgacgtcactcccttcctgaaggcgtcgcttctgaagttcgtctcggccaggactttgccttcggctgttgcttcgcttctcggtgcctggtatgcgagtggaggtgggggttttgcaacgtgaagtcggagctgctacatcagtggatgtggctcggcaacgataacacgaggcgaacctcccttcttcgtggtccagaatgtttcggaggtcgggcaaaaaccggaggcagggcggagggttaagattggaagtcggagctgctctgtgcctgagcccagcaacgatgacttgttgagacctttcgtttcgggctgtctgtctgctttttgtttggttcgcctgttagctgcttcgggaagttggagttgttggatgctctgcatccttgcttgataacgatgacctttagcagttttgtgtgctctcgtgtggggttgtcgctgcctgtgttgtttgggcactctgtgtcggcggtgagtgtggtgtcgtgttgatgtcccaatccaaccgatgagttgagttgtatggtgtaggcatgttgatgtctcaatccaaccgcatgttgtttgttgtttagtccggtccggaccacttcttcttaattaatataatcggcagctctcccgcctggttcgtttcaaaaaaaaaaaaaattgtttgaccgtgcttgttagtaagcttgactgtatatgtgtcagacatgtttcatattgagcatcctaattatgctatcttacacagggtacttcaaggccaacccattaccatgtgttgcttgatgagattggcttctctgcagataatctccagaagctagttctttcactttcatatgtgtaagcacatactttcatgtctatttcctctatttccttaactcatgtgaaaataacatgtttgtgctttgtataggtaccagaggagcaccactgcgatttctgtgggtacgttgatgttttcttttgtgctaaaaaaaccatcacgcactctttgctgaatgctgttttttgctttttcagtggcacctatctgttatgcccacctcgcagcagctcagatgggccagttcatgaaatttgaagagtttgcagatacgtcgtcagggagtgtcaattcatcatcgccaccatcaataccagaattgccacggctgcatgctgatgtctgcagttccatgttcttctgttgacgtgattttagtttgaccgttgtggggtagggccaattctttgtgaaaggaaccttaccttatatgttggcacacagcaggctaaccgtttttgtgaagaaaccatgtaggtcgttagttgtcgtatatcgcacgcgtgcatctttttggagcggttttcggctccccccacccacaggtggcggttccgttaggtacagtttccagattttaacgatgctaatacagtaaaagcagtttgtacattctacgcagattttgcagggatacgtggttagatgatctttttgttatgcccagaaatacgtgtgcattggggggttatgaaagtgagctaaatttctgtgcctcgcatggcatccaattgtactcggagattgtgtttgtgctcgatacgcttcctgccactgaaatgcg

SEQ ID NO: 672 - DNA, 11016 bp, Zea mays
gtggcccttgcagggaagttttgttcccggttgattgagaagaaggaaagctcactcggtccgagggaccgtttgagagagggaagggttgaaagagacccggcctttgtggcctcctcaacggggagtaggtttgcaagaaccgaacctcggtaaaacaaatccacgtgtcactctccttatttgcttgcgatttgttttgcgccctctcttgcggactcatttattattactaacgctaaccccggcttgtagttgtgattatttttgtaaatttcagtttcgccctattcaccccccctctaggcgactatcagttggccgtcaccaggtcgccgaggtacaccaccaagtctgagcgaagatgcgtggatcgaattccgccgccgcagagaccatgaggcagagagggagttccgtttcagttctttgattctttcggaggaaaagggaaagggtaaggggagcaaaaggagagcgtgcgcatgcacgcacctgggttctcgacgtcgaggacggcggccatgacgcggtcggacgcggcgtcctgcgcggggccccagtccgtccacgcgtcctcgccataatgcaggtccgcaaacagggccactttgaacactcctcctggcccgaaccacagcggcggcagcgagcagggcgggcgcgaggctgcgccaccacttgcacaatgcggatttgctcgacggcttgggcggtgtggtcctgggagcatcgggcttggcgcgttcttgtctggtgaagccccgcgttcggagtcggagggaggtgggcgacattcacggcgggactcgcttggttgacgggatctacgcgctggtggtaggagatcccttgatggcggcacggatggcgtggggcggaggcgttcgtcgcggagccgggatctacgcgctgggggaggatcgcggaggagagggggggcgcgggcagacagctgtagacgcgctgggggaggatcgcggaggagagggggcgcgcgggcagacagctgtagagaggcagaacacggcgggtgtgcacgcctacaataagaaagtaaagattggagttattttcacaaagctgattctcataaagacataaacggctaaagctgtctcatggtcataatccgactgaaaacgaaacaaacaggcccaactacccacacagtttgggccaccctacagctggttcatgtgacagacagggctggaggtagaggggccaacatccgaaagcctgcggcgctcgcgggagacgaacaaaaattcgaatccgggctctcccgctggccgctgcagcctgcagaaggctccgcgccgtaaaaaattggacgttcccgctccctccatctttttggttcgggtttcgttttcccactgccgctcccgcctcctctctgccctgtttccacatttgaccgatcctcttcgattcgatttctacacccccagagcttgccaaacccctcgtctcccaaccctagagagcagcagcagcagcagcagctaccgcatcccttgccatggcgccaagctccccgtcatccgctaggcccacgcgcgcctccggccggaagcgctccgccatggccgaggagatccaccagaaccaggaggaggaggaggaggttgtggctgcgtccaccgccaagcgcagacgcaaggcggcgtcttccgggaagaagcccaagccgacgcccaagcaggccaaaccggccgtggcggggatgaagaagaagggggagaccgagaagacggagcccgttgtggacgacgtgtgcgccgaggagcccgacgaggaggagttggccatgggcgaggaggaggcggaggccgaggagcaggccatgcaggaggtggtggccgcggtcgcggccgggtcgcccggtaagaagagggtggggagaaggagcgccgccgcctcgggcgaccacgtgcccgagttcatcggcagccccgttgctgcggccgaggcgcacagcaactggcccaagcgctacgagcgcagcactgccgcaaataagtatattgtccctcccttcttaccctggtttagtatgactatgactggatttttgctccctgttcgttgcttgagagctgagcaatttgctatttgttaatctattgcgcatgcagaccggaggaggacgatgagctcaaggccaggtgccactaccggagcgctaaggtggacaacattgtctactgcctcggggatgacgtttatgtcaaggttttgcccatcgtcttcattgcctttatttgtcatgctgctgctgctgctctcatttacgcactgctcatgtatttgttaaggaagcatcacttaattgttttttgttgtccatttgcaatctgttgtgcgtgtggtcagcgcccagcgttacatggtcagcggcgggcctaggatttgaagtatgagtattcaaatttttggtagaacatattttttgacaatttaaaattacactattgtactgtatgatcggttgaacggtacataaatgaagagggctagtgaaaaccaaagtttagacaaaatagctgtaaaacagtatgattttatgtttttttataatattttagcttatatacataacatatacatgtatatataattgttttgccaaaaataatgagtattcaattgaatacccttgcttgcatgtaggcccaccactatacatggtggtactttcgacgcaccgtttttttggtaatttttccgaaaaaagttcggtaaacgtgaattttggtccttttacaaatctatggcgccgagcaaagagttcataaatatcaagctttgccaaaaagctttgctaaatacaatttgggaacaaaaacaactttagcctctaatagtttccaattcttaggttgttaaatatttttaaattatgctaacttaatggtaagttcaacattttcaccgtttaaatcgcttgtgtgccattggaatactcacatgtgttaagtatttgtgactagagggagtataatataaaggggtgccagccattgatcacatccattatgatctctgagagcatttgaaaattttcttgtcttatttgcctgtttatgaagttaaagtgttgtttgtgtcttaaattttagtttgatgaaaattcttagtaattcagctgaacacaaacattgatgatgcaatgcaatgatttcaagtcgtccgactaatcgcgattaatcgcgattagtcgggctggtcggtaattagtacacgatttgctggacgactcgaccagataacctagtcgtcctggtcgtccgactaatcgtcgactagggtgactagtcgtccgacttatgtgtcctggtcgtcccggctagggtttagttattaggccttttttagcccatctacagtcactgcacgtctcctctcctctcctattataacctacccgccaacagtctctggctctctacacgtctcctctcctctcttgcaccgcccctgcagtcctggactttgattgctgacggctacagcaccctgcgtccctgccctttctcctggagtcctgcagcctgctgcactactgcagtctctaatttatataatgtatacatgtatatttatatatatacctatatacgtatagctactagtgtaggacgaccagggaccgactaggaccgactaggagtcgactagtcgccctagtcgtcgcctaatcgcgactagtcacctggtcggtcctagggttcgaccagacgactaggcgacttgaaatcattgatgcaatgaacaagtatggtcgaagtaatggttgtgtgcaattcttctggattgttttgctctcacattacaacattttatatgttctttaataatagttattgaccttaagtttctggttcctttttgcttatcttaggctggagaaaatgaggctgattacattggtcgcattactgaattttttgagggcactgatcgatgccactattttacttgccgttggtttttccgtgcagaggacacggtgtgtattgagcttaatgtcatttctatttatatcaagaattagcatagaactgaaccttaacagtgcaggtcatcaattcgttggtgtcgattaatgttgatggccacaagcatgaccctagacgtgtttttctttccgaggaaaagaatgacaatgtgcttgattgcatcatctccaaggtcaagatagtccatgttgatccaaatgtaagttccctgctaagagctttgcggttttgctatacacataatatttctcactacaattgtttctttgctttagatggatccaaaagctaaggcccaactgatagaacattgtgacctatactatgacatgtcttactctgttgcatattctacatttgctaatatctcatcaggtaattgcttctacatcattcttttttggttgactagctgcatggttattaaaacgacgaaacgttgaaacactcatggatggacttttaacttttaaactatttaaacaaagtttaaacgtagttataaacaacatagggaaatttcaatatatcataatttcaggggaaatttggatccataccattaaaagatcaccactttagattcataccattactatctcacttacatgtgggtccacatgagtcaatgacatgtggggtccatgatatatatctaaagtttggatcttttaatggtatagatccaattgttcctaatttcagacaattatataaagtcaaataccaaacaagcaacataagttcacataataatattgtgtaaaatgacatgtccacaaccacattaccacaataacacaagttcaactaatagcaagtcgacaaccgtaaacaaagtggaatgggatgtctaatagtccaccatcaaaaacatagcacaaaatcaactaaagtagaatgcaatgtccacaaccacaagcacacaagtgttactcaagcactcaataaccatcatccaaatcatctaaaccaatatcatccttgtcttgctcatcaccacgggcaccactgttgtttgtttcttcttcatcatccatatcaaggtcgtcaagcacaaaattgtaacctgggcggaatctctaattgggctgggccaaaatttacaagcaggcaacttaaacgttcgaaacgtggcgtttaactatatatcgcgtttaaacgtcaaaacatgacgtttaaacgtcgttaaacaacgttttacgaggaagtgtgaaacgtttcagcgtttcagcgtttcgctgttctattagcgttttatagtttaaacgacgtttaaacgttgttttaataaccatgactagctgaatacaatttactggctttgctaaattagtggaatgacactactaaccaaatgatctcccactctaatgccttttacaatatttctatgttatgctagaaaaaaaattaacttttatgtttccaattagatttacactgaaaatcagagtttttaaggcattaagctgactggccccctttttactttttaatctttatggtgtaagatgatgtgactcttgtgtagtatatagaaataggaaatacaatagtaaataggatcatagtctcaaataaatactctctcttcgcttgagtttgtcattctaggtttatcataagttaaattgtttgaactttaaccaataatgaatatatgattaagttattttaatctaaaagaattatatattatgataattcaatttatgataaatctaataattttattttttgttgtaaaattttataaaacatcttatataaccggtcaaagttgatagtgatggacttaatacaaaactaaaataacaaactcatatgtatggagtagacagtaataatagtactatataagcaataggagtacaagttaacctaaactaacatattagctataaagtctacaaagaggataattcacattcactttaccatttaaaaagcaaaatagagtgctgaaccggtattgctctgactcaacatagggtgggagcagagagagcagcacctcctgggtctaggccgctctcgcagagagagcagagagggcgaggggagctggccgatgttggacggtgatggatggcgggggcagggtggaggggagctcgcggaggcagggccactgactgctgcaggagagagggaagaggcaggggcgcagggcggctaacatcgctgccgcctagaggcagtgaagaggtaggggatctcgcgggaggcagggccgctgctgccacctggagatcccgaatcccgaccgccgccgcctggagctcccaaccgctgacgcctggagtgtttcgcgtcgtaaggctctatgtaccccgcggccctacttagggtgtttggttcttttagagcatgtaatccctttgccattcaattttgatctctcaaatctcctccattatcactgctcccaaaaaatccttagagcgtgtttgatttttagtcacccttttaaactttagtgattaaaccttattctctaaaaaattatttggaagacatttttgtcactccgtttagtattttagtgaataaaaataactaaactttagccattgaaattgaagtttaggaggtgggagacaaacacttccttagttcctaaactttaggactaaactttgtccttagaaattatatttggaagacctattttaatcaatctctttggtattttagttttaaaagatgggaaccaaacacccccttaatcctgcgtaccctaacatcaatcttttaccccaaaccctacaaaggctaagatcttcgcaaatcgaagcgccaaggtgacatatcaaaccctaaggcggatgcctttcgagttgctgcaagtttactatgacgccctagctgtcgaactcgcctttccacttaagctctatctaagtgatgcttaattgttgcctcgagttgttctttttaggagagtacataatcatgttttagtatcattgaaggataactgaactgtctaccttagacatctctattttaaagtttgtttttggctaccggccaaatgccaaaaactgaaataaattcaacttttaaaattagcttatgaagaagccaaaagcaggtctagagatgtttttcctgtcttttttttgtatatgagatagcaacgtgtatgtacccatatggtagtactgtttcatattcacagtactagataaaattctatttgccatgtctgcataacatgtacccaaatgtatacttgttatagacaaaatcctaaatacatcatgcaattaaaatctaatagtgtaagtttctgtaaacaaaaggacaattgttaaatgtgtatgttttttttgcaaaacctcacaattgtttttctactagaaaatgggcagtcaggcagtgaaaccgcttcgggtatttcttctgatgatgcgggtttggagacgtcatctaatatgccagagaggacagcaacccttcttgacttgtattcgggctgtgggggcatgtccactggtctttgcttgggtgctgctctttctggcctgaaacttgaaactgtaatattctacctagttatctgttggatagaacatgttcttacttaccactgattctactgttatggctatgattgcagcgatgggctgttgatcttaacagttttgcgtgccaaagtttaaaatacaatcatccacagactgaggtatgcatattaagctgcatcttggattccatctgttctgtccagctgctctcaaaaagtttctttggacctttgaatgtaggtgcgaaatgagaaagctgatgagtttcttgctctccttaaggaatgggcagtcttatgtgaaaaatatgttcatcaagacgtggattcgaatttagcaggttcagaggatcaagaggatgctgacactcttgacaaggatgaatttgttgtacagaagcttattggaatacgctatgatggcactggaaggaaaaaaggcgtatattttaaggtattcaagcattatctgttcatttatacttgattccaagaaaaagttcaattactatgatgatataggaaaaagtttttgaacaatggacatttctttgcattttggtgtaatgctaaatttctgcaggtccaatgggaaggatatggtcctgaagaggatacatgggaacctattgataacctgaggttagtattttggtagtgtcatctgcttgttgccttgtatgtctatttgtactctaatccttgtttcacgaaccagtgactgtccgctgaaaattagagaatttgtacaagaagggcgcaaaagaaaaattctcccgcttcctgtgagtatttagttgggtgtggttttcctctctgtttagctccccatttttatttggtgacatctacctaatctattctttcaaaagggtgatgttgatgtcatttgtggaggcccaccatgtcaaggtataagtgggtttaatcggttcaggaaccgtgatgagccacttaaagatgagaaaaacaagcaaatggtgactttcatggatattgtggcatacttgaagcccaagtatgttctcatggaaaatgtcgtggacatactgaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtcagttttgtaccttgctgttttatatgctttgctagatttatattgcattgtcgactggtggctaatcaggtgtagttgacaatgtaggtgctccctaagtatcctctgcctacatatgacgttgtagtacgtggaggagcacctaatgccttttcggtaagtgcaatcactacatcgaaatcctttggaatgtgtaaaatttgttgaccaactgaatttgtttgcagcaatgtatggttgcatatgatgagacacaaaggccatccctgaagaaagctttgcttcttggtgatgcattttcagatttaccaaaggcaagtgttttgtcaagttcaagtatttctcaatgtgcatgcagtcttacacttactcctctctgcaggtcgaaaaccatcaacctaacgatgtaatggagtatggtggttcccccaagacagagttccagcgctacattcgacttggtcgtaaaggtaaaaggcccattgaactttactggttgacctcttctaattttagaagaacaatcttttttcttggtgcttttctgcagctacatatgaagtttactctatttttattctttcagacatgttggattggtcgtttggtgaggaggctggtccagatgaaggcaagctcttggatcaccagcccttacggcttaacaatgatgattatgagcgggttaagcaaattcctgtcaagaaggttggtggcttgatagtgttattgtgccttcctttgttgtttgtcctgaaacaatcttcactctttcctatgacagggagccaacttccgtgacctaaagggtgtcaaggttggagcaaataatgttgttgagtgggatccagaagtcgaacgtgtgtacctttcgtctgggaaaccactggtatgtgctgttcattgctgttgtttccacaacaatgcaacatttatgctacatgttcaaacttaaaacagatgagatggtgcaagtactgtgagattcatggttaagacatgctaagttattgcacaaatctttgtcatctaggttcctgactatgcgatgtcattcatcaagggcaaatcactcaagtaagtggcaaaatggtcctgctttctttattttttttgggggaaaaactaggctattggttacttatccttgtatatatgatgttgtaggccattcgggcgcctgtggtgggacgagacggttcctacagttgtgaccagagcagagcctcataaccaggtcagcttcagcacaaactactcttatcctactccctgcggctgtctttactgcttgtgtagtctgtatacgaccctgattgaacgtgtccgtaggttatattgcatccgactcaagcaagagtcttgactatccgggagaacgcaaggttacagggcttccccgattactaccgattgtttggaccgatcaaggagaagtaagttccatcttttcagtttgcttgtacttgatctattaactcttggcagttgtcagctgttaaggattgatcagtcaattacagctcttgaaatcagaagcagttactgacataaactgcacggcgatgtgttactaacatgtgggcctagggccctaggtgctttagacccatagggatcatgctgcattgcaatccttctgaacaatgtgtgctttctcatggctataggtatattcaagtcgggaacgcagtggcagtccctgttgcacgggcactgggctactgtctgggtcaagcctacctgggtgaatctgacgggagtcagcctctgtaccagctgcctgcaagttttacctctgtggggcgaaccgcggttcaggcgaatgccgtttctgttggcactcctgcgggggaggtagtcgagcagtaaaaggatagcggagcaaccctggttggtattttgattcgagcccatccagtagcatgtttaccaataaataatcattggtcgtgctgattcttatggttggagatgaatgtatgtagggtgtactcgagctcgagtgcttgttgtactgtaggttgaggtttctcatccattggcctgcctatttgtggatgacgtttcatttcagattagcaatgtgcttatttaaggtttcgtcatgtacctgtattctacaatccactattgtttccaaagacagcatttgatccttgttcaacgcgagcagattttcgtccaccaaagctgtgtagggatcgaaatgtcaacaatgaattgagtcattcaatcatttgtctaa

SEQ ID NO: 673 - DNA, 10866 bp, Zea mays
gtggcccttgcagggaagttttgttcccggttgattgagaagaaggaaagctcactcggtccgagggaccgtttgagagagggaagggttgaaagagacccggcctttgtggcctcctcaacggggagtaggtttgcaagaaccgaacctcggtaaaacaaatccacgtgtcactctccttatttgcttgcgatttgttttgcgccctctcttgcggactcatttattattactaacgctaaccccggcttgtagttgtgattatttttgtaaatttcagtttcgccctattcaccccccctctaggcgactatcagttggccgtcaccaggtcgccgaggtacaccaccaagtctgagcgaagatgcgtggatcgaattccgccgccgcagagaccatgaggcagagagggagttccgtttcagttctttgattctttcggaggaaaagggaaagggtaaggggagcaaaaggagagcgtgcgcatgcacgcacctgggttctcgacgtcgaggacggcggccatgacgcggtcggacgcggcgtcctgcgcggggccccagtccgtccacgcgtcctcgccataatgcaggtccgcaaacagggccactttgaacactcctcctggcccgaaccacagcggcggcagcgagcagggcgggcgcgaggctgcgccaccacttgcacaatgcggatttgctcgacggcttgggcggtgtggtcctgggagcatcgggcttggcgcgttcttgtctggtgaagccccgcgttcggagtcggagggaggtgggcgacattcacggcgggactcgcttggttgacgggatctacgcgctggtggtaggagatcccttgatggcggcacggatggcgtggggcggaggcgttcgtcgcggagccgggatctacgcgctgggggaggatcgcggaggagagggggggcgcgggcagacagctgtagacgcgctgggggaggatcgcggaggagagggggcgcgcgggcagacagctgtagagaggcagaacacggcgggtgtgcacgcctacaataagaaagtaaagattggagttattttcacaaagctgattctcataaagacataaacggctaaagctgtctcatggtcataatccgactgaaaacgaaacaaacaggcccaactacccacacagtttgggccaccctacagctggttcatgtgacagacagggctggaggtagaggggccaacatccgaaagcctgcggcgctcgcgggagacgaacaaaaattcgaatccgggctctcccgctggccgctgcagcctgcagaaggctccgcgccgtaaaaaattggacgttcccgctccctccatctttttggttcgggtttcgttttcccactgccgctcccgcctcctctctgccctgtttccacatttgaccgatcctcttcgattcgatttctacacccccagagcttgccaaacccctcgtctcccaaccctagagagcagcagcagcagcagcagctaccgcatcccttgccatggcgccaagctccccgtcatccgctaggcccacgcgcgcctccggccggaagcgctccgccatggccgaggagatccaccagaaccaggaggaggaggaggaggttgtggctgcgtccaccgccaagcgcagacgcaaggcggcgtcttccgggaagaagcccaagccgacgcccaagcaggccaaaccggccgtggcggggatgaagaagaagggggagaccgagaagacggagcccgttgtggacgacgtgtgcgccgaggagcccgacgaggaggagttggccatgggcgaggaggaggcggaggccgaggagcaggccatgcaggaggtggtggccgcggtcgcggccgggtcgcccggtaagaagagggtggggagaaggagcgccgccgcctcgggcgaccacgtgcccgagttcatcggcagccccgttgctgcggccgaggcgcacagcaactggcccaagcgctacgagcgcagcactgccgcaaataagtatattgtccctcccttcttaccctggtttagtatgactatgactggatttttgctccctgttcgttgcttgagagctgagcaatttgctatttgttaatctattgcgcatgcagaccggaggaggacgatgagctcaaggccaggtgccactaccggagcgctaaggtggacaacattgtctactgcctcggggatgacgtttatgtcaaggttttgcccatcgtcttcattgcctttatttgtcatgctgctgctgctgctctcatttacgcactgctcatgtatttgttaaggaagcatcacttaattgttttttgttgtccatttgcaatctgttgtgcgtgtggtcagcgcccagcgttacatggtcagcggcgggcctaggatttgaagtatgagtattcaaatttttggtagaacatattttttgacaatttaaaattacactattgtactgtatgatcggttgaacggtacataaatgaagagggctagtgaaaaccaaagtttagacaaaatagctgtaaaacagtatgattttatgtttttttataatattttagcttatatacataacatatacatgtatatataattgttttgccaaaaataatgagtattcaattgaatacccttgcttgcatgtaggcccaccactatacatggtggtactttcgacgcaccgtttttttggtaatttttccgaaaaaagttcggtaaacgtgaattttggtccttttacaaatctatggcgccgagcaaagagttcataaatatcaagctttgccaaaaagctttgctaaatacaatttgggaacaaaaacaactttagcctctaatagtttccaattcttaggttgttaaatatttttaaattatgctaacttaatggtaagttcaacattttcaccgtttaaatcgcttgtgtgccattggaatactcacatgtgttaagtatttgtgactagagggagtataatataaaggggtgccagccattgatcacatccattatgatctctgagagcatttgaaaattttcttgtcttatttgcctgtttatgaagttaaagtgttgtttgtgtcttaaattttagtttgatgaaaattcttagtaattcagctgaacacaaacattgatgatgcaatgcaatgatttcaagtcgtccgactaatcgcgattaatcgcgattagtcgggctggtcggtaattagtacacgatttgctggacgactcgaccagataacctagtcgtcctggtcgtccgactaatcgtcgactagggtgactagtcgtccgacttatgtgtcctggtcgtcccggctagggtttagttattaggccttttttagcccatctacagtcactgcacgtctcctctcctctcctattataacctacccgccaacagtctctggctctctacacgtctcctctcctctcttgcaccgcccctgcagtcctggactttgattgctgacggctacagcaccctgcgtccctgccctttctcctggagtcctgcagcctgctgcactactgcagtctctaatttatataatgtatacatgtatatttatatatatacctatatacgtatagctactagtgtaggacgaccagggaccgactaggaccgactaggagtcgactagtcgccctagtcgtcgcctaatcgcgactagtcacctggtcggtcctagggttcgaccagacgactaggcgacttgaaatcattgatgcaatgaacaagtatggtcgaagtaatggttgtgtgcaattcttctggattgttttgctctcacattacaacattttatatgttctttaataatagttattgaccttaagtttctggttcctttttgcttatcttaggctggagaaaatgaggctgattacattggtcgcattactgaattttttgagggcactgatcgatgccactattttacttgccgttggtttttccgtgcagaggacacggtgtgtattgagcttaatgtcatttctatttatatcaagaattagcatagaactgaaccttaacagtgcaggtcatcaattcgttggtgtcgattaatgttgatggccacaagcatgaccctagacgtgtttttctttccgaggaaaagaatgacaatgtgcttgattgcatcatctccaaggtcaagatagtccatgttgatccaaatgtaagttccctgctaagagctttgcggttttgctatacacataatatttctcactacaattgtttctttgctttagatggatccaaaagctaaggcccaactgatagaacattgtgacctatactatgacatgtcttactctgttgcatattctacatttgctaatatctcatcaggtaattgcttctacatcattcttttttggttgactagctgcatggttattaaaacgacgaaacgttgaaacactcatggatggacttttaacttttaaactatttaaacaaagtttaaacgtagttataaacaacatagggaaatttcaatatatcataatttcaggggaaatttggatccataccattaaaagatcaccactttagattcataccattactatctcacttacatgtgggtccacatgagtcaatgacatgtggggtccatgatatatatctaaagtttggatcttttaatggtatagatccaattgttcctaatttcagacaattatataaagtcaaataccaaacaagcaacataagttcacataataatattgtgtaaaatgacatgtccacaaccacattaccacaataacacaagttcaactaatagcaagtcgacaaccgtaaacaaagtggaatgggatgtctaatagtccaccatcaaaaacatagcacaaaatcaactaaagtagaatgcaatgtccacaaccacaagcacacaagtgttactcaagcactcaataaccatcatccaaatcatctaaaccaatatcatccttgtcttgctcatcaccacgggcaccactgttgtttgtttcttcttcatcatccatatcaaggtcgtcaagcacaaaattgtaacctgggcggaatctctaattgggctgggccaaaatttacaagcaggcaacttaaacgttcgaaacgtggcgtttaactatatatcgcgtttaaacgtcaaaacatgacgtttaaacgtcgttaaacaacgttttacgaggaagtgtgaaacgtttcagcgtttcagcgtttcgctgttctattagcgttttatagtttaaacgacgtttaaacgttgttttaataaccatgactagctgaatacaatttactggctttgctaaattagtggaatgacactactaaccaaatgatctcccactctaatgccttttacaatatttctatgttatgctagaaaaaaaattaacttttatgtttccaattagatttacactgaaaatcagagtttttaaggcattaagctgactggccccctttttactttttaatctttatggtgtaagatgatgtgactcttgtgtagtatatagaaataggaaatacaatagtaaataggatcatagtctcaaataaatactctctcttcgcttgagtttgtcattctaggtttatcataagttaaattgtttgaactttaaccaataatgaatatatgattaagttattttaatctaaaagaattatatattatgataattcaatttatgataaatctaataattttattttttgttgtaaaattttataaaacatcttatataaccggtcaaagttgatagtgatggacttaatacaaaactaaaataacaaactcatatgtatggagtagacagtaataatagtactatataagcaataggagtacaagttaacctaaactaacatattagctataaagtctacaaagaggataattcacattcactttaccatttaaaaagcaaaatagagtgctgaaccggtattgctctgactcaacatagggtgggagcagagagagcagcacctcctgggtctaggccgctctcgcagagagagcagagagggcgaggggagctggccgatgttggacggtgatggatggcgggggcagggtggaggggagctcgcggaggcagggccactgactgctgcaggagagagggaagaggcaggggcgcagggcggctaacatcgctgccgcctagaggcagtgaagaggtaggggatctcgcgggaggcagggccgctgctgccacctggagatcccgaatcccgaccgccgccgcctggagctcccaaccgctgacgcctggagtgtttcgcgtcgtaaggctctatgtaccccgcggccctacttagggtgtttggttcttttagagcatgtaatccctttgccattcaattttgatctctcaaatctcctccattatcactgctcccaaaaaatccttagagcgtgtttgatttttagtcacccttttaaactttagtgattaaaccttattctctaaaaaattatttggaagacatttttgtcactccgtttagtattttagtgaataaaaataactaaactttagccattgaaattgaagtttaggaggtgggagacaaacacttccttagttcctaaactttaggactaaactttgtccttagaaattatatttggaagacctattttaatcaatctctttggtattttagttttaaaagatgggaaccaaacacccccttaatcctgcgtaccctaacatcaatcttttaccccaaaccctacaaaggctaagatcttcgcaaatcgaagcgccaaggtgacatatcaaaccctaaggcggatgcctttcgagttgctgcaagtttactatgacgccctagctgtcgaactcgcctttccacttaagctctatctaagtgatgcttaattgttgcctcgagttgttctttttaggagagtacataatcatgttttagtatcattgaaggataactgaactgtctaccttagacatctctattttaaagtttgtttttggctaccggccaaatgccaaaaactgaaataaattcaacttttaaaattagcttatgaagaagccaaaagcaggtctagagatgtttttcctgtcttttttttgtatatgagatagcaacgtgtatgtacccatatggtagtactgtttcatattcacagtactagataaaattctatttgccatgtctgcataacatgtacccaaatgtatacttgttatagacaaaatcctaaatacatcatgcaattaaaatctaatagtgtaagtttctgtaaacaaaaggacaattgttaaatgtgtatgttttttttgcaaaacctcacaattgtttttctactagaaaatgggcagtcaggcagtgaaaccgcttcgggtatttcttctgatgatgcgggtttggagacgtcatctaatatgccagagaggacagcaacccttcttgacttgtattcgggctgtgggggcatgtccactggtctttgcttgggtgctgctctttctggcctgaaacttgaaactgtaatattctacctagttatctgttggatagaacatgttcttacttaccactgattctactgttatggctatgattgcagcgatgggctgttgatcttaacagttttgcgtgccaaagtttaaaatacaatcatccacagactgaggtatgcatattaagctgcatcttggattccatctgttctgtccagctgctctcaaaaagtttctttggacctttgaatgtaggtgcgaaatgagaaagctgatgagtttcttgctctccttaaggaatgggcagtcttatgtgaaaaatatgttcatcaagacgtggattcgaatttagcaggttcagaggatcaagaggatgctgacactcttgacaaggatgaatttgttgtacagaagcttattggaatacgctatgatggcactggaaggaaaaaaggcgtatattttaaggtattcaagcattatctgttcatttatacttgattccaagaaaaagttcaattactatgatgatataggaaaaagtttttgaacaatggacatttctttgcattttggtgtaatgctaaatttctgcaggtccaatgggaaggatatggtcctgaagaggatacatgggaacctattgataacctgaggttagtattttggtagtgtcatctgcttgttgccttgtatgtctatttgtactctaatccttgtttcacgaaccagtgactgtccgctgaaaattagagaatttgtacaagaagggcgcaaaagaaaaattctcccgcttcctgtgagtatttagttgggtgtggttttcctctctgtttagctccccatttttatttggtgacatctacctaatctattctttcaaaagggtgatgttgatgtcatttgtggaggcccaccatgtcaaggtataagtgggtttaatcggttcaggaaccgtgatgagccacttaaagatgagaaaaacaagcaaatggtgactttcatggatattgtggcatacttgaagcccaagtatgttctcatggaaaatgtcgtggacatactgaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtcagttttgtaccttgctgttttatatgctttgctagatttatattgcattgtcgactggtggctaatcaggtgtagttgacaatgtaggtgctccctaagtatcctctgcctacatatgacgttgtagtacgtggaggagcacctaatgccttttcggtaagtgcaatcactacatcgaaatcctttggaatgtgtaaaatttgttgaccaactgaatttgtttgcagcaatgtatggttgcatatgatgagacacaaaggccatccctgaagaaagctttgcttcttggtgatgcattttcagatttaccaaaggcaagtgttttgtcaagttcaagtatttctcaatgtgcatgcagtcttacacttactcctctctgcaggtcgaaaaccatcaacctaacgatgtaatggagtatggtggttcccccaagacagagttccagcgctacattcgacttggtcgtaaaggtaaaaggcccattgaactttactggttgacctcttctaattttagaagaacaatcttttttcttggtgcttttctgcagctacatatgaagtttactctatttttattctttcagacatgttggattggtcgtttggtgaggaggctggtccagatgaaggcaagctcttggatcaccagcccttacggcttaacaatgatgattatgagcgggttaagcaaattcctgtcaagaaggttggtggcttgatagtgttattgtgccttcctttgttgtttgtcctgaaacaatcttcactctttcctatgacagggagccaacttccgtgacctaaagggtgtcaaggttggagcaaataatgttgttgagtgggatccagaagtcgaacgtgtgtacctttcgtctgggaaaccactggtatgtgctgttcattgctgttgtttccacaacaatgcaacatttatgctacatgttcaaacttaaaacagatgagatggtgcaagtactgtgagattcatggttaagacatgctaagttattgcacaaatctttgtcatctaggttcctgactatgcgatgtcattcatcaagggcaaatcactcaagtaagtggcaaaatggtcctgctttctttattttttttgggggaaaaactaggctattggttacttatccttgtatatatgatgttgtaggccattcgggcgcctgtggtgggacgagacggttcctacagttgtgaccagagcagagcctcataaccaggtcagcttcagcacaaactactcttatcctactccctgcggctgtctttactgcttgtgtagtctgtatacgaccctgattgaacgtgtccgtaggttatattgcatccgactcaagcaagagtcttgactatccgggagaacgcaaggttacagggcttccccgattactaccgattgtttggaccgatcaaggagaagtaagttccatcttttcagtttgcttgtacttgatctattaactcttggcagttgtcagctgttaaggattgatcagtcaattacagctcttgaaatcagaagcagttactgacataaactgcacggcgatgtgttactaacatgtgggcctagggccctaggtgctttagacccatagggatcatgctgcattgcaatccttctgaacaatgtgtgctttctcatggctataggtatattcaagtcgggaacgcagtggcagtccctgttgcacgggcactgggctactgtctgggtcaagcctacctgggtgaatctgacgggagtcagcctctgtaccagctgcctgcaagttttacctctgtggggcgaaccgcggttcaggcgaatgccgtttctgttggcactcctgcgggggaggtagtcgagcagtaaaaggatagcggagcaaccctggttggtattttgattcgagcccatccagtagcatgtttaccaataaataatcattggtcgtgctgattcttatggttggagatgaatgtatgtagggtgtactcgagctcgagtgcttgttgtactgtaggttgaggtttctcatccattggcctgcctatttgtggatgacgtttcatttcagattagcaatgtgcttatttaa

SEQ ID NO: 674 - DNA, 9255 bp, Zea mays
gtgcaccggactgttcggtggtgcaccagacagtgtccggtgcgccaggctggctctggtggaaaggccgtcctcgggaatcgtcggcggcgtacggctaaaattcaccggactgtccggtgtacaccggactgtccggtgagccaaccgtcgaccgcgcaatccgcgcgtgacgcgtgaccaagccaacagtcagaagggggcaccggactgtccggtgtgcaccggacaggggacaatttgtttttcaaaacaaactagtgtatgctcctactctgttagctgtacttaacattgttaagtgttgataaaaatacaagagataattgcgccaatgcccctgttttagcgcaattgtattttactatatttttagacttacatgttttatgacaattcaaattaatcccacaacgtttcaaattattttaacaacaattcaaactatttgcaacaatttaaattatttttaaagatttaaaaatattgacaaattattccatcaacattttaaattattttgcctcatcacactaatttaattagttagatattttttaactttgaaaataataatttgaattgtcataaaagcggacaaagtctaaaaaaagcggtaaaactatagttacacaacaaaacagtgacaatggcgcaattgtttcttgtcttctttatcatgacttaacactgttaagtataaccaacggagtatgggcatacatcgttttattttgaaaaacaggggcaaacgcgcaaagttttaaaaagggggtaattctacagttacaccctaaaacagggacaccatcacaattgttccttgtttttttagtaaagttttgttcatgtcacagctgatgtatgaatatcaattgtaagtactaaacatagtataattacaaaactaattacacaaacaaagactaaattgtaagacgaacctgttaagtctaattaattcatgattaacaaatgtttactgtaatatcatgttaccgaatcataaactaatcagatttaatatgttttccttattatgtgtgtaattagttttataattatattatatttaatatttgaaatgtgacaatactaaagctaagcctcttaagcccaacaatccacatattttagatttaaaatttgaaaacagacgtatcggctagaagagccctgtcactgtcagctaatcaattacaagaagtggcccatactagttccatcaccagtccagtagtccaccaccccaccctacagctgggtcatctggcacgggtggaggggccaacggccgaaagcgccgcgcacttccggcgggcaccctcgcggagtcgcgggtgacagcgaaatttcaaatccataccctcccgctgcagacgggtcccacgccgtcaaaatttggacgctcccgctccctcgatcttttgggtttcgttttcccagttcccaccctctcttccaccctgccctgtttccagatttgaccgatccccttcgattcgatttctacacctccagagcactcactctcctggcaaaccccttcgtctcccaaccctagagagcagcagcagctaccgcagcccctgccatggcgccgagctccccgtcacccgccgcgcccacacgcgtctctgggcggaagcgcgccgccaaggccgaggagatccaccagaacaaggaggaggaggaggaggaggaggaggtcgtggcggcgtcctccgccaagcgcagccgcaaggcggcatcttctgggaagaagcccaagtcgccccccaagcaggccaagccggggaggaagaagaagggggatgccgagatgaaggagcccgtggaggacgacgtgtgcgccgaggagcccgacgaggaggagttggccatgggcgaggaggaggccgaggagcaggccatgcgggaggaggtggttgcggtcgcggcggggtcacccgggaagaagagggtggggagaaggaacgccgccgccgccgccggcgaccacgagccggagttcatcggcagccctgttgccgcggacgaggcgcgcagcaactggcccaagcgctacggccgcagcactgccgcaaagaagtacagtttttctcccagctctggttttgatttgaccagatttttgctccatgtctattagtacttgtgagccgagcaatctgctatttgctgatttattgtgcgtgcagaccggatgaggaggaagagctcaaggccagatgtcactaccggagcgctaaggtggacaacgtcgtctactgccttggggatgacgtctatgtcaaggtccttgttcatcgctttctgttgcttctgctctcatttatgatgtgcatatgtgtttgttaaggaagcaagaattgcttgatttttgttgccgactcgcatttccgtgacgagttctgcgtatggtcaccggtacgtggcactgatacacaacgtggtatgctggaagtctggtagtatattttgcatcgaccaggaggtccagatcgatatgtgcggtatagtgcttatttgattgcaccctgttcggagattcatgcatgatggcgtgtttagatgacgcctcccagacagctgcctgctaggcagctgattctggcccaggcgtccggaatggtgaagttgcgctggcaagattctcaggccacctaccaaatatgccctggagcatattgcatgcttctttttttgttctctttccttctatatttatctcattgttagtgaagtttcacattgcgcgtgtcatggaatatttactttcaaatcaacgaggagatgctagcattgaggtgtgtgataattattacatactagaagatatcgtgcatgttgccattgggattgcgaagaatgtggaaatgatgttggtagcttgtattaagaggttaacagttagtgggatgacatgactattagttagagatgatgtggatagtaagtgggatatgatgtagatgacttgtgtgttgagacagaactataacatggagttggaaatgggagcagcatggtcaaacataccctaaatgcctgtctctacacaatgtggtgattggtgtatagtctggtgttaaaagctggatactttgattctgttgaagattgtcacacccgaatttaaggacaaatctagatacatctcatatgttcaccaggatagtgtatagataccaatgtcataatctttattacacgacgataatgtcttacaaaatatctggtgttacaagatgcacctttcaacatgtttaatgctgcaaactgttttaattaaacagaatgcagtgttttgaacaaaaaaatgctgctttatcctgcatcttgttttgcatgtgtcagcaattgcttacattccattatgatctctgagattctttaaatttctagcctgatgaaagtatttactaattcaactgaacacaaacattgtttgaatgaacaaggcaacacggatgcttggaataatggttgtgtataatatcacttagtggttttgctctcacaccacatctttcatgggttctataataatagttactgactttaagtttcttattcctttttgtctatcttaggctggagaaaacgaggcagattacattggccgcattactgaattttttgaggggactgaccagtgtcactattttacttgccgttggttcttccgagcagaggacacggtgtgtatttagtattttgtcattctatgcatgtcaagtggcatagcactcacatttgtcatggcaggttatcaattctttggtgtccataagtgtggatggccacaagcatgaccctagacgtgtttttctttctgaggaaaagaacgacaatgtgcttgattgcattatctccaaggtcaagatagtccatgttgatccaaatgtaagtttgctgcagtttgctgagagctttgtggttttgctatacacataatgtttctgactaccattgttttgttgcctacttgccttagatggatccaaaagccaaggctcagctgatagagagttgcgacctatactatgacatgtcttactctgttgcatattctacatttgctaatatctcgtctggtaattccttctgcatcatcttttttggttgactagctgaatgcagttagctttgccaaagagttaaatacatgagttgttcctgcactcgtcaagggatgtcaataatgtccacaaactctgaaaatgtatttttagatacttaacttgttaagtcagtaaaacctgtcagatacttgggttttgggtacgattaccatccttatgtgagtaaaactcgtcaagggatgtcaatgacgtgttgattgtgtattagatattctgtttgttcgaaagctaatctacacaaacagcttatgtaatgtaaaacctcaaacaaacttgcctcttcataagcttaggtttataggattagcgtttagtgcatgtaaggcctatttgcttcacggcctccctgccgagctcctggctagacagccatcctggccgtaggtgcccgaaatcgaacacctgggagccacgtttgcactggcaggttttcctgggtgcaaaccaaacacgcctatagtgttcaagtataactgaattggtgctcacctttgtctaatagcttaagtttttggttttcatcggtgcatgcaactccatactcaatagtcaatatgatatagtgttcaagcatagaactctcgagtttgaatcctggcaggggcaatcaaataaaataattgcagcttacccctatttccacgtttgagcacatgagggagagtgttgaattataagtgtgttctccatctttctctaacagattgaactggtttgtgcatgcaactcaatatgatatttgagtcaaatgtttactttaaaatcatagttgatgcaatttaataacatatttttttggtctcgtgtgagggagtgtacgtataactgaattgcacacatttccttatcagcttaggtttttgactgcaactgttggtgcatgtagctcaataactaaagttgatctggacagtctacagtgaataagtttgacacttgtaaaatgtgcatgtatttttacaaacgctggcacttttttcctaatagaaaatgggcagtcagacagtgataccgcttcgggtatttcttctgatgatgtggatctggagacgtcatctagtatgccaacgaggacagcaacccttcttgatctgtattctggctgtgggggcatgtctactggtctttgcttgggtgcagctctttctggcttgaaacttgaaactgtaatcttctaactagtcatctgttggatagaatatgttcacgatctcagaacttattctattgttctggcttgcagcgatgggctgttgatttcaacagttttgcgtgccaaagtttaaaatataatcatccacagactgaggtatggatagtaaacttcatcttggattccatctgttctgtcagctactcttacaaagtgtctggatttttggatgtaggtgcgaaatgagaaagccgatgagtttcttgccctccttaaggaatgggcagttctatgcaaaaaatatgtccaagatgtggattcaaatttagcaagctcagaggatcaagcggatgaagacagccctcttgacaaggacgaatttgttgtagagaagcttgtcgggatatgttatggtggcagtgacagggaaaatggcatctattttaaggtacttcagtgtcatttgttcatttctacttgattccaacaaaaaaatcaattacttaagcctgtcaaacgatggatatttctgtatattttgctgtaacgctagatttctgcaggtccagtgggaaggatacggccctgaggaggatacatgggaaccgattgataacttgaggttagtgtatggtatatcgtctgcttgttgccttgtatacctatttgcatctaatccttgttttgcaaaccagtgactgcccgcagaaaattagagattttgtacaagaagggcacaaaagaaagattctcccactgcctgtgagtatttagttcgttgtgattttgctcgctatttgtttagctccccttttttatttggtgatatctgcctattttattctttcaaagggtgatgttgatgtcatttgtggaggcccaccatgccaaggtatcagtgggtttaatcggtacagaaaccgtgatgagccactcaaagatgagaaaaacaaacaaatggtgactttcatggatattgtggcgtacttgaagcccaagtatgttctcatggaaaatgtggtggacatactcaaatttgcggatggttacctaggaaaatatgctttgagctgccttgttgctatgaagtaccaagcgcggcttggaatgatggtggctggttgctatggtctgccacagttcaggatgcgtgtgttcctctggggtgctctttcttccatggtctgttctgtaccttgctgttttatatgcttcgctagattcatattgcactgttggctgctggctaaccaggtgtacgtgtatttgacaatttaggtgctccctaagtatcctctgcccacctatgatgttgtagtacgtggaggagcccctaatgccttttcggtgagtgcaatcacaaaccactactatgaaatcatgtggaatgtgtaaaatacgctgaccaactgaatttgttgcagcaatgtatggttgcatatgacgagacacaaaaaccatccctgaaaaaagccttgcttcttggcgatgcaatttcagatttaccaaaggcaagtgttctgtcaagttcatgcatttctcagtgagcatgctatttaactcttctctgcaggttcaaaatcaccagcctaacgatgtgatggagtatggtggttcccccaagaccgaattccagcgctacattcgactcagtcgtaaaggtaaaaaaccccgtgaactactactggttggccttcactacgaatatgttaggatttaatttcagaagaaccgccttttttttcttggtgcttcggtactactgcagcaagctcactcttattatcatgtcagacatgttggattggtccttcggtgagggggctggtccagatgaaggcaagctcttggatcaccagcctttacggcttaacaacgatgattatgagcgggttcaacagattcctgtcaagaaggttggtggcttggtcgcatttgtgccttcctttgttgttttttccccttctgaaacaatcatctctctttcctatgacagggagccaacttccgcgacctaaagggcgtgagggttggagcaaacaatattgttgagtgggatccagaaatcgagcgtgtgaaactttcatctgggaaaccactggtatgtgtgctatttcgtgctgttgtttctataactgtgcaacatttactttccatattcaaactcataactgacgagatgctgcaactactgtaagattcatggctaacccatgacaacattttgcacacatctttgttatctaggttcctgactatgcaatgtcattcatcaagggcaaatcactcaagtaagtttcaaaacattttttttgtttttttggggaaaagtaggttattgtttacttgtgcttacatatgatgttgcaggccgtttgggcgcctgtggtgggacgagacagttcctacagttgtaaccagagcagagcctcacaaccaggtcagcttcagaaaggccactccttttcgccaatccctgcatctgtatttactattagcgtgtgttcccatatgatcattaccgaacatgttgtccacacaggttataattcatccgactcaagcaagggtcctcactatccgggagaacgcaaggttacagggcttccccgattactaccgattgtttggcccgatcaaggagaagtaagttcctgttttcaagttgcctgtaccagatctagtcactattgaaagttttcagcagcaagccattcatcagttagttacagctcttgaaagccttacctctgaacatgtgtgctttctctgatggtgataggtacattcaagtcgggaacgcagtggctgtccctgttgcccgggcactgggctactgtctggggcaagcctacctgggtgaatctgaggggagtgaccctctgtaccagctgcctccaagtttcacctctgttggaggacgcactgcggggcaggcgagggcctctcctgttggcacccctgcaggggaggtagttgagcagtaaaaggatgacagatctgagctgagctgggcaacatccagcggcaggagcatttctggttcggttcgattcgggctcacgagcgcattgtgctgattcgcagggtgcactcgagctcgagtgcggagttgttgtaatgtaggttgaggtttcaaaacatccatccatccatcggccccgcctatttgtggatggtgtttctcgtgccattttagttcagctgtattgatgcttcgtcatgtatgtgtattgtaccattcgttcttgttacctactagtaaggcaacatttgatccatgttcaacgcgagcaaaattccatccactttaggtactgagatgctcaagtagttcagtcatcaggtaacatttacaacctattattttgcctggtattatctgaaaacgatttgctgaggatgttttttttttgaagtaaaggtactgtaggaaggtcctacagtaatattattaaatcaaaagaactaagtttagggagacagaagaatattacaaagaaataaaagggagagtgaggagggggaagaattctggatacatgtatttactctatttcacataaacatatggacatcaacatagatgtgaaggtatctaatctaaataagcgccgacatgctttacaagatagtttgatctataaggtgagggatgttgtggatgaagattgtgaccaactagctcatgtgtagttttgtttgtagtacctgtcctaaaaaatatgtaattctaagtttaatttgaatcagccttgttttttaaaatttttttgaccaagtccgttaaaaagtaataacattttttacttcaaatagatttactatgaaattttgtcttatggttatctaatgacatttatttaaaactgtaacaaaaactggtttggttaggggactgagggagtagtgcttaaaatggaagacgataggagagatcacattagtggtggc

SEQ ID NO: 675 - DNA, 4481 bp, Zea mays
agacgttaatatatattttttaaaagtttggttaggacagctaaaacgacttacaatttggaatgggtggagttcttgtttgtagtcgttatgcacagtgaatctggtttcattcatttattgtttatttaatatatgataaataaacaaaagtatctctaatgacactgtcttatttcattctcaaaggtacaaccaaacggaaagaactgcatggtacaaccaaagttctttccatgtctggctcttggggttcagatagaagtgtgactaaacttcaaggctacaagttgaattttgtttgtgatcaagttggtcaaaaatactctgcctttgtccttttaattgatgctagtatagcaaaagaagctgctactttagatattgatctatatttgcatgacaagatggtaaaagcttcagtttccccttgtggacctcttgagttggatgcttggcaggtttggtcaagtacattgttcacctactctgttttagctaatatttttttcttacctgaaagatttcttttggttctctcttagatggaacaaacaaaactatttcaagcacttctctttaatagtttgtttggaaaactgttcattggatcaaaagcatcaaaaaccccaagggagttcattctcaagaaagatgatgtgttcctttggaacaaagaaaatatgtatttgcttttacctgtggattctactctggattctcataaaagtgtttgcatcaactggagtgtaattgatgtagtggctacagctgttggattcatgagaagcatttattcagatggcaaatgtaacctaactgataaacttaattatgaaaaaaatggtgaagatcttattcatttggccaacaagtcatgcaagggtaatgatcttaaaaatatggtggttctagcaattcacactggaaagatctatactattgttgttgtatctgatttatgtgccaatagtaaatttgatggtacaactgacaagaaagaagcaaaattccggacatttgcagaatattttgagaagaagtatgctaaatctttcacatattcatatgcttattcaagaatacatagctaataaacggtaaactaacacacttcatttacaggtatagtatatttctttgtcatcctttacaaccattgctagtgttgaaacccacccataatcctcacaatcttctttcctcaaagaatagagatgaaggtataaattataatcttgaactctgttatccttttaactgtagccaagtaataattttgtacaatgatacaaattggttatgctttattgttttttgtagacaatgttgtggaaaataaaaatagggcgaacagccttgttcacatgcctccagagttgctgattccccttgatttacctattgatgttttgagagtattctacttgtttccatctctgatgcatcgtcttgagtcactaatgctagccagccaactaagaagtgaaattgcatacagagattctgatatatcaagcttcgtggtatgatatttatatttttagacatagtattatgttattccttaaaatgtaatgtcacaatccaattccctacacttcctcagattttggaagctatgacaacacttagatgctgtgaggacttctctatggagcgattagagttattgggggactctgttcttaagtatgcagtgagtgcccatcttttcatgacatttcttaataagcatgagggacagttatcgtccagaaggcaagaaacaatatgtaatgccacactttataggcttggtattgaacgcaggatacaggtaatttgcatctcatcattggtaatatgaagaaaagaggctgcattttgcttaaaaaaatgagctatatactgttttaattaactttgtaattgatggaatgtcatccatagggttacatacgtgatgctgcatttgatcctcgtcgatggcttgctcctggacagctgtccagacgtccttgtccttgtgaatgcccagtaaattctgaggttgtaactgaggatattcataggattgatgacaagtctataattataggcaaggcgtgtgacaagggacacagatggatatgttcgaaaaccatctctgattgtgttgaggctctaattggggcctattatgtcgaagggggattaaaagcagcttttgctgttctcaaatggttccagattgagactgaaatcgaggaagagttaattatggaagctctgtcgagtgcttcagtgcgaaactatcttccaaaagttgatgtagttgaattgcttgaagcaaaactaggctacacttttcaaatgaaaggtttgttaatagaggctctcacccactcatcacagcaagaatctggagcaacatactgctaccaagtatggttgatatttatcttgaactttggctagtttaagccttttttattccatttctcattttctctaacggaagacgttttactttcagcgcttggagttccttggtgatgcagtcttggatattttaataactcgccatctgttccttagtcataaagacacagatgagggggagctgacagatttacggtctgcatcagtaaataatgagaattttgcacaagttgcggtaaagcacaatctccatcagtttctacaacattcttcggggttcttacaagaccaaattactgaatatgtgaatagtcttgaaagttcgtccatggacagagccagccttttatccagtggaccatgtagggggccaaaagtatgttttctcctctctgtaggccagtgcatacgagattcgagatcccatgaatgacatgtgctttacgagtagcatattagtgcactatttgttaacatcctttacagcctattggactcctatggtagaaattaggatatatatccggttctacttgtttttcatgtagtttgatattgtcaactattgaaatcatgaaagtaaaagtgcaaaatgtgattggtaggtccatcacactaatcgccatttttgtccgaccccaaagatactgttgaaacacagtttttaaaaccttggtttaaacattgtttttatccagaatatgacatttcactgtcttctttcgcataggttttaggtgatattgtagaaagtatagcaggtgctattcttattgacagcaaacttgatttggatttagtttggcgggtttttaaacctcttctttcaccaattgtcacacctgagaatttggagttgccccgattcagagaacttaatgagtggtctgacaagaatgggtactttattggaattaagtgtgaaaatcgaggagacagcacaatggctatccttaacttacaactcaaggatttgcttcttgtgaggcaaggttgtgggaagaataaagtagatgcgaaagcacatgcagcttccttattgcttagggatctagaggtacttccttttacgccccattcttttggtgaatcatgctgctggttgattcgggacatagcatgtattcttgttgtgttagcaggaaaaaggacttataattccaaggaatgcaagcagagtggaacaacttgaaaagaattctggtactgtaaaacattgcaacaacgtgcttgatgttatggacacacaaaacgtagcaccacctaggcaaaaggaagtagctgtgttaagtaccaccactcctggctctgttcttgataagccatgtacgtgtttgtctcagttgttttgttttgtttttcatccaatatttgtcgggtcgacatctatgcgtatcatgtacaaaacttcacattggtttaatcattgatcttatttgtgcagtggttgtgaaggttaagttgagcaaaggaggacctcgtatatcattgtacgagtcgtgtaaaaagcttcagtggccaatgccgacctttgaattcgtgaaggtcgaaccaaggtactaatgtttcacattgtggggttgcagttggcttgtgtaaagtactacctaatatttcctcttttgaaaataccagcgtgtgctcctcttcctgtggttcgtcacaaaaggttgcgccccaaggattcgcatttgcttcgacaataacgttgcatataccgaacggcgatgtcatcagcctcacaggagatgggcgtgcggataagaagagctcacaggattctgctgcgttgctcatgctctatgagctgcagcggcaacgtagattccaagttcaagaagtatgaggaatcacctcgtggttccatcaccaaagatgcaatgttaccgccaccggcgattattgcttgggcatcttggagtaatgtcaccgccaaatcagtctttagtcgtcagccgcacgggggtgtaagaaaataatgtacttcattctgattctaaattataagacaccccgaattatgtaatctaattatcataatgtcctataatttgaaatggagcggtgttggttactct

SEQ ID NO: 676 - DNA, 18807 bp, Zea mays
cggatccatgaaggggccgacggaggaagaaggagcagctgacggtgggctagggaggggactggccggtggcaggtttggcgcagacctgcttggcgacgacggagggaaggggagggagagggcggtggttgcaggagcgtcagcgacgggggagggagagaccacggctagggacgtcgtcggctggggaaagggcggccgacgatggggacactagctgcggctgctggtgcagcggttggggtggggagggaggggagagaaaagtggaaaactaacctaactctatatctcgtgggaaactctaaccctaaccaaggttgtgagttgtattaatagactcagtttgttgggcctggcccattacacataggtgtaaatgtaattacaagagattaatcctaaaattttaaatgggtactctaacacctaacagtttatacatgcaactgttgaccataagtgtgttttttcaatataaacaacgactctatatcctatcggcccacaaattaacttttactagcaatgatagatggtatatagatagctcataacagttacccagcacgatagtaggagaatagagaaaagatcgctatacttggctaggaatgtaaaccactgctacccgtctaccatattcaagtgaaactcttgactgtgtgcccttcgaatgatagtgtttatctgccaccattgtactccctctgctgcaccttctagcttcgttctaaatcaaacttctctaatattaactaagtttatagaaaaaatacaccaacatctaaaacattaaattatttcatgacatccaccatgaaatatgttttgatggtacctttatttagtattgtatatgctaatatacttttgtacaaatttgatctgagatagagaagtttgacttagacgaaactaacattttggaatagagagagtgtggatgtgttagtgtgtaaatatattaactagtcctaaactctaatgagttgtttatggattattataatctagattatataatccacttaataatctatgttgtttgtttgtctcttaacttatttaagctagattatataatatagagggtaaacaaacatgggagatataatgcaagctaaagctaataggagattagaagcaaccaatcagatttcaagtgaaaggatgccgagctgctcgttattatactaacaaaagcatcagttctgttaagtaaaactaaacacaagaatggagaggttcgtcacgacggtattaggctgaggcgaaatcatgtgccaacaaacgcatttcgcgttcatttcgcaggcacgtgccatgtaacattatgggtccacgtgccagccgctcatcagcgccagcgggaacccgtccgtacctggcacctccggcctctggagtccgccttcgcaacggtaacggtagcggccgcctgccccccgccgtctcccggggcccagccaacgaacgaacacaggccacggccacggcgccacccacacccaccgcctcacgcacttcgccttctcgcccagttcagctcctctctcccccttccgccgtgtctcgctcctcctggctatgccgatttataaacccccaccgcgccatgcgctccccaccgccacagccactccacccgcaccgaaccaatggcggacgccgccacctccgaggatgccgacctgccgcccccacctccgccggcgcagctcccgcctcctcgccgcccgcacaagcggcttcagccgcgggggtactgatcgactctgatctcgcgctgcgcagccgtgtcggggcctgggcttatgtgggttatctcgcttgcaggtaccaggtggaggtgttcgctgcggcgctgcgcgggaacaccatcgcggtgctagacactggctctgggaaaaccatggtcgctatcatgctcgcgcgggagcacgtcctccgcgcgcgcgctggggaggcgctgcgccggatcgtggtattcctcgcgcccaccgtgcacctcgtccaccaggtgcgcgtctggtggcccgtttgtcttctccacgcgggaatgtggtggctggaggctgtgttgttgatgagggaagcggttgcctttccgtgtttgtgctgcagcaattcgaggtgattcgggagtatacagacctcgacgcggtggagtgccatggggcatcgggggttggccactggaacgccaagcgctggaaggaagcaattgggactaaggaggtacgcgccagggttcactgaagcctgccctatgcttgagcttgacacagtaattgagcaattgtgatgtactgtgagatttatggactaccgtgcctaccaactgcctgactaatggcctggaacagcaagcgtcctgtaggggctgtctgattggttgcctccatatgctccagccagacacacgagatgcaggctactgctgtttggtaacctgtatcgccacatgcaaaaggggctttcacgttggctccgtaaatatgtagattttggacgtttttgtggagccaggcccatttgaatgcagcttcttaaccagctaatgattttattagtgtgtgattagcacatatggagtaatattaatatatttcaaagaatattaaacacaataagataaaataaggtctataaaagtgtacttgcacaaaataaatattatagcaaaataattttagcggcttctatttcatgcatcatatctctatacaaacaaccatacaccatctctttctagctaggctaactagatacatgtaaccaaacaccatgcaattgcatgtagccagtctggttgagataggccaggctcacaaatttgagccaggttggaccatgcaggcaaccaatcggatccttagtgttgacagcactgctttttgtgagtagtgctcatcctgagtcaatgtagattgacgttatttttttcataaatgcagtagttcttgacaaaaaatattcttcagtcctggctgaagtacatatacatatgaaatatcctccatctttccgttgctacatggatacttctctacatcagcaaattctcataatccttataaatatgccattgtgatgaacttacatggctttttaatgcattttcttctcttggatttcagtcatttatatgattattcgcttttcagttcaaattcaaagtgctatctatgatttggaatatgtatttactcaagccatgactctttccgtttcttctccctcagattgttgttatgacaccacagatactattggatgctctcaggcatgcttttctaacaatgcgtgtgatgagcttgttaatatttgatgaatgccatcgtgcttgtggaaaccatccatactcactaataatgaaggtaacacaatttgaagatcgtttctttgttttgacttatatttttagataggctttgttccaaactttgcttgagactgaaatgctttgttgttgttgttggtgtttgttccaaactcccttgcattttttgtatagtacatgggttgcttaagccttagtatcacattttctaaataaatgtcatgcaaaagtcctaatgtctttaactcggcttgtgtttaaaggaattttacattgattcggagtggaggccagctatatttggaatgacggcgtctccagtttctaaaaagggtaggagtttctgtatatgacaatcatgtgtaatttctctttttgtcaatcgtttcagcaattatgctgtattgttattttaattatcatgttttatgactataattgtcttcctttttttgtcatactgcataaaaactcttttgataaatttatggtacattcatactccattttggtgtataacacttcttttttctgatattgatacatgttttatgcatcacaagacagtgcattttgggagtgtggtgttctctcttgtactaatgctgctctacttctcagcagtataaatttctaggttatctagcttacatgattagttgatgctttaattttttgtgattttgtgcatctaacttacttcttgggtgcactctgcatttccttgttaattgttttctagggctactattcatcctactggaagctacatatgactaatttactgagtcaaagttgtttctgatctatgactgttttcttaggcatatatttttgttactaattatggtagattcacattttttggatccctagctattatttgggtagggtcacgcagccagtagcacgggagcactattagaatatattgtcctcttggattcacattcctactattaaatgtgccatggtattctattttacatttagtatttactacaaccttctatttataaacaacaacaacagagccttttaattgcaaacaagttgggataagttagagttaaaagccaagagaagccacaagtcaaggttcacgtatgtggataactgttttccatgtactcgtattcaaggctaaatctttaagtatattcctttcaattctccttgtactgtctctttgtgtatcaacttcggtctttctagacctcttttttcattactatcgtgccttaggattccactacgcgctggtgcctatagatgtctctgttggacatgctcaaactatctcgatcggtgttggacaagcttttcttgaattggtgccacccctagcctatcacgtatatcatctttccagactcgatcaattcttgtaggtcataaatccaacgcaacctacgtatttccgcaacacttatctattgaacatgtcgtttttatatggtaacattttgcaccatacaacataacatgtctcattgttgtcctataactcacactttagcttctatggtaccctcttgtcactagaacgtcatatgcttgacgtcactttatccaccctattttgattctatggctaacatctttatcaatatctctgtctctctgtagcattgatcctaaataccaacttatccttcctgaggattacttgatttccaaactaacatagtcttcctcatgtatagaaggttgtgaagcacataagctaaaaccttatattttataggagcttctactatagaagattgtgaagcacagattgctcaacttgagctagtattggatgccaaggttctttctctcttgcagctaatgtttccttaatttttaaatttactgagttcttttaggaaacccaagtttgcagcagcaaactgatttaaatatcttacacgttatcccaggtatatattgttgaagataggaatgaacttgagagcttttcaactggtgcaaaagttgtgaataaatactatgacccttacttgtttgatttggataatctggaatcaaagttacagatgctgtttgaggaggtgacttaaccaaccaactatatatttcttctgattcactagaaaaatgtgtttttcgtagccacagcctagatacctagtatctttttctgcttgtacttacgtataggtttatataaatattgtactgttgggcagtttgatggtttgttggttagactgcaagaatcatctcctaataaatttgaagacactgatagtatattggagatgtcgagaaagagcttgtccagatgccatgggaagatattgtacgaactaaatactcttggtccaattgttactttggaggtattgttttatttaagcaccaagtatttctttttttactgaagggttataatgtccattgtgtcctgcgcgttcgataaaaaaataatgtccattgtggcattgtgctacattctatttattgatattgattagtggcaacaattaatatgcaagcaaccattaggtgcaaacgtgcaagcatgtttcttggtccattcgatttagatccaaccctagatgtaatcgtggtttgttagggtttttttataaagcagcccaacgtggtagtggaagggtttatgtgctaaatatgacatacggttggatctagatcgaatggaccaaaagacctgcttacacgcttgcacctaatgactgcttgcatattagttgttgccattgattagtagctgcataaattcctgtgtccttagtgactcctaattcctacacatttgttaattaatcccattgactctggcctggccagggaatatactggattaagaaattggcaatgctaatttaataggtcacctttgttgtaggaaacaccattaaaataccctttcccttgtttcacaaaagaaaaaaaaggctctgttagaatgtattgcgtgtgtgctgttattgtaatgtgcataggcccacctaactctctattaatacatccccaaccctatttagggttagggtttcactctcctaacaggctccactcagtgaatacatttgccctcctttctgaaaaatttctgattgtttccctgccagtcttaataatgtagcatttgcactgcaaaccatattaccataccgtaccatttgtattagaaaatatgtggtcctgatcgtatgttctgaacattcacctgtagccttttcgtttctttagattttttttttcagttttgaaggactatgttgttcgttctagaaaatcatacatgcatttatctagcaatcttattaaccagagtaactattggtacaatttgaatgtttatatgctaactctttattacatttctctgataggtggtgaagatatataatgaaagcattaataccatagatgattctgaagattgcgtattttctaaagagagcctcaacttacaggtttcctatttcaaagaagctttatttttgattgaagattttttgccacagggtatgatgcattattttactgaattcttacgatactgtcaccagctttgaaactacagtttttatgtatcaatatttgttttctaattcttgtggcattgttctataataggttatggggagctgatgaaatcagaatctggttctgcggaactaactaagaagggatatatttcttctaaagtggagtcactgatcaacattttcaaatcgtttgggtaataccttagtccacttaagatgtttattctattcttttgtttagtcttttgttcgtacaaagatacatttacatgtgttgtctctacagctcgtcagaggaagtgctttgcatgatttttgtagaaagaattacgacagccaaagctgttgaaaggtttatgagaggaaatgtgaacttctctcgtttttcaatttcatacttgactggagggagtacatcaaaagatgctttgagcccagcagtacaaagatttactttggatttgttccgagctgggaaggtattatattttgctagtgcaatttgattggaatattcaaatgatatactaacttttatgtcaatttataggtgaatttgctttttacaacagatgtcactgaagagggtattgatgtacctaactgttcctgtgtgatacgttttgacttacccagaactgtttgtagctatgtccagtctcgtgggcgtgccagaaaaagcagttcaagttatgttcttatgattgaaaggtaaaacattgccacatttaattaactttttttttgatatgggctgtttagctataaaaaagtttatatggtcaccaatattttctcccttcctgagttacacctgttcttaaaccttttcttatatgcttggtctggaactttcaggggtaacttggcgcagcaggaacacatatttcgtataatacgaactgaatactatgttaaaacctttgcactgcataaacaaccaaatactccatcacttgatttgcctctccaagagaagtacatataccatgttgaatcaacaggagcaactatcaccgcagaatgctgtgtcaacctaatttataaatattgtgagaagcttcctaaagataggtatgcttgtgcttttaatctgcttatgttcgttgatctgcaaagggcaggtcttgtgctgtggtgaagcgaaagggcttctaactgagttcgttaggtggtataagtagaactccccaggtcctgagttcgacatcccgtgggagtgaattttaggctggggttaaaaaaattccctcatctgttccatgccaaagcacaggcctaaggcctggtctcggtcgttctcatatgggctacggtgtcgttgtgtatgtgtgaggtaggttttttttgcgctgtggtgaaagctgtctcactgagtaatcaggttgtgggttcgaagcagtctctcatcatttgcagggggagatggcttgccttgttttattaatccttcctcagatcccactcatgtggagcccctggcactgggtctgcctattttatctgtttgttaatctctgtgataacaggaaacccagccatattataatacaatcactatatctctaacactctgtttcaacatatgcatgactgttatgcttaaactttcatttggatttgttcctgttatgggtagtatttgcatgtgggctgaaaagttgatcaaactgaaatgtcactcataatggaataactacacctcctaccccatgatattgctgtattttcgttgcataaacatggtgcttcacgataggattcctctccaggtattacttgccaaagccttgctttgaggtgggtcttaaggatgggtcatatcaatgtaccttgacaatgcctcacaatgctgcatttcgaagtatagttggtcctccaagtagttcatgtaatttagccaagcagcttgtatgcctggaggcatgcaagaaactgcacgagctgggagaactcgatgatcatctagtacccttgactgaagagcctatggatattgatacagacacaacagataaaaaatgtgtttctggaccaggtatggttctaatgtctttcaagtgttgcttcgtgcttacatcaatgttttattgagaggaatacctcttcatatatttagctctgtttcaacaataaaatactgtacagtgagtgagtctgtttatagtggttgtgactcagaacgggcatgaactttttattttttgacagtgccattattcttggggcatggcgcttatggctacaaaggaaccgggtcatctttgatggggaatctctttccataagcataagcaaagtgcaaagaagttttttagatgagttagtttgttgggtgatggctggagcgaaacatcttgggaatttaggcttagtgggagctcttaatgtcattgtcatcgggtcgagttagattctaatatgtaatagttcttttgtgtgtgtggttttggggcctagcatgccccccccttctagttgtaagaccgtttttctcctctctaatatataaagatgcgcagctctcctgcacgtcgagaaaaaaagatagaacttgatgaactagtggtgattgaatctgtttgtttccttgcatggtgcatcatatttacttgtgccgaaactctcttcatatatgttgttatctttgtgaacttgtttattaagaaaatgtctccagaccattgaaccctgtcacctttatgtaactatctctcatttgttatctttgacatttgattgagcaatcactgaatacttactttgcaaatggaagttggcagtagcattcccatgaagtattagcaacagctacaagtgtttctccttctgaagaagattttatatttttttcatgcccttgccctttcaccattttggcaggaacaactaaacgaaaggagcttcatggaacgataaatgttcatggtctatctggaaactggatccatgaaagtgaaactgtgattctgaatgcttacacatttgattttcgttgtgatcaagaaggtgaactttatgctgggttcgttctcttaatggaatcagtacttgatgatgatgtggcacgttcagagatagatctcttccttatacctaataaaatggtgtacaccaccatgactccttgtggaaaaattcaactgaacaaagagcaggttattcaagaaaccgcaactcctgttgctagatttctttttaagtttaccagtggcttactttccttagtttttttgtcagctgtgtaaaggaaaattattccaagaattcttcttcaatggtatatttggtagattatttcatggttcccgaacggatgaactgcaaagggaatttattttcacaaaaggtcatgaaatacaatggggctcagacaacatgtacttacttttgcctttgaggaactcttcacagatacaacatgatccaaacatatactgggaagccgttgagtcttgctctggtacagtagagcagttgagaaatttgtatctagaagatggaaatctcaaccatgaaaacttatgttcacataaaagaagcaacaagggagaagacatcattcatctggccaataaatctcttcatttttccacagtcaaagattcagttgtactatctcttcatactgggaggatctattctgttcttgacttgattttagataaaactgcagatgactcatttgatgagatgtataatgggaaagcttcaccatttgcttcatttgtggactactaccatcaaaagtagttgctcatttttaattttgtcaattcaaggatggatccactatgttatgcttgctcactaatttctccgttctcaactatatgtaggtatggtattgttattcaacatccagggcaacctttgttgctgttaaagcaaagtcacaatgcacacaacttacttttttcaaaaatgaagtaccaaggtactgtagtctcgatgtagtagcattctttccttttttctgttgcataatttgagatggtaattgtgttactttggctctgcttttacatggtattccatccaatttatggcagatggttcaactggcaatcctctgctcgtagaaaaagagcaaattcatgcccgagttccacctgaactactcatccatattgatgtcgcaactgatattctcaaatcattttacttgctcccttctgtaatgcatcgggttcagtctttaatgttagccagccagcttcgcagcaacattagttacattcaacgcataccaagttctctggtctgttctctcatggtattacatattgttttatttgttaaggatagtaatgcatataatgacttctcttcatgctagattttggaagctataacaactttaaggtgctgcgagtccttttctctggagcggttagagttattaggagactcagtactgaaatatgtaataggatgtgatctgttcctaagatacccaatgaaacatgaaggccatctctctgatatgagatccaaggcggtatgcaatgcgacactgcataaacatggaatatggcaatccctgcaggtagatgctttcaagcctaagttcatttgtgtgatcattttgctgaagttcataaatggatctgtcaatattcttacatcataattgaaccagttttgtctgagagtgacaccaataattcattgtcgtcatttaacaaaacttggaatttcccagaaggtttatcccgaaggaataagatacatgctattcatgctagaatggatagactaatccagttagacattttcatgttctgtgctacccatctgtagtttcctattataggcctaatcacttgtgtcatcttttctttgaagtctttcctttttattaggtttgtttttatttaatgtatatctactaatgctttcagggttatatacgtgatgctgcatttgaccctcgtcgttgggttgctcctggacagatatcattgcgcccttttccttgtaattgtggaatcgaaactgcatttgttccttttaatggaggttatatcagtgacgatccatcttttgttgtgggaaaaccatgtgacagaggccacagatggatgtgctcaaaaacagtatctgattgtgttgaagcactagttggagcatattatgttggtggtggcatcgctgctgcaatttgggttatgaggtggtttggtattgatgtcaggtgtgatatggaactagtgcagaaagcaaaatataattctaatgcatctcgaatgtgctatttatcaaaaataaaagatattgaggaactggaagcaaaactgaagtacaacttctcggtcaaaggccttctgcttgaagccatatcacatccatctgtacaggaattaggagttgactattgttaccaggtcagtgaagcagagtttcagtacattagtttattgcatttaagtcacattgatatacatatcttaatttctgatttgtaacagcgtctggaatttcttggtgattctgtgctggatctattaatcacacagcatctctatgctacccacactgatgttgatcctggagaattgacagacctgcgttccgcttcggttagtaatgagaattttgcacaagcagttgtaagaaacaatattcataatcatctacagcatggatctggaatacttttggaacaagtaacagaatatgtcaggtccaacttggagtaccatggtaaagagaatcaattccttcaacaagctacatgcaaagcacctaaggttagaaaacttagttctacttctgtttgtggattagcagcctatttttctttattgtatttttatatatttgagtgaataacatggagctctcctttgtgttcccattaaaaattgtgctttcattgtttgttcaatatttatctatttttactcagcaacgtagaactttccaaggcataggaagctaattttaatttccttgcacaggttcttggagacatcatggaaagtattactggtgcaatatttatagatgtaaattttgatgttgatctggtttggaagattgttgaaccgttactttctccaatgattacccctgataagcttgcgttgccaccttatcgggagttgctggagttatgtagtcaccttggttgcttcatagagtcaaaatgtactagtgaaggagaagagttaattattgagatgaaggtgcagttgcgagatgaacaactgatagcacaaggacatgacagaaatggtaaaaccgcaaaggcaaatgcagcagcccgaattttggtcgacatgaaggtatatcttttcaaacagaaacaaaatatcaagaaatgtctagtttaaggggttgggcaggtccattgtgaaagacagtgtattgggtaaatgttgaatgattaatgggagcaaaggctcgtctacatataggcaaggatgttcacaggaataggaaactatcctagacaataggaaactctcctagacaataggaagcaatcctagacaatccaatcagggaagatccttgcctattagaaccaattaaccaaactaggggacgacgcacaaggcaacatgcctgtgcagccgcactaccctaaacccaagggacctgcctaacatagcccattttaacacccccctagtcagatcgtcaaccactgcacaagttcaaactggtcctgaattcagtgaagactgatggaggcccttggtgaagatgtctgcatactgtgatgtcgtcggcacatgcagggcatgtagatcaccagcagaaacccgttctctgacgaagtgaagatcaatctcgatgtgcttggtgcgttgatgctggacggggttggaggtcatgttggcagcactgatgttgtcacagtacaccaatgtagcttgacgaagagggacgtggagttccaagaggagctggcacaaccatgtagcctctacaactccgtttgccagaacgtgatactcagcttcagcactagacctcgagacaatgttctgacgcttggaggactaggagacgaggttgtcaccaaggaacacatcatagcctgaggtgaacttgcgtgtatccaggcaatccacccaatcaacatcagtatagaccacaagatcagtcgttgtagatggtcacagcaggaggccaaggtcaagggtgccacgaatgtatcgaagaatcctcttaagtgcagcaagatgtggtcccaggagcatgcatgtcaagacaaacttgctgaacaacataagcaatatcaggccgagtgaatgtgagccactgtagtgcaccagcaagacaacgaaaatccgaggcgccagtcaccggcgcaccatctgctgaggcaaccttcgggttggtgttaactggtgtcagacagggcttgcactctgacatccctgcgggctcaaggagctcgaccatgtactgcttctaagaagaagaccatcgtctgagggctgaacatgcataccaaggaagtgatgcagcacaccgagatccttcatggagaactcctgttgcagggctaagatgatatgacgcaggagggcagaggaggaagcggtgaggacaatgttgtcgacatagagcagcaaataagcaatgtcggatccacactgaaagacgaagggtgacatgtctgacttggcctcaacaaaactaagggagagcaaatatgtggcaaatcagttgaaccatgcgcgaggagcctgcctcaaccatagagggacttgttcaatcgacaaacaagatctggatgtgtagggtcttccaatccggatgactgaatgcagtacacagtcttggacagagtgccatgtagaaaagcattcttcacatcaagctggtgcttaggccatcgctgggatagtaccagggagaggattgtgcgaaccgtagctggcttcaccacaggactgaatgtctcaaagaaatccacacttggacgctaggtgaaaccctgaagaacccatcataccttgtgccgctccagtgtctcgttggcattgaacttgtgcttgaagacccatttgcatgtcaccacgttggcatgaggtgaccgaggcacgagatcccaagtgtggttatgttgaagggcgacatgctcttcctccatggcggcatgctagctcggatcagcgaggccaccacgataggtcttgggcaccagggagagttgtgcagcatggaacagggctggaacgcgaaagccacgcttagcgcgcgtcgccatcaggtgttggttggtcacttgctggacatcaacaacacccttgggaagcggtgctggagacggtgacgggagcgctggtgctggagacgatgctgttggcgacagaacaagatccgtgggttcccggcgcatgtagacattggtgatgacgcgcgccggagcctggagaggtagaaagcctggcggtgagccacgcgtggcggcgcccggggacatttacgccgcgcggggcgctgacgaaatgcaggcggggcatggggacgcaacaggcgatgacgacgaagtctacaaataatgtgtgcaattgttaaggatgaccaaataatatttataactagacacactgacaaccagagatgtccaaaggttgcaatgtataagatcaaacttattagatgcatgagaggtagacacatgaaagggcaggtgagcatagcgccctagctgacaagcatgacataaagtggaggaatctctaaatgaatggagacactagacgcgagcttcgatagagcttcatgaccaggatgaccgagatggcggtgccaaggggggaggtggccttggcgacaaaagattgagctggaggaaggtgtaggggtacaggaccctagagctattgcgcctgatgatcatgttctgagtttgcagatccttcacagaacaaccagcatggtcaaactcaacagagcaattgttgttgatagtaattggcaaactaaaataagattcttaataatttgtggagacacaaggatattattaagaaataaagagtgagataattcagtacagccagtgtcaaccataggaagcagggagccattgccgacaacaatggatgaaggagtaggatactgcagggaaaaagtgtgtgaaagattgttgtaagaagatgtcatgtgggaagtagcacctgaattgaagtaccactcggtggacgggggttgctgcagcgtctccgtgctaaacccagaggccagcgactgattgtccctggagggcaggccgaccatggggtgatagaaccctggcggagcccattggtccccttagttggtgcagaaggagcaagagcagcaggtggctgctgctgggcgacgaaggcctgctgctgaggacgaggctgggaaattggcgacagaggaggacgtgtgccgggccacatgtggatggtgcctatccacgggttgtagaccgatggccaagggccagccgccggcataacatctttggtgtcgggctgctgctacccgctgttgttgctgcctgccgctgtcgtggccaccggcacgcttgctgcgactactgttgttcttggagctgttcccatggccacccccaccccgcgagttgaagtcggagagctgtgggggatgttgcgaggacttggtggcggcggcaagagcgacgaccataagaggccgctgatttgccagggtgaggtcatcgcagacgtcgaggtaggaggggaagggtcgagcgtgacgaagcagggcgccgacatgggtgaagcgctcattgaggtcgcgaatcacattgaggatgagggtgcggtccgagacgacttccttgagggcaccgaggtcgtcggccatcttgaggcggcggtagtactcggcgatggagatcgccctggacgaagttgtgaaaccttgtctcaagctggatggcgtgtatctcccgtttcccaaggaaccgaactcgacggcgagccaggtgtcccgggcagtgccaccctgggaggagacaatctcgacaaggtcgtatgtgaggcagtcgaggttctaggacttgacacaatccatttgatcccaatccggagaggggaccagggcgtcgaggtggacgtgatcctagagggagaacttgccgagggtcagtaaaaactaatgacgccaacggttgaggtggccagagttgacgttgaggacgatgtggacgaggctctggatgttggtgacaacgacgaccttggcgtggaggtggagggcggcggcctcctgcagtagcctggcgccatggagatccacaggcgtgggcatagaggacttgtccctgtggagcggggggcaagggcgatgccagtggcgcgagcctcctcctctgtcgcggcgaggcgggcaagggccacgtcgtaggcccgctggcgcttcaaggcgacgacgctgaccatttccgtggcccggcgggcggcgatctcgtcctgctggacgtgggtgtggatggccgaggatgacgagtcgacgaggccggcggtagccgccctgggcggtgtcgcccttgggcgacggaggcgcaatgccgagcatggcgctgcacagcagggagggtggcgcgcgggcgctataggtcagtaagacgggcgctgcacggcagagaagccgacacgcttattggggcggaagcgaagaaatccgatgtggaaccctgacaattgataccatgaaagacagtgtattgggaaaatgttgaatgattaatgggagcaaaggctcgagtacatataggcaaggatgtttacaggaataggaaactatcctagacaataggaaacaatgaagatccttgcctgttagaaccaattaaccaaactaggggagggcgcacaaggcaacatgcatgtgcagccgcactaccctaaacccaagggacctgcctcatatagcccatgctaacacattgtgatgctaatgggtagttcaacttcaactacacaccttgggtgtaactttctattctattgtaatgactgctttggcagtagatgctactccttcctgtcggaaatccatgatggtttgaaccggtggcttgaactgtaggcaaaatctgcctctcgagcgtcatgtatttttttgaaaggatggagtatgttttgctgactattttagaactggtttaatttttttctgaatgcagaaacggggtctctctcttaaacaatgcatctcgaaggctaatcaattggatattgtctcttcaaaactgcaatcagaattgacaaatgtaagcttataaagtgtttcccacaaaatggtacatcaaagtaatgaacttaattctgattctctgagtaatgaatagtatcgcatctctgtagttggaatcgcgacatgattgtcctcacatgaatggcactcttagcctaggtctttcctcagcgagagcagcaggtaatgccctgttttggttaattactctccctctgttccaaattatagttcactttagatttatcttaagttcagtttctctaactttgaccaaatttatagaaaaatgtatcgacatttacaacatcaaattagtatcattaaatccttcatgaaatatattttcatagtgcatttacttgaacctgaggtattaatatagtgttattaaaacttcttcaaagttagggaagtttgaattaagacaaagctagaatgaactatgatttggatgaatggagtatatggtactcactggtcagggtatcaaataggaaatattagtaattagatttgttctatacctagctctagcagccacaaaatacttagcattactcagatgtcatggcctttcatatgctttcagttgttcttcctctcaaaatggacaaaggtggacctcggactgcactttttaggctatgcaagagtttacagtggccaattccagaatttgaatttgtggaacaaaggtttaggtat

(The sequence listing continues in the following parts.)

What is claimed is:

1. A method for enriching asexual embryos and endosperm in a seed population of a dicot plant, the method comprising: providing a dicot plant comprising an asexual female gametophyte defective for RNA-dependent DNA methylation (RdDM) activity, wherein the RdDM activity is defective for RDR6 (RNA-DEPENDENT RNA POLYMERASE 6), and wherein the asexual female gametophyte of the dicot plant is also disrupted for activity in Fertilization Independent Embryo (FIE), wherein the dicot plant is *Arabidopsis*, canola, cauliflower, cabbage, broccoli, turnip or radish, wherein the seeds formed comprise parthenogenically-derived clonal embryos.

2. The method of claim 1, wherein the asexual female gametophyte of the dicot plant defective for RdDM activity is defective for:

(a) a nucleic acid having at least 90% identity to the full length of a nucleic acid of any of the nucleotide sequences set forth in SEQ ID NOs: 5 or 59, or a fragment of a nucleic acid having at least 90% identity to the full length of a nucleic acid of any of the nucleotide sequences set forth in SEQ ID NOs: 5 or 59, a complement of a nucleic acid having at least 90% identity to the full length of a nucleic acid of any of the nucleotide sequences set forth in SEQ ID NOs: 5 or 59, or combination thereof; or (b) a polypeptide having at least 90% identity to the full length of a polypeptide of the amino acid sequence set forth in SEQ ID NO: 91 or a fragment of a polypeptide having at least 90% identity to the full length of a polypeptide of the amino acid sequence set forth in SEQ ID NO: 91, or combination thereof.

* * * * *